United States Patent 9,567,581 (SELECTIVE REACTIVATION OF GENES ON THE INACTIVE X CHROMOSOME) - sequence listing, part 48

SEQ ID NO: 5028 - DNA, 15099 bp, human
ggtgggggtgggggtgggggtggggggtgggtgagaaaaaaaagaggtgggttcgcctggagtccctgcggccgccgcggaaggcccccgcttctttccccgcggcgagcagcagcgctggggcagcggagagacagaggagccagcgggtggccatggccttggcgtgacagagcctccccggcggccgggcgggtgcggacggcggggtaagcggcagtagcttgatccgggtgggagttgggggaggcggcggccggcgccgcaggttcggggcgggggtcagccgggtaatgtgcgtccttctccccttcacaggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggtaaccaaaccaagtcttgtaatttgttagaagggggtgtggtaatccgacatcgacttctgggttgcttgaaccgtgcattaatgactgtgctttgcttttgaaagttagacatgacgcatttttgaggttactcctgccatggaagactatcgggttgtttctatagagcgtagtaaaaagtaacaagcgtcaacaaatattttaaagctatttttaagtgaaagaaaagtgaaaaagaaatgtcagtctgtgtatatttcgcctggaatataaccttctgaagttgcttgctcaattcaacaagtattgattaacttacacgacaaaacatctaacaaataatctcgggtaaatagagcactttgaaaaaattatttggagccgattatctgttgcacagataagtcctctgtgtctgtcccacccacaccttcccctcccaccccccaacaccccctcccgccgccctccccttctctctcaagtttctcaactagattcataaatcttagtgttgcaagacgaagaactcaagacctgccttctaggcattttacttaattacttggggcgtgtagtaggaagaaaagttactaatagaaaagactagtacctagaattaataaccaacaaaaatcaggaatgactctttttctgcagttgatccaaattgtttctggtaacattgcctgtatttacagaaaatacgtgggtctgggaacactgaacaagtgcagatttcttactccggctgggtggccaaactggatgtggtccaatctcttagaaaatctgtcctgtccttcactgggaaacagactgaaggtttaacgttattttaggatatgcaatgtatgtttctatttatcccttgaaaatgaataacctcatattgacccattatattgacctccattgatttaggaaatggatatattttttctgcatttaaaggtatgcacttaatgtagcttacttaagagaccttaagtgctttagccaatacaatgtgctaattccactttctttagtattttaaattaaagtactatagtgaactttcccagtaacctgatagaacaacttcagggattttttttttttaagatgataaattctggggaaataaatcaaagctattgagaccaaactaaattcattttatgtaggcataaattcccaaacaatagtatcataaaagcattttcccccagaaagtaccaaagtactgaaggtgctgtttgacaggcattttttccctaaaggatcctcaggagatttgttattctatcagcttactctctggaggctgagagtcttttgaagggtgtttcataagatttctgttatatccatttgtgttatagacatgaattgggagtgaaaaactgtgccgttatttcagtggaggtgtaaactcttttgagcccaaatgccctaagtttggattttcagctgaacttatgtttccataaagacaatgggaaataagcgtaacctagaaatctgagttgatatattatcaaaccaaattgatgcaaatatcaaataactatatttttatagattttcatagtcccttgcttttccgtaggcccacatgtgaatattctgtacttactatgacttccaattaagcatacattttctatttaaggcaaacttttaaaattatgaaatattaccgaaaatggtgatttttataattaagtctataatattgtattaaatcaatacttgcccccacctcccaaaactgatgctactggagaattgctaacgctcttatcttttgtaattcgttgtaactacttggaaaaagtaatacgcatggggaaacaagtagtaaaaacaaacacaggcaaaaaaaaaaaaaatgacttcttcccacccagactccccttgcactgtccttcccaggagttgctcactgttacagtagtttctagtgaatttaagtgtattgtaaggtgtttgattttactggaataaatgcataccattcaatttaaaataaaacatttaagtgtatccatctggttgtaactcttttattctaggcattacaaagtggttttttttcccacttaaaacactttcactcaagccctcttgctacatggctaggaatgcatagatgctgcaatcctgtgctaggataacaggtgttacaaggagtgatgacaagcaggcaggtttagggagatggccaaacatccttatgtacgaatggattaatcatttggaaacttgcttttttaatcagtatagactgggggtgggtaaaagtgattatatgagtcaaggttagtgtgcaacccatgttttatattcttgacaaacccagcaggtagggtctctggaaattatctagttcttacttcagtggacaaaatgatgacgatttctctgtttaggtgtgatttcattttggattcagctttgtatactcactgaggtatgactttttgtaatactgtaatatttctgttatggttatacaaacagcataatgtttttctttctctttgtgattgcttgaataggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcaggttagtttttgatggaactgtatgaatcaggtagtgttttgttttttgatcaagtaaaacaaaaagctggttagtgttaatacatatggcactgccttaaatttctttatttttaaaataacattttccatcacacaaaatagtcaacattcaatgaagaaaatttttttaaatgcagataagcaaagcggagataagaaattgcttatattcccatcaccaggattttaagtgagttattgttcttccttctctgctttattggtaatatttctttgggttgagttaaaccataatacactttttccctgttcttctgatttagcatccagaatgcacaggagagcactgagtaataatttcagaagttttgtggtattttctgtacttttatgtttttatgtcctgagcaagcaaattgctgcaattaaaatcaccaatttactaatcaccaagtgcttgattaacagtacaattatttaagcaaattcatctgtacctaacacttgagggacttaagtgacctctgataataacaaattatagtgccacagtgtaccctgacttcattataaatatacggtccaaaagataatctagttgaattatctgtgatgtgttagaaggaacagtttcatgcataaaaaaatttattcaatttaataaattatgagattaataggaacagtaacaaaccttcaggcctttcactgagttaaatgataacttacaagttttttttaatgaatgagtttttttttaaaactcatacttttttaaaagtaagattatgtaaaacttacgaagcatttaaaacaagattatttatgccatgatcttttagtctagattgtaattgagcaaatagtctcacttagacagtaacacttagataataagataaaacaaccaatattgtgaatgactgagaaaccgcagcaaatgccagactagcctgacagtatcaggaatgaaattgatcttcctgagccaaggctgacctcgagtctaggaggcagtgttgcaaatggcaacaggcatttcagattggagcaatgattcctaatcaagggtctggctttgtgtatgctccccggagaaaagactaacggtccctaatttatcttttcagacaaggtctcctgtcagatagtgtcatctttgaaaatgaaggatgacaacaatgctttatttaaaatgctttcactcatcagcctttagcataccagaatatgatgaaaactcatttattttcttatgtctagctacatctattattttataaagtcacttttcagaccatagtccagcttgtgtttggttgatagcattgtacttgcagtatagtcttttgaggaggggagaggcttatggatcaagtcccatattcttgctgctgtaatctctctccttaaattgtaagccagcttcacaattgaacaagttctgtgtggtgattgtgtctttactgttttgctctatttttctacctgacacttactgggcagataacgtaagtgtctatacacattttgtgttagttttatcatctttttaaaaattaaccaactcccacgaaatgttcccagttttccttccatcattagtgtagacagctataggaggttaactgaataaaattggtctcatacatgtagagagccagctctctcagccaaattggcaggtgaataatttctaaagctatttttgaacctcttcttctgaatcatttctgagtttatttcatttggtaactttttgtgatctgaattatttttaacctatttagttacctacaggaatgagtacatagattttttttagtatctcaagccaactatatttgtattttttgttaattaacatactaaaaatggaaattattaatacctatattcatttttatagtagtgggtcaagttctctgtgtaggtttttgtttgtttttgtaagcagaatatataaatgaagatattagccttgaaataaaatatccaataaactgaatttctaaaaatattaaggggaactccctgaccaagatcttttagaacaaagtgcactatatgcaggttttttttttttctgacatcaaataaaattgaactgattcccatatatgggaatctctaatctgaggctagtaaaatttgtggttgtccttgctcaccatttacctaagaagagaagaaaatagatggtggattttgaatcctatagcttgagtcatggagctttgaaatctgtcagacccagatctaaattgaatatcaaactttgacaggtaaagttgatttgagaaatgtttgtcgctaatatttagaagagtaccttgtccaagttagaaataataggatgtaaatcagaaacactgttattgttgttaattggttgtttttaactgagagggaaaatttattaatgctctaagaattgcttctgataattcctcacatttatgtcttaacatctttcaatttgggtcacaggcctcgtgcctaacacctgtttatctgcgtggctcccaggattgtttcctcaccttttaccctcccattggcagtaactttagtgtaagtttggaagcataaccagattccttatacgctgccatcatcctgatttctttactgatctgaggagcgtatgatcaagtgctttgaagggacttcttttgctgtatggcagcagtataatggaaacccgggtcagcattgtcaccctgttctggtttcattcactatatcatagctcttctgtgctggtataaattattggcagttcactgtttgggtatatttttgttgagaaggattgatgttttgttaataatctcatagtactataaaagaagtaaatcactgtcctgtgggagttcagggaaaggagagaccacaaccaactggaacagagtttcttaacattctgggatctttgctgtttggggctgtcctgtgcattgtcagatgtttaacagcatccctagcttttacccactagatgacagtagcatcttcctcatcccccattatgacaagaatatctccagaaattgccaaatgccccctggggacaaaaattgcccttggttaagcgccaccgagttagagatattgggagcaatagcatttgaatcaggctttgaagatggataggacttgaggggactggtggtaggggtggggggtgtcagtgttgaccttcaaacagaaagaatgccaagaaggagcataatcatatcctaaaatattctgttgattccctaatagtaagggggaagtgcagtaaaggtgtctcttaaatgtgacagtttgatatatccttttggcaaatagaatattttaaagatgatttttcaaggattcctttatgtcagtccagtattgatgaaagtgataaagaaagaaaatgggggaaaaggtgttattcactgtggtttgaaggtctcctgtaagattttataccatttttctcagtgtactgtggaacaggttctcccaactagagtaaatggtgcataagagtaccaaacacagggaagcaaactgaaaggacaaagatcattatttatgtcagccccagttcattatatatttcagcctgaagaaaaagggagattcttggttcaagactagcacgtcattttacatggcagcagaatgcctgggatgctaacaaaggctactgaaagactaaactctatttgaacatcattttagtctagctagacttactattcctaaatacagtggaattgataaacattttcagggttttttaaaataaaatatagaatcagaatggtttttaatttttttaacttttaattttagtttttaatttttatggtatgctgggggtttagcaaatgtgaggagaaaaatcctcaaatcacatcacatacttaaaatttcctatacaaggtaaatattaataatatcagtaaaatgctggggtggaattctgttgtagaagttatagttttgttagatagttctttttttcccactgctctatttgcatatcactttgaatggggaaaatggcttatttaaaatgctcatctgtcatccagttcacatggtgagtcaaagtggagcagaggagttgaatggaagaagaagcatgctttgggggtggtatgtaccataaaggccctcagcgaaccttgggtaaaagggaaaaacaaaaccaccttgccctttctactactcctaattctcccagaccttcactgaattcatagggttggttcatggtttgagacttgagagtggacaggtgcctagttagacctgctctggatgtggaggtgtctggtgattagaatgactctttgtatatctgttccctctttaattgcttccttttaacctcaagattaggcttttattgcataataaaatgcatatgagccattcagttttactccattacctctctggcttagaatgaactatcagtagaattaacaaaaattgcatcatagagttggagaattgccaccaaggaagtgttctagccatactacagaaaagattctccccatgggattacttctcagtagaattctacaattcagaagataatatcagtaagaaaaacttaagtcctgtcagctgttagaaaaacatatccaatcaaaaacatactcccaagtagttttaattagccaatcttagaaacatcaaattcagaaaaagcaatttagagttgaggggagtactaacttatctggtctaattcaaagctagcagctggaattgtatcattgggctcacactgttgtttattatcactggacttggttataatatgtgagatctcagaattgaactaatcatattaatttaaacattcagagattttaggtctagtacataagaaatatagctaatcccatcccttctaccctgggttcactataaacatttagtgagcttgctttccttcatgtgtgattccacctccattcaaggattctatgccataggttccgcttttgctctctgtgtttaatgggtgacagtgaacacgtttaaagatctagtcctcccactccaaccctagtaagcttcatgagtattatgcacattaggatagagaaacaaaacaaaagatatttaacaaaaacataacctgtatcagaggaattccagcctgaggccagatgcagtggctcatacctgtcatcccagcactttgggaagccgaggtggaaggatcacttgaggccaggagttcgagaccagcctgggctatgtaatgagaccccgactctacaaaaaataaaaataaaaaacttagctgggtatggtggtgtgtgcctgtagtactagcggttcaagaggctggggtaggaggatcccctgagcccaggaattccaggttgcagtaagccacaattgcactactgcactccagcctggatgacagagcaagatcctgtctctgaaattaaaattattattaaaataataattttaatgttttattaaaattattaaaataatttaatgttttattaaaattattactaaaataatttaatgttttattaaaatagcacttttgatgatttattaacatcattattaaaataacaatttattaaaattataattgcagcctgatgttttgctaatacaactaacttttaacttgtaaataaaatgctaattaaatatgaaaggaaattcattttcaaaaaaagtattttggttaaatcccaagaatatcatatccctaaaactagaaaaaaattaaaagtgattatgattacacactagtatttgtgagagagagagagagacaatgctagtaaataccattgtatttagataaggtaagtccagttaagctaaaaagacattcataaactgctaagcctttcaggagcctttgttaacataccaggcattctgctgccatgtgaaatgatgtgctagtcttgaatcaagaatcccctttttttcttcaggctgacataaataatgatctttgttccttttgttctgtgtttggtactctcgtataccaatttacccgacttgggagaccctatttatttcataatttcctgagcaaaagctttggattagtgtgtgtgtgtgtggttttttttttgtactttcctataatattgcattagtaaaaagctaaaaagtaaaaccaaacaattaagtaagagtttgaatagaagcttccagagataagatttgttgagtgtcttgctggaaacttgagagtgaggtcgaggataacttgtgttctatcttgaaagctgcaagttatacatttgcaacgtgcttgaatgtgatatcctgcaagttaaaaagtactgatttgaccagctgcttttaaaccttcagcgatttatttttacgtaaatgaaagtgttagtatattgaaaattttgctgtcactggggagcaagaacatttacacttgaaattctaacctgaaagagactgttgtttttgtttaatgcaagcattttacttcaggatttattactgcagataattataatttattactctcttgaaaagtagctagtattaatactttgtttgcttaaaggtatgcctaatgttaatattgtagagcctaactcaggatttatctatatctcttgatttcacaggagtattgtcatcctgtggatgtggatagaccaaatgttacccaggtttttagagggtaggaggtgattaatatatcatgttttattccatatagattatggttagtaaaatgatttgattattaatatttattttggctagaaataaataataactactttctcaatttgattttagagaatgcttgaagaggtctttaatatttaagagaaataattatttttgaaaatcccaacctctttataattgtttgatttaaaaaaggaaatgaaaatttatagcaaattcattaattcaaactaattgaaggaagtctttctaaattactaaaaagtattcataatgaataatttttattcataatactgcatatataatgaaatactgttgtgttcaagtaggtatagaaattccagctaggctaaaaaatataaagctccttagtctggatatcaaaattacaatcctggtagtctagaaatttataacatagttggaaatggaaaacaaatttacaacaaccctgtgaagaaagtatttttatccctttttcgatgatgaggaaaccggacttgccaaagcttaaataactggtgtcctaattaacaatttaatgcaaaatgtcttttaattggaagaatgtttctataataatttctaaagaggcagacttttgttctattttttcctaatgtgtttaggtagcagaatttcaataatgagcagagtgatgttctttaatagtaatcatttttatgatatagctgctaataaagcattatctcaggctctttgagcactaatagaagtgtagctgtcaaatgaaattaaaattatgcatttataaacattggtagagcccttaaatgattataaactggtttcccttggcattctttcatagttgctgttctacttttgtttctggctttatgataacattttttatctcatgcgttcaaaaacaaacataactctattcccctagaagctatttggtgattcagcacagttgaaggacgctctatctgtctgaacgatagattttttttccctagtattagctggaagggcagaaatctgtacgctataagagcagggaatgaggaatcccagtcataaaagaagatcccgtggttgggaggacatccccaaaaaagggcagacccaagtggaaaatgtgaactgctgctatcacctagcatctgaccttacctaggcacctagtaggtgctcaatatctagaccttgattgaatttccttccttccttcctccctccctccctctttcttctcttttcttttttcttttcctttcttttcttttttctttctgcagtcctcccaccttggcctcctagagtgctgggattacagacatgaaccactgtgcccggcctgaatgacgttttcttattttaatctctcaaaaaactaaatttaggaaaagtctaacatactgccaattaactcataattaacatgcatttgataacaataccatttccagttaaaatgtgaagagatcaagttcaaagtagaagcagcatttgcaacaacttttatactgtaagatcatttaaaccagtaaggacatttttaatattgcataagtataatacaagtacaaggcataataatattatagaaataagctagaatagctacacacacgcacacacacgcacacacaaagtacattatatccaatgcatcacttctgtgtttctatttttttttaatgacttatcaggacgagggaaaattaactttctactttaactgaagtttgttattcttgttaccacttctctgtgtatatagatctgttgtcagtgttctctttttaaactatgtatttctacatttttatgacatgtttatcttaattgcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactg

SEQ ID NO: 5029 - DNA, 12883 bp, human
ggcccgttcccgaagccggagtcccgacccgaaaccgtccccggccggctcgctcgctcagcagggcgcggctccagcgccacccggctcgccccgaagaggtgggactttccccaccggaagtgatcccgtccagtctcggggaactggggcacctcagccagtgtgtcagggaaacccttccgggtgtgtgcttggtgggggtgggggtgggggtgggggtgggggtggggggtgggtgagaaaaaaaagaggtgggttcgcctggagtccctgcggccgccgcggaaggcccccgcttctttccccgcggcgagcagcagcgctggggcagcggagagacagaggagccagcgggtggccatggccttggcgtgacagagcctccccggcggccgggcgggtgcggacggcggggtaagcggcagtagcttgatccgggtgggagttgggggaggcggcggccggcgccgcaggttcggggcgggggtcagccgggtaatgtgcgtccttctccccttcacaggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggtaaccaaaccaagtcttgtaatttgttagaagggggtgtggtaatccgacatcgacttctgggttgcttgaaccgtgcattaatgactgtgctttgcttttgaaagttagacatgacgcatttttgaggttactcctgccatggaagactatcgggttgtttctatagagcgtagtaaaaagtaacaagcgtcaacaaatattttaaagctatttttaagtgaaagaaaagtgaaaaagaaatgtcagtctgtgtatatttcgcctggaatataaccttctgaagttgcttgctcaattcaacaagtattgattaacttacacgacaaaacatctaacaaataatctcgggtaaatagagcactttgaaaaaattatttggagccgattatctgttgcacagataagtcctctgtgtctgtcccacccacaccttcccctcccaccccccaacaccccctcccgccgccctccccttctctctcaagtttctcaactagattcataaatcttagtgttgcaagacgaagaactcaagacctgccttctaggcattttacttaattacttggggcgtgtagtaggaagaaaagttactaatagaaaagactagtacctagaattaataaccaacaaaaatcaggaatgactctttttctgcagttgatccaaattgtttctggtaacattgcctgtatttacagaaaatacgtgggtctgggaacactgaacaagtgcagatttcttactccggctgggtggccaaactggatgtggtccaatctcttagaaaatctgtcctgtccttcactgggaaacagactgaaggtttaacgttattttaggatatgcaatgtatgtttctatttatcccttgaaaatgaataacctcatattgacccattatattgacctccattgatttaggaaatggatatattttttctgcatttaaaggtatgcacttaatgtagcttacttaagagaccttaagtgctttagccaatacaatgtgctaattccactttctttagtattttaaattaaagtactatagtgaactttcccagtaacctgatagaacaacttcagggattttttttttttaagatgataaattctggggaaataaatcaaagctattgagaccaaactaaattcattttatgtaggcataaattcccaaacaatagtatcataaaagcattttcccccagaaagtaccaaagtactgaaggtgctgtttgacaggcattttttccctaaaggatcctcaggagatttgttattctatcagcttactctctggaggctgagagtcttttgaagggtgtttcataagatttctgttatatccatttgtgttatagacatgaattgggagtgaaaaactgtgccgttatttcagtggaggtgtaaactcttttgagcccaaatgccctaagtttggattttcagctgaacttatgtttccataaagacaatgggaaataagcgtaacctagaaatctgagttgatatattatcaaaccaaattgatgcaaatatcaaataactatatttttatagattttcatagtcccttgcttttccgtaggcccacatgtgaatattctgtacttactatgacttccaattaagcatacattttctatttaaggcaaacttttaaaattatgaaatattaccgaaaatggtgatttttataattaagtctataatattgtattaaatcaatacttgcccccacctcccaaaactgatgctactggagaattgctaacgctcttatcttttgtaattcgttgtaactacttggaaaaagtaatacgcatggggaaacaagtagtaaaaacaaacacaggcaaaaaaaaaaaaaatgacttcttcccacccagactccccttgcactgtccttcccaggagttgctcactgttacagtagtttctagtgaatttaagtgtattgtaaggtgtttgattttactggaataaatgcataccattcaatttaaaataaaacatttaagtgtatccatctggttgtaactcttttattctaggcattacaaagtggttttttttcccacttaaaacactttcactcaagccctcttgctacatggctaggaatgcatagatgctgcaatcctgtgctaggataacaggtgttacaaggagtgatgacaagcaggcaggtttagggagatggccaaacatccttatgtacgaatggattaatcatttggaaacttgcttttttaatcagtatagactgggggtgggtaaaagtgattatatgagtcaaggttagtgtgcaacccatgttttatattcttgacaaacccagcaggtagggtctctggaaattatctagttcttacttcagtggacaaaatgatgacgatttctctgtttaggtgtgatttcattttggattcagctttgtatactcactgaggtatgactttttgtaatactgtaatatttctgttatggttatacaaacagcataatgtttttctttctctttgtgattgcttgaataggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcaggttagtttttgatggaactgtatgaatcaggtagtgttttgttttttgatcaagtaaaacaaaaagctggttagtgttaatacatatggcactgccttaaatttctttatttttaaaataacattttccatcacacaaaatagtcaacattcaatgaagaaaatttttttaaatgcagataagcaaagcggagataagaaattgcttatattcccatcaccaggattttaagtgagttattgttcttccttctctgctttattggtaatatttctttgggttgagttaaaccataatacactttttccctgttcttctgatttagcatccagaatgcacaggagagcactgagtaataatttcagaagttttgtggtattttctgtacttttatgtttttatgtcctgagcaagcaaattgctgcaattaaaatcaccaatttactaatcaccaagtgcttgattaacagtacaattatttaagcaaattcatctgtacctaacacttgagggacttaagtgacctctgataataacaaattatagtgccacagtgtaccctgacttcattataaatatacggtccaaaagataatctagttgaattatctgtgatgtgttagaaggaacagtttcatgcataaaaaaatttattcaatttaataaattatgagattaataggaacagtaacaaaccttcaggcctttcactgagttaaatgataacttacaagttttttttaatgaatgagtttttttttaaaactcatacttttttaaaagtaagattatgtaaaacttacgaagcatttaaaacaagattatttatgccatgatcttttagtctagattgtaattgagcaaatagtctcacttagacagtaacacttagataataagataaaacaaccaatattgtgaatgactgagaaaccgcagcaaatgccagactagcctgacagtatcaggaatgaaattgatcttcctgagccaaggctgacctcgagtctaggaggcagtgttgcaaatggcaacaggcatttcagattggagcaatgattcctaatcaagggtctggctttgtgtatgctccccggagaaaagactaacggtccctaatttatcttttcagacaaggtctcctgtcagatagtgtcatctttgaaaatgaaggatgacaacaatgctttatttaaaatgctttcactcatcagcctttagcataccagaatatgatgaaaactcatttattttcttatgtctagctacatctattattttataaagtcacttttcagaccatagtccagcttgtgtttggttgatagcattgtacttgcagtatagtcttttgaggaggggagaggcttatggatcaagtcccatattcttgctgctgtaatctctctccttaaattgtaagccagcttcacaattgaacaagttctgtgtggtgattgtgtctttactgttttgctctatttttctacctgacacttactgggcagataacgtaagtgtctatacacattttgtgttagttttatcatctttttaaaaattaaccaactcccacgaaatgttcccagttttccttccatcattagtgtagacagctataggaggttaactgaataaaattggtctcatacatgtagagagccagctctctcagccaaattggcaggtgaataatttctaaagctatttttgaacctcttcttctgaatcatttctgagtttatttcatttggtaactttttgtgatctgaattatttttaacctatttagttacctacaggaatgagtacatagattttttttagtatctcaagccaactatatttgtattttttgttaattaacatactaaaaatggaaattattaatacctatattcatttttatagtagtgggtcaagttctctgtgtaggtttttgtttgtttttgtaagcagaatatataaatgaagatattagccttgaaataaaatatccaataaactgaatttctaaaaatattaaggggaactccctgaccaagatcttttagaacaaagtgcactatatgcaggttttttttttttctgacatcaaataaaattgaactgattcccatatatgggaatctctaatctgaggctagtaaaatttgtggttgtccttgctcaccatttacctaagaagagaagaaaatagatggtggattttgaatcctatagcttgagtcatggagctttgaaatctgtcagacccagatctaaattgaatatcaaactttgacaggtaaagttgatttgagaaatgtttgtcgctaatatttagaagagtaccttgtccaagttagaaataataggatgtaaatcagaaacactgttattgttgttaattggttgtttttaactgagagggaaaatttattaatgctctaagaattgcttctgataattcctcacatttatgtcttaacatctttcaatttgggtcacaggcctcgtgcctaacacctgtttatctgcgtggctcccaggattgtttcctcaccttttaccctcccattggcagtaactttagtgtaagtttggaagcataaccagattccttatacgctgccatcatcctgatttctttactgatctgaggagcgtatgatcaagtgctttgaagggacttcttttgctgtatggcagcagtataatggaaacccgggtcagcattgtcaccctgttctggtttcattcactatatcatagctcttctgtgctggtataaattattggcagttcactgtttgggtatatttttgttgagaaggattgatgttttgttaataatctcatagtactataaaagaagtaaatcactgtcctgtgggagttcagggaaaggagagaccacaaccaactggaacagagtttcttaacattctgggatctttgctgtttggggctgtcctgtgcattgtcagatgtttaacagcatccctagcttttacccactagatgacagtagcatcttcctcatcccccattatgacaagaatatctccagaaattgccaaatgccccctggggacaaaaattgcccttggttaagcgccaccgagttagagatattgggagcaatagcatttgaatcaggctttgaagatggataggacttgaggggactggtggtaggggtggggggtgtcagtgttgaccttcaaacagaaagaatgccaagaaggagcataatcatatcctaaaatattctgttgattccctaatagtaagggggaagtgcagtaaaggtgtctcttaaatgtgacagtttgatatatccttttggcaaatagaatattttaaagatgatttttcaaggattcctttatgtcagtccagtattgatgaaagtgataaagaaagaaaatgggggaaaaggtgttattcactgtggtttgaaggtctcctgtaagattttataccatttttctcagtgtactgtggaacaggttctcccaactagagtaaatggtgcataagagtaccaaacacagggaagcaaactgaaaggacaaagatcattatttatgtcagccccagttcattatatatttcagcctgaagaaaaagggagattcttggttcaagactagcacgtcattttacatggcagcagaatgcctgggatgctaacaaaggctactgaaagactaaactctatttgaacatcattttagtctagctagacttactattcctaaatacagtggaattgataaacattttcagggttttttaaaataaaatatagaatcagaatggtttttaatttttttaacttttaattttagtttttaatttttatggtatgctgggggtttagcaaatgtgaggagaaaaatcctcaaatcacatcacatacttaaaatttcctatacaaggtaaatattaataatatcagtaaaatgctggggtggaattctgttgtagaagttatagttttgttagatagttctttttttcccactgctctatttgcatatcactttgaatggggaaaatggcttatttaaaatgctcatctgtcatccagttcacatggtgagtcaaagtggagcagaggagttgaatggaagaagaagcatgctttgggggtggtatgtaccataaaggccctcagcgaaccttgggtaaaagggaaaaacaaaaccaccttgccctttctactactcctaattctcccagaccttcactgaattcatagggttggttcatggtttgagacttgagagtggacaggtgcctagttagacctgctctggatgtggaggtgtctggtgattagaatgactctttgtatatctgttccctctttaattgcttccttttaacctcaagattaggcttttattgcataataaaatgcatatgagccattcagttttactccattacctctctggcttagaatgaactatcagtagaattaacaaaaattgcatcatagagttggagaattgccaccaaggaagtgttctagccatactacagaaaagattctccccatgggattacttctcagtagaattctacaattcagaagataatatcagtaagaaaaacttaagtcctgtcagctgttagaaaaacatatccaatcaaaaacatactcccaagtagttttaattagccaatcttagaaacatcaaattcagaaaaagcaatttagagttgaggggagtactaacttatctggtctaattcaaagctagcagctggaattgtatcattgggctcacactgttgtttattatcactggacttggttataatatgtgagatctcagaattgaactaatcatattaatttaaacattcagagattttaggtctagtacataagaaatatagctaatcccatcccttctaccctgggttcactataaacatttagtgagcttgctttccttcatgtgtgattccacctccattcaaggattctatgccataggttccgcttttgctctctgtgtttaatgggtgacagtgaacacgtttaaagatctagtcctcccactccaaccctagtaagcttcatgagtattatgcacattaggatagagaaacaaaacaaaagatatttaacaaaaacataacctgtatcagaggaattccagcctgaggccagatgcagtggctcatacctgtcatcccagcactttgggaagccgaggtggaaggatcacttgaggccaggagttcgagaccagcctgggctatgtaatgagaccccgactctacaaaaaataaaaataaaaaacttagctgggtatggtggtgtgtgcctgtagtactagcggttcaagaggctggggtaggaggatcccctgagcccaggaattccaggttgcagtaagccacaattgcactactgcactccagcctggatgacagagcaagatcctgtctctgaaattaaaattattattaaaataataattttaatgttttattaaaattattaaaataatttaatgttttattaaaattattactaaaataatttaatgttttattaaaatagcacttttgatgatttattaacatcattattaaaataacaatttattaaaattataattgcagcctgatgttttgctaatacaactaacttttaacttgtaaataaaatgctaattaaatatgaaaggaaattcattttcaaaaaaagtattttggttaaatcccaagaatatcatatccctaaaactagaaaaaaattaaaagtgattatgattacacactagtatttgtgagagagagagagagacaatgctagtaaataccattgtatttagataaggtaagtccagttaagctaaaaagacattcataaactgctaagcctttcaggagcctttgttaacataccaggcattctgctgccatgtgaaatgatgtgctagtcttgaatcaagaatcccctttttttcttcaggctgacataaataatgatctttgttccttttgttctgtgtttggtactctcgtataccaatttacccgacttgggagaccctatttatttcataatttcctgagcaaaagctttggattagtgtgtgtgtgtgtggttttttttttgtactttcctataatattgcattagtaaaaagctaaaaagtaaaaccaaacaattaagtaagagtttgaatagaagcttccagagataagatttgttgagtgtcttgctggaaacttgagagtgaggtcgaggataacttgtgttctatcttgaaagctgcaagttatacatttgcaacgtgcttgaatgtgatatcctgcaagttaaaaagtactgatttgaccagctgcttttaaaccttcagcgatttatttttacgtaaatgaaagtgttagtatattgaaaattttgctgtcactggggagcaagaacatttacacttgaaattctaacctgaaagagactgttgtttttgtttaatgcaagcattttacttcaggatttattactgcagataattataatttattactctcttgaaaagtagctagtattaatactttgtttgcttaaaggtatgcctaatgttaatattgtagagcctaactcaggatttatctatatctcttgatttcacaggagtattgtcatcctgtggatgtggatagaccaaatgttacccaggtttttagagggtaggaggtgattaatatatcatgttttattccatatagattatggttagtaaaatgatttgattattaatatttattttggctagaaataaataataactactttctcaatttgattttagagaatgcttgaagaggtctttaatatttaagagaaataattatttttgaaaatcccaacctctttataattgtttgatttaaaaaaggaaatgaaaatttatagcaaattcattaattcaaactaattgaaggaagtctttctaaattactaaaaagtattcataatgaataatttttattcataatactgcatatataatgaaatactgttgtgttcaagtaggtatagaaattccagctaggctaaaaaatataaagctccttagtctggatatcaaaattacaatcctggtagtctagaaatttataacatagttggaaatggaaaacaaatttacaacaaccctgtgaagaaagtatttttatccctttttcgatgatgaggaaaccggacttgccaaagcttaaataactggtgtcctaattaacaatttaatgcaaaatgtcttttaattggaagaatgtttctataataatttctaaagaggcagacttttgttctattttttcctaatgtgtttaggtagcagaatttcaataatgagcagagtgatgttctttaatagtaatcatttttatgatatagctgctaataaagcattatctcaggctctttgagcactaatagaagtgtagctgtcaaatgaaattaaaattatgcatttataaacattggtagagcccttaaatgattataaactggtttcccttggcattctttcatagttgctgttctacttttgtttctggctttatgataacattttttatctcatgcgttcaaaaacaaacataactctattcccctagaagctatttggtgattcagcacagttgaaggacgctctatctgtctgaacgatagattttttttccctagtattagctggaagggcagaaatctgtacgctataagagcagggaatgaggaatcccagtcataaaagaagatcccgtggttgggaggacatccccaaaaaagggcagacccaagtggaaaatgtgaactgctgctatcacctagcatctgaccttacctaggcacctagtaggtgctcaatatctagaccttgattgaatttccttccttccttcctccctccctccctctttcttctcttttcttttttcttttcctttcttttcttttttctttctgcagtcctcccaccttggcctcctagagtgctgggattacagacatgaaccactgtgcccggcctgaatgacgttttcttattttaatctctcaaaaaactaaatttaggaaaagtctaacatactgccaattaactcataattaacatgcatttgataacaataccatttccagttaaaatgtgaagagatcaagttcaaagtagaagcagcatttgcaacaacttttatactgtaagatcatttaaaccagtaaggacatttttaatattgcataagtataatacaagtacaaggcataataatattatagaaataagctagaatagctacacacacgcacacacacgcacacacaaagtacattatatccaatgcatcacttctgtgtttctatttttttttaatgacttatcaggacgagggaaaattaactttctactttaactgaagtttgttattcttgttaccacttctctgtgtatatagatctgttgtcagtgttctctttttaaactatgtatttctacatttttatgacatgtttatcttaattgcagataaaactcagaggaaatttgcacagatgctgctttggagaactttacaacctgggttgcagaactgagccttggtaaacctgtctctattacagcatgttgccatacatctatttaagtgcataaggtctttggcct

SEQ ID NO: 5030 - DNA, 213015 bp, human; identical to SEQ ID NO: 3720

SEQ ID NO: 5031 - DNA, 214355 bp, human; identical to SEQ ID NO: 3722

SEQ ID NO: 5032 - DNA, 61541 bp, human; identical to SEQ ID NO: 3715

SEQ ID NO: 5033 - DNA, 67676 bp, human; identical to SEQ ID NO: 3716

SEQ ID NO: 5034 - DNA, 60486 bp, human; identical to SEQ ID NO: 3717

SEQ ID NO: 5035 - DNA, 110764 bp, human; identical to SEQ ID NO: 3718

SEQ ID NO: 5036 - DNA, 104352 bp, human; identical to SEQ ID NO: 3719

SEQ ID NO: 5037 - DNA, 213015 bp, human; identical to SEQ ID NO: 3720

SEQ ID NO: 5038 - DNA, 107650 bp, human; identical to SEQ ID NO: 3721

SEQ ID NO: 5039 - DNA, 214355 bp, human; identical to SEQ ID NO: 3722

SEQ ID NO: 5040 - DNA, 335379 bp, human
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccaggtactgaatcccaaatatatgcatacacagcaactccagttggtgttagaattaaggagatggaaaaccgaacacttgacagttcggccagttctcttcccttttttttttttttgcctcctacccccagtctttccccaaaaggccaaaatctagagcatttgagcctttgtcattcactgcctgagaggaactggctcctgggagcagagaccagccgagattacaagaagcctcttcaacatgcagccaaggcccagccttggcctcgggagaacatggctcttgggacacacgtaggaaaaattccctgcttctcagcaaaaagcctcttcaatcctggagggatcttctgaggtttgtgggactccctgctccccacaaagactgttttcttatacttccaggagccctgatatatgaattcctgtatgagagattcatttctttgttcctcacagcatgagggggtggaggaagggcttctaaatgcaaaaatcctagtgacatattatatctcagaaactgaactttacagccccaccttgtccctcttgctctgcaactaccaacctcactggccctttctctgaaggttggactgtgagtgtgtgtgcaggtgtgtggacaccttccttttcacaactcaaatgagtaaaacctgacttttccccccgtactgtttaccacctcccccttccctccacccaaggcactttcttgtgttccaatgccactaatccctcttacagtagaaactccgtagtttagctgctgagggcttgaatttgtgacccacctgtttcagaaatattttcctagggacccaatgaatgccattacatacaaaggtggtgtaatggcagggaatctttatgcgacaccatgaggagagccacctattgggtaggctaaagaggttgactgcagtgagtggccaagcagaaggcaggggcagctggcaagcagagctccggggccacccccatagcttcccactaccctggctcacaccctaagctgccctcagggggagcaggcctaggactaccagcctgggcaccaggggagctcttggggaagctgagaggtcaaccttgtaagttactgcatctggcttcttcgcacaagttcattgggttttcagagtgttcctggaacctcaggacaggagatgcctggagtgctagaaattcaggattcccaaaaaatccactatcccttatgtctgcagctggacaaagggtccctcacggtccccagtaggtttgggggcacgtagaagtctagccagggctgggaattctagggggtggtaaagacagggtgcacagccacagaattgcctgagaacggcctgttccttatttggcctgtgacgcagttggcacattgagcttagagcaacaggtaaacacagcctcacatttggagtggcctaaaggtttctacatttcatccccacggtgactcagttggtcaaaacaggggacataattggtcctatcttacagacaagaaaactgaggctcaggaggggcaagtgattatcccagtgctgcccagggacagatttcccaggacttctggactattcttaggcttgccgcttcatggcatagatagaacaggaaacggatggagcagagctcagcaagggagatactgggagagcctgtctccaggagggacatgcccccaccccaggactcagctcgtggtctgcattctcccactcagtggccccagtgccaacagcactgctcagaaacactgctgccaaccggtgccccttctgtagcagtgggactggagggagttgcacactcagtcacggaaacaccagtgtcctgatgtacagcaagcccctttgatcaatcagatggggacagactgactcctgagttcccagggtccttttcctgaaggaacatccattctttccctgttaaaccctgcattcctggtccagcagcagaaaagagcctttcggacactggagcttgaggaagatctgtgcctatttattagagaaggtggtgttagtatcaggaaataggtggatggtgctgggtttcttgggttcaaaccctggggctctgctgtgtgaccttgggcacatccctacccctctctgggcctcagtttcctcatgtgtcacattaccttggattagacggtctcactctgatggagtttttagttatgtatccattcattcaacaaaccttttatgagtcaagccctcctgcaggcacagggtttggtacacaggattcagcaagaagacagtctgtgctctaaaaaaggtcagattctcattctgtaatgctttttggtcctgctgtctttttatcatgctgacttaccttttcagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccaggtacgttctaggtgaaagcggggttcgcgctcccaggccagggcgcgaaggtgctgtacggggagggaaggcagccgcggggggtagagaagggcgtaaagttccagctggccattggtggcccggctagggtctccggaggggtgcggcgcgcatttgcccacgccgcggctccgtcgctactgttccgcgggcaccggcagcgcagcgtctccgatagcaagtcgggctgccggccggctcattcccccagggtaactctgagcccccggctccgagctccctcgaggccgcctaccgggtgggcaagcgggcgcgggcgccggcaaaaggagggcttcggggcatgcggggagaaacccggacagaggtgtgcgctccaaagaggataggggcagaagagcccggagagtccggcggacgaagcgggatggggatgggagcgggagccaccgagagtggagcgagacacgcgggggcccggactgggggcgtgagttgaggagtggggcgactgggcccggaggggtcccactggggctaaaccccgtggaggggctccggggagctccggagagctctggcggggggagggggcgaacggcccgcgggaaggagtcggggtgggggtgtgtgtgtgccgcagaagccacagcgctgagcctgccgggaaggaaggaagcggggaagggagccgccgccgcagccgccgccgccgtggagtactcggtgcggaggggagggggagaggggcgcagcagcggctccaggggaagggggcggtgcgggggcacgacgagcgcgggctgagctgcgggattgacgtaacgagcttgggtttcccccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcgggacccgggcctaggcgggcggagggctgggaggcgcggctggcccaagccggggacctagcgcgcaccctgacgcccgggcgtttgcaccccggctgggcaggtgctgggcgcccagtagcgcacgttcgccgcgctgtggcggccacagaaaggctttccgctccggccccggactgaccgtctgtctgtccgcagggtggcctgcgtgatggttggcagagcgtgcgggggaggcggccgagcggccggaacggggccgctgggacggggcatcgtactcagtctccgcactggagagccctaaagagccgcgctctccgtgcagcgtctctggatccctgctttcttctactctgcacccgggttccgaagtctcctttcagcgctctcttcctcctttcggcgcccgcattcttccctccccccgctttcccccctatttcgtctatttgccttgttctccctctttctctcttgtgtcctagatgttgtctgctcctgtttgctcgctgtttccttctttccattcccctctctcgcttttattctttttctctcttaccctttctgtttttctcttcttgccggacttttatcacctcgctccttccccgctctggctctggtcttcccgggcgactgggtgtccctctgtcgctattttccgacatccaaggagagctcatggttcccaggcttgcttatcactactggctgcatgagaggcatccgtggctctttgggagtggcggggggcaccccgcggaccgaagggcgggctgggatggtgccctggaccccatgtggggttcagtcaccaggagcctctcctgatttacaaaaaatatttaaaaagcttgagccccagcatggggcgctgccagcccatgttctgtgagcctgggctgatgcggtaaaagctgatttattaatagtctgtagccagaagcaagggtattttcctccctccagacgcgatgtccagttgctagaggtcatgcagtactgtaaagtgggtggtggtggggtgggggaagtgagtgctatggggtgcagttagtccagccagggctactgtttcgcaagtctccttaaaacaaatctgggctgaagcagggagtccagggggtgcacaaggtgagtttcatggcctggaggcctctggatggggtctctgggccggcaaggacatgtctgtgtcccatccccatcccccgggtgcacttggtaccctggacaaggggatgctttgcaggtgactgttagaacgcaacaaccagtgtggatttttctgtccaactgcagcaaatagagccctagagccctctgactttcagattaccattgagatttaaggggaacatcaccccctggctctcctcttcactctctcttctctcagtttacactgtcctttctcaaatgctggaattgtgtcagaatctgccaaacttgtatttcctttccaatactaacaaattttttcttccaccccaagaaaaccttagccccaggacctcaatccattggtacaattgtgtaagtcattgtcacaacaatattctggtgtttaataagttcccaaacaatttggcaatattgaaaagaatttctcatactgacagaccttgtaggtgtattgagaggtggtaatatttaaaaagctcttctgggcaaaagtagaattccacagccatgactatagcagagaagtgaaaacaaggtcttggtcaccatgaaagccatggccttgtctggagttccatggggcacatgtgcctttactgatccttttgaacatgtaggtcagagtatgatgtctataaacacacattattaatgtggtctagattatctgtttggtggctactgtcctctggcagattccttcccgcattctccagaagataaccagaacccctcaaagcctcttggattgtcccaaattgaagcaaaattatttgaaatgacataggattttcttggttattaaaagggtgatactacagtagcatctagtctaatcaaagagcaaccatgttctaaaaagtcacagttactggattttacggtgtttgcaaaaatgaaataaaacttgctagagaaatgcattgctacctcaagggcacctttttatttcattcattcctgcccacctccagaaatattcactttgaagaatagggatagcctaggggttccagaatttctctggatgttgacagatcccctaggaggttgcaggaccagttctgtgagttctgataatctgtaagagctaaggtgtgcatgtgtgtgtgagaatgagagagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctttaaaaaaaatcagaaattggatttcatccatctgtctgccagtatgttgtttgcagtcactcagggtcctgctcattttagaatttctgagaccatttttgaaagtgtatccaaacattgttgctcacaagctgttaaaagtcccaaattctgcaggcttttcttaggccaaatttcctctgtttgtagccaactctagtgtgccatttgttctgtagagggaattcagaactgggcccaaagaaatagcactagcccccttcttcatcactaagtatcatgctggccagcatgcacagaatggggttgagaggtcagggtccatggctatacaagtcaaagaatctgatcatattcatgttgtaccctagacttttagcatctctaaaattttcagtttggatgagtgattgggccgggggtaccacacccattgggagaagaacagatttctacatccctgaggtgttttattcaccaggggtaggtcttgtggctagattgcagaggggcctttcattgccatattgggaatccctgcaaagctgagcaggatgggagcaggctgaggcatctggaagagtaattaattatcatctcaaatccagtagcatatcattgatgggaaaggactaaaaagtgtttgtttagatggagaaaagctttttttggtcattctatttttttttaattgtgggaaaagctttcttttattcccatttgtttttaaaaggtggctctattttgaaagagctgtaactatagagtgtgtgtacctgatcatgcctcacaagcccacgctttccctctttcttctccttgattttgcagtgaggcaaaatgacacaacaggcttgtgatataggctgaggcattaagcagaatggactgttacagccagtggtcagtactggtcgtgtggttcatcaggctctaagctgttgggctcagttttacttagctgaggatacatttcttcagctgtctttgagagctgtggtaccatcttagctatttcatagaagagggggagaaatctaccattacaatatctgtagaattccagtagtattaattagcatctttgcatggatgtcgaacatggtgttggagtccttacaaagctgtaagttctcaggtagtacaaaaggctattcagaattaacatcacttaataataattttagatcagtgctatggggcaattaaaatgctagagcttgtctttcatggatatcagtcatcaactgaggtagtatgtaatgacattaaaagaatagccatccgtttttttctgtcattcattaagcaagattttgtgaaactgttcattatattccagggaagagacatcattctctgtctcacagagcttatggtagaacagaacaatttagtactttagatatttaattaaaaaatggattttgtttgaaaacaatttgaaaatcaataatgtctttaaaatgtcatacatttaccagaatatacaaaaaatagacaaaagtccatctgttatgttgtagtttgggtctaatcggcaaagcagatggagtaactattatgtctctggcatggtgctagcagttgtggggagattagagccaagaagaaaccaaaaaagccaagataaccatcttcagcctcaagtccataaagattagcatgtgaagtgcaggactatgtcatgtagacaggtgctgggagaggaaatttagattttggacaggcccttttccttcccttggtctcagtgtcttatctataaaattggagatttaaatgacatgctttccagggccctttcctttctaaagtatgaggaacaggccagaaaaaggagacatccttttgagaaggcctctgggagtaggagagttgtattaagaagaaaggaggcattgtgggtgggcacggagtcctcatgaccttttgaggtccagcaacctcacctaggcaggtctggccagacccgaaaggttcatgcttggagtaataatggttagggaagtagatggggttaggctccactgtggaggacttgaatggcaatgaggaaccccagtaagtatgagaagctcttggatggaaagagtgcaaaaacaccatgaaagtaaataaaggtcggagtctaggtaaagctatctccctgatatctagtctggaatgtaggtggtaccagccaccaaaacagagaggttgagaaggggatctggttcgggctggagagtactaagaagtcatgactggttcctgttgcctagatttctagtggacaggacttataaggaggtgacaactggggctctggggcaggttagggctccatcgtacattatatgtgggaatctgtggacccagttaatctgaattcacaattggcgttgttatttaagtgatagctgcaattcacatatgggactcttagccaaggaaaaggatgtttgaataaaggaaaaaagatcaatagttatgattacataagaataagatatgcttatctgtcaaaaaaaagccaaaacgaaaaggtttcaaactggtaataatatgcacaattacaacagacacaaagttgaaatctttactgtacaaagaactctcacgagctgattagagaatcaaaggacatgaccagacaatttacaacataggacccccaactagtttgcagacatggaaaaactgttttatttcactggtactaaagaaatgcacatttaaacatagaatactttttttgcctctctaaccctgattaaaacaaacaaacaaacaaagcaaaacccaacatatatcaccaccaaacaaaaaaagtagacagtgctgacaagggcatggtaaatatcaaaattctcatacattgtcagtgggaatgtaacttgaatgatctttttggaaataaatagtgtaaacacagaatataaaaatatttatttctatgacccataatttcttttctgggattttgcagaaaaacatacttttatacatgctttcattcattcactcatttatttattgattcagcaaatatttattgagtatctggtatccctgtgctatgtgctggggttaccgggaagaaccaggtagatgtggtccctgccttcgtaggagtgggaaagatagacagaaaacaaattatcaattacttaaaattatatgaagtgccatgggggaaaagtacaggatgctatgagaacacatactaggagactaactggagttatcataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagagaaaaagagatagaaaattatggacccagtacgactacaattatattaaagaaaaaaagatagcgagcgagcgagcgagagaaatcatctcctacccctcccaaatctaagcataaaagacagagactggaagaaaaaaataatagaatataaatagatctattagtgatttattttcttattctgcttttctgaaggttttgagttttctttgagtctacattacttatataataacaataagcattaacaatttttaaaataatgttttactaagctgtgattaattgcacacaggtctacttttttggttcctggctggttatttcattagcctcttgatatcctgggagcctttaatgaggagagtagcctcagccctaataaaccctcaccctgaaaggcagaggtgatgagtcagacattggctgctgattttcgataactgacttttatcatattcccacacaatgcatggaactctttttataccagtatggtatagagctacttgagtgaattgctattgtttctttctcatttataaattataaattttaatttataaattatatggaacaggaagttaatagtggtacacagttggaaatataaagcttattctgctcagccagagccatccgagatagtctggactttggatctccatgagcttctttcttagtgagttgacaccagggctgatggtctggctggaagagttaaaatcttggggttggtaaagggctatagttctaaacatccataactgggagcttagatcagttagtgtatgtgttgctctcgtccagcagaaaaggagagttcactttgctaagcagcgccccctagagaagtttcactgcataagagtattacccccagttaaccataaataaagttgattagaaatgtcattgtccaactattccaatatctgagggaccactctatgcacatatagtgaggtgcataatcttattgttgaaactccactgaaactacaccgtaggtacaagttgttttgacagtgtaaagaatgtccctcacagttgaaaagctaatattaacattctgtgacacatgaaatgaggtatttagtcactgagtttaaaaagagatgtatggatgggaatttccccctttccattaaaggataatgaataatccacttaatggcgtatgtcctctaaaacagtgtccttgtaagcttagataaatatttgtctaaactttagtaaaatatttattggcaaaagagcttttctcatttactaggtattgaactttgcagattattcagttggtcttattgcatcccatttgttatttctgccattttgcctctaaaaactgtgctgaagactttgacacatttcagagcattacactaaataaatctgtcttgcacattccactgtgctttttctggaatattataaatattcaaatataggcacacacgccgattcaaaatacaatttaatacatgcaaattgtgcataaattccatatttataacttggcaatagtttcgaacttgttatcctatgatataaatgtatcaaataggagctcatgggaattatcaataaatgtatttttctgattaaactgtgggctctttttcagtcacaatttaagcttcaattctgagttatattataagagaataatttgcacttcatttactctgaattgtcaagaatcttgttcttccccaatgtaagtgtctgcaaagaggacttcttattcagtttgattgctttttaaattttactagtggagatgccctagtgagtctgagagaattggtctgtttcttatgaagagtttagttctaatgagttgcttccatgcactgttctgtgcgaatacagagcaattgaaatgtgcggtgtattgatttacctcaaatggattaggcctgtgtgcaccattccttgcattaattgactttctcccataactgtactaataactgcaaatcttcagtatagtattagcttcaatttactcataaagatccttgggtttttgctaacttactacaggagagtcaatgcaagcaagagtatttagaaattgactagggggaccaagttacatcatacaacccagaaatacttttaaagggctctttgatcatggcagccaactcttcagttattacaataaataggagttgactaaactcaccagttaagacctagattatcacaatggatgaaaataaaaaatccagctatatgctgtgtataagagacaaaggtaaaacataagaacataaagcacacaaaaaggattggaataggtacactatgcaaacactagccagaagtaaactgatgtggctatgttgatatcagacaaaacagactttaaggtagaaccattattgggcataaacagatcactgtgtaatgattaacagttcagtttttttttcagataacaattctaaacttgcatatgcttaataccataagtttgaaacgtataaagcaaaagttggcagagctaaaagcagaaattataaaatctgattttttttcagaaattgataggtaaaatgaacaaaaaatgaataaggatacagaggatttgaacaacatgattaacaaactcaatataatgggtatatatatatacacacacacatatacatatacatctaaaatacacacatacacacacatacacgcacacacacacacatatatatatataaaatctgcacccaattggaagaatacacacacaagtgcatatgaaacacttttgaaaatagaccatatactgagccctaaaattactcttgaaaaacttcagtgaatgaattatcttgtagaccatactatctgatcatatgcagtgcttagacattgggtgttgtgttaaacctgagtgcgtgtgaaggaacgttagtagtttgctatatttgtaagtattaccaatccttcaccgaccacataacatttcttaattgacatacaaaagtgaagaactccaagacttaggtagtttgacccaggtaacttggccttattttccaagaagatctattactattttggggtacctattgagacaggtcctgtgcaaggagcatattatatattttctcatttaattctcacgacaaccctctgaggtagattttttaatatatactttaagttctagggtacatgtgcacaacgtgcaggtttattacatatgtatacatgtgccatgttggtgtgctgcacccattaactcatcatttacattaggtacatctcctaatgctatccctcccgcctcccctcaccccatgacaggccccagtgtgtgatgttccccaccctgtgtccaagtgttgtcattgttcaattcccacctatgaatgagaacatgcggtgtttggttttctgtccttgggatagtttgctgagaatgatggtttccagcttcatccatgttcctacaaaggacatgaactcatcctttttatggctgcatagtattccatggcatatatgtgccaaattttcttagtccagtctatcaatgatggacatttgggttggttccaagactttgctattgtgaatagtgtcacaataaatgtgtgcatgtgtctttatagcagcatgatttataatcctttgggtatatacccagtaatgggatggctgggtcaaacggtatttctagttctagatccttgaggaatcaccacactgtcttccacaatggttgaactagtttacagacccaccaacagtgtaaaagtgttcctatttctccacatcctctccaacacctgttgtttcctgaaattttaatgatcgccattctaactggtgtgagatggtatctcattgtggttttgatttgcatttctctgaaggccagtgacgatgagcattttttcatttcttttttaattattacactttaagtgctagggtacatgtgcacaacgtgcaggtttgttacatatgtatacatgtgccatgttggtgtgctgcacccattaactcatcatttacattaggtatatctcctaatgctatccctcccccctccccccaccccacaacaatccccagtgtgtgatgccccccttcctgtgtccaagtgttcttgttgttcaattaccacctatgagtgatgtgatgtttggttttttgtccttgggatactttgctgagaatgatggtttccagcttcatccatgtccctgcaaaggacatgaactcatcattttttatggctgcatagtattccatggtgtatatgtgccacattttcttaatccagtctgtcatcattggacatttgggttggttccaggtctttgctattgtgactaatgccgcaataaatatatgtgtgcatgtgtctttatggcagcatgatttataatcctttgggtatatacccagtaatgggatggctgcgtcaaatggtatttctagttctagatccctgaggaatcgccacactgacttccacaatggttgaaccagtttacagtcccagcaacagtgtaaaagtgttcctgtttctccacatcctctccagcacctgttgtttcttgactttttaatgatcgccattctaactggtgtgagatggtatctcattgtggttttgatttgcatttctctgatggccagtgatgatgagcattttttcatgtgtcttttggctgcataaatgtcttcttttaagaagtgcctgttcatatcctttgcccacttgttgatgggtttgtttgtttttttcttgtaaatctgtttgagttctttgtagattctggatattagccctttgtcagatggctagattgcaaaaattttcccccattctgtaggttgcctgttcactctgatggtagtttcttttgctgtgcagacgctcttgagtttaattagatatcatttgtgaattttggcttttgttgtcattgcttttggtgttttagacatgaagtccttgcccatgcctatgtcctgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggcagcagtaccatgctgttttggttactgtagccttgtagtatagtttgaagtcaggtagcgtgatgcctccagctttgttcttttggcttaggattgacttggcaatgtgagctcttttttggttccatatgaactttaaagtagttttttccaattctgtgaagaaagtcattggtagcttgatggggatggcattgaatctataaattaccttgggcagtacggccgttttcacaatattgattcttcctatccatgagcatggaatgttcttccatttgtttgtgtcctcttgtttcatcgagcagtggtttgtagttctccttgaagaggtccttcacttcccttgtaagttggattcctaggtattttattctctttgaggcagttgtgaatgggagttcactcatgatttggctctctgtatgttattggtgtataagaatgcttgtgatttttgcacattgattttgtatcctgagactttgctgaagttgcttatcagcttaaggaggttttgggctgagacgatggggttttctagatatatagtcatgtcatctgcaaacagggacaatttgacttcctcttttcccaattgaataccctttatttccttctcctgcctgattgccctggccagaacttccaacactatgttgaataggagtggtgagagagggcatccctgtcttgtgccagttttcaaagggaatgcttccagtttttgcccattcagtatgattttggctgtgggtttgtcataaatagctgttattattttgagatacgtcccatcaatacctaatttattgagagtttttagcatgaagggctattgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgaggatttttgcatcaatgttcatcatggatattggtctaaatttcgctttttttgtgtgtctctgccaggctttggtatcaggatgatgctggcctcataaaatgagttagggaggattccctctttttctattgattggaatagtttcagaaggaatggtaccagctcctctttgtacgtctgaggtagatgttttaaaaccccatttaaagatgagaaaacagaactggacaagatacataacctcctaaatcttcacagctacacagtattggagctggcatttaaaatcaactgggatatttggcctgtctggtatattttaatgtctactaaattctcagacaaatctccaaaaacctttttcttttctgtggctaagtctatacaagctaagtggaatggagacctgaagtaactatctggagataccaagatccaacatattagcttgtttttaaaaaaacaccttttaaaaatttaataaaagtcactctttcaaggtgaactctgcagctcttttttcccgtcttaaagatttagatgccgaagttatttcaaatactttttacattgaagatttacacataagtatgatgttttaatggaaatgaaaaaaggcgctagagaaaagattcaggttttcttttttcaaataagaaaaatgaggaccttaactgtattttaatttctacccccttgtagactgcatttttggtacatacactatgcaaaatttgtaagaggccaaagaatcttgctccttttagaatgttggcatttgtctcattagcagttagttgcattgctttgaccaattgtgacctgtttctataaatgaccattgctttttgctgcatttggtaagtgtagacacagcctttggagggtaatataaatgagttcaggcagggcatctcttgtaatctgggaacagaggagccagtgaaataaagatgctttctttcaaaaaccaagggaggagtcctagatgaaatgaatcctgaaggctattcttattttgggggctcatcatgaagataataagaatccattttgttgctgaaataaccaaataagagtggcacattcccataggagtgaccattctcttccttttggaaggggcagctttagaaaagtgccattatgcaaagctgaaggccataaaaaagtgccattaaagagaatgcaaattagcatgggcctaccagcctggcaggcattattaatgttggaggtaaagaaattaggttgaaggtatggaagaaccataaaaaaacaaccagaggccagtgtgacattgggctgatggccacttaagctgatgcctcatggctgagactttgctaagtggaagattaactgacaaaacagcttgaaggttgacgaactatttgagctcattgccagatactctagaggcaaaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcgaccacaaaattcagctcttctgatttgctaggatctgactccaggatgcagtactttctggttaacagagggggctcttgtatgcagtaaacctcccaagatggagagatgtggtatcagctattttcattatagccatcttaggagtgtgaagttgtatctcattgtggtattgatttgcatttttctgatggctaatgatgttaaacattttttcatgtgcctattgcccatttgagtatcttctctggagaaatatctatacaggttgtttgacattcttaattgtgttatttctttttctttttaatattaattggttttttttaaacatattctaggttcaagtctcttataagatatacgctttgcaaacattttacccccattcagtggttgttgcttcactttcttgaaggtacccattgaagcaggaaagttttaaattttggtgaagtccaatttaatttttttctttgtcacttctgaaggctttgcctagtgttcacaaaaatttactcctatatctgcttttaagagttttatagtttaaccttttacagtaaggtcaatgatctatttcaggttaatttttgtgcatattgtgaaaaaggagacacacccataagattggtataactttatccttttttatttaggtaatatttgtcccagaatcctttgttgaagactgtttttctttattcattttccttggtaccattatacaaaaccggttgatcataaatgtttggatttatttctggattctattttacttgtctataaagctatctttaatcaagtgacacacagtcttgactactgttgctttgtagctagttttgaaagcaggaagtgcgaatcttttatttattttttctttctctagattgttttggctattcttggcaccttgaatttcattgtgaattttagcatcagcttatcaatatccacaaagaagccggctgggatttttttagggattgtattaaatctgtagatcaattttggggagtattgccatatggacaatattgtttttcaattcaaaaacatgggctatttttccatttgtttaggtcttctttaaattctttcagtgctaattttgaagcctttagattgtaagttttgaatttattttgttaaatttatttaaaagtattttactcttttgatattattgtaaattgaatttttttcatttttggattgttcattgctactatataaaaagatagttttttttgtttgtttgttttgcaacggagtctctgtcggccaggctggagtgcggtggtgcaatctcggctcactgcaacctctgccccccatgttcaagcaattctcctgcctcagcctcctgagtagctgggattacaggtgcacgccaccatgcccggctaatttttgtatttttagtagagatggggtttcaccatgttggccagtctggtctcaaactcctgacctcaagtcatctgcccgccttggcctcccagagtgctgggattacaggcatgagccactgtgcccggccagttaatttttaaatattgatcttgtatgctgcagccttgctgaattcatttttaagttctaatagtttttcagagtatccctcaagattttctgtatacaaatgatagagtttggatgtgtgttccccacaatctcatgttgaaatgtaatccctaatgttggaggtggggcctggtgggaggtgtttggattatgggagcagatctctcatgaaaggctcagtgccctccctgtgataatgaggtcacatgacatctgtttgcttaaaagagtctagcacttccacctctctctcttgctccctctcttgccatgtgacacactggcttcccttcaccttccaccatgattctaagcttcctgaggcccttgccagaagcagaagccaacactatgctagctgtacagcctgcagaactgtaagccagataaacttcttttttatgttacccagtctcagacattcctttatagcaacacaaatggactaatacaacatgcttatgctatctgtaaatagacactttaatttcttactattcagtgttgatgaattttatttccttttcctgccttacttccttggctaaaatctccagtaaaatgtgaactggaagtggctataatgaacttctttatcttgtttttgatctcaggggaaagcattcagtctttcattattattattattattattatttgagacaaggtctcactgtcattcaggttgggatgcagtggcatgatcacagctcactgcaccctcaacctcctggggcttgaggaaacctcccacctcagccttccaagtaggaagaactataggcaaggatcactatgcctgactaatttttaaattctgtgtagagatggggtcttgctatgttgcccaggctggtcttggactcctgggctcaagtggtgtactgcctcagtctcccaaagtgttgggataacaggtgtgagccactgttctctgcccagtctatcactattaaatatgtgagctctaggtgtcttttatcagattgaggaagttctcttattcctagtttgatgagtgtttctttaaaaaaaaaacaatgaatggatattggattttgtcatgattattctgcatctcttgagataattgtgtttttttctctttattttttatttatttgtttttttttttttgagacagggtttccctttgttgcccagggtggagtgcagtggcatgatcatggctcactgaagcttcaacttcctgggctcaagcaatccccccacctcagcctcttgaatagctgggactacaggtgtgcatcactattcccagataattttattttttattgtagagatggggtctcactatgttgtccaggctggtctcaaactcctgcgctcaggaggtcctcctgccttggcctcctacatgctgggattacaggtgtgagtcaccacaccctacctctttattctattgatatagtgttttacattaatttactcacaggtagtaagccaacctcgcattctcttgacaaatcctacttagtcatggtgcataatctttttttatatattgctggattgcttagattttcttctagtattttcatagtttcaggtcttaggtttaagtctttaatcttgagttgatttttgcacatgatgagggctaagggtccagttttattcttctgcatgtggctatcaaattttcccagcacaagttattgaagagggtgcccttttcccaatatatattcttagtgcctttgttgaaaatcagttagatgtaaatacacagattttttttctgggttctctactctgttccattggtctatgtatctgtttttacagcaatgtcatgttgttgtggttactataactttctagtataatttgaagtcatgtagtgtcttgcctccagcgttgtcctttttgctcagtattgcttcggctgttcagggtcttctgtagtttcatacaaatttcagaatttgttttttctatttctatgaagaatgttattggtattttgacagggattgcattgaatctgtagattgctttgggtagtgtggacattttaacaatattaattctttcaatctatgagcatgtgatgtctttccttttttgtgtcttcttcaatttcttcagagttttattgtttttattttacttccttgattaaatttattccttgttattttatttttttgtagctgctataaatggaattactttcttgatttccttttcagctagtttgttaatggtgtatcaaaacactgttgacttttgtatgttgatttttgtgtcctgcaactttactaaattcattaaatagttctaagatatttttgatggagtttttagggttttctatatataagacaatgtcatctgcaaacagagacaatttgactttctctttttcaatttggatgcattttctttcttttttttttttctttctcaacttttattttaggttcaagtgtacatgcgcaggtttgttagatgggtaaattgcatgtcactggggtttggtgtacaaatgatttcatgacccaggtagtgggcatagtatctgacaagtagtttttcaaccctcatcctcctcccagtctccaccctcaagtaggccctggtttctattgttcctctctttgtatctaagtgtactcagtgtttagctctcacttataagtaaggacatgcaatatttggttttctgttcctgtgttaatttgcttagaataaatggcctccagctgtatctatattcataggagacattggtctatagttttcctgtgatgtctttgtctgaatttggtattagagtaacactagtctcacagaatgtgttgagagatattttctccttttctatttttttaaagagtttgtgaaagcttggtgttaattctttttaaatttttggtgtaattcactagagaaacatatgggcctgggcttttctctgtggtaagttaaaattatttatttgatcactttactttttatagttcaattgagttttttatttctttgtgagttaatttcagtagtttattgtctttctggtaacttgtgtgttctttccaagttatccagtttattggcatgcagctgttcatagcattaccttataattcaatttattgttaaaggatagtattaatgtcccctctttcattcctgattttaataattgagtcttttctctttttgttcagtataagttctgtttatcaattttgttgatctcttcaaagaatccatttttgttttcatggaatttattattctttttcaactctcaattccctagaatctataatatttcttttcttctgcttgctttatgtttagtgtgttcttcccttttcagtatcttatgatataaagttatattagtgatttgaaaattttcaaattatagttgtaaatgcctatattttcaaaaagaaaatatttcaaatcgcttcatcccataagctttgatatgttttgtttcatcccataggttttggtatgtttggtttcattttcatttgtatcaaacaattttctgatttcctttgtgattttttccttgacttattggttattttgcagtgtgatgtttaatttttcacgtttgtcaatttcccaaatttccttctgtaaatgatttataatttcattccactgtgattggagaacatacattgtatgattcaactattttaaatatattgagacttcatgaccagtctgggcaacatggcgaaactctatttctaccaaaaatacaaaaaattagctgactgtggtggtgcacacctgcagtcccagctactctggaggctgaggtgggaggatcacttgagtcctgggaggtggaggttgcagtgagctgagattgtgccactgcactgaagcctaggtgacagagtaagaccctagctggaaaaaaaaatatgttgagacacatcttgtggcctaacatatgctctatcctggagaatgtctgtgtgcatctgagaagactattttgctgttggtggtggagtgttctatagatgttgctaaaacttggtagtttattgtgctgtttagacttctatttctccattgatctttttctagttgttccaccattatttaaattgggataatgaagtctccaattattattattgaattatctgtttttccctttggtcctgtcagtttttacttcatgtgttttagggatctgttgttagctgcatatatatttataattgttttgttttcttgatgcattgtttctttatcattataaaacttctttctttagtaattttgtaatatttattttctctgatattagtatagccattccatatttcttgtggttcttgtttccatgatatcttttctcttctttttcctctccaatgatttctatctttttctatctataatgtgtgtttcttgtagacagcaaatagctggatcttgtttggtttttatttcattctggcagtctgtgccttttgattggattgtttcatccatctacatttaacaatattaatgatatagcttgatccatcttattttgattttccatatatctcatgtcttttttgttcccctattgctcctgtactgctttgtcttatattaagttaatgctttccagtgtaacattttaattcccttaatgattttctactgtattttgttgttattttctcaatgtattctctagggcttaatctatgtatattaaattatcagaatctacttcatatttatagtaacttaattacaataagctctttaagtgttttcctagatagctctgtttcttcttctctctttttgtgctgttattgttataaattttacatctatacatgttacaaactcagcagcacattgttataattattacttaatgaaattttatgtcttctaaagaaggtaagagaagtgagagaacaagtatatttattgagtttcttataaaccaccttatgtaccattactggttctgtttgtttgtttctgtgcatttaagttaccattttgtatttcctcactccagtacagccttgctccaacacatttcttttggtttgttattgtcatatgttaaatgtatatattttatggtcccaacaatacaattatatacctatttttttattgcttttcaaagtttgttatgagaaaaggggagtaaatatgcatttatactgtattttgttattattacattattattttattattacattattatcttcaaatgagctgattttttctttcatgtggacttgaattaccacctggtcccacttgctttcagccggagaatttttctttattatttcttgtaatgcaggactgttagcatgagattgtctcatgctaacatgagatactttgttttctgtgaatgtctttatattgctttcggttttgaaaatacttttgctggatatacaattcttaattattggtttcttttcctaagcatgttgaatgccatcccactgcctttgtcctctattgtgtctgatgagaagttagctgtcagtgttattgaggttcctctgtgtgatgggtcacttttctcttactgcttttaagaatttctctttctctttttaacatttttagtatggtatgtctgtgttaggatctctttttggttatcctacttgcagttcattgagctacttgcacgtgtagattaatttttcttccagcttagagaaagtattagccattaagatttttttttcttttctgtttctttctctttctggtactcttccattaggtgtattctggtgtgctttttggtgtcccatatttctctgaggttctgtccatttttataccttctttctctctctgttttcagattgcgtaatgtctactgaaatatcttcaaggttgctgattatttatcctgccagctcaaattgtctgcggaagccttgtagtaatttttttttaaattgagacagaatctcgctctgtcacccaggctggagtgcactggtgcgatctcggctcactgcaacctccgtctcctgggttcaagcagttctcccacctcagcctcccgaatagctgggattacagacgcatgccaccatgcctggccaatttttgtatttttagtagagagggggtttcaccatgttggccaggctggtctccatactcctggcctcaagtgatctgcctacctaggccccccaaagtactgggattacaggtgtgagccactgcacccagcccttgcagtaaatttgtaatttcaattattcttttcaatttcagagtgttcattagtttcatttttataatgtctatattatataacatagacattatattatagaaaatatatatagaaaaatatattatatataaatatatattatagaatatagaatatatatagaatagaatatatattctattctaaatacagaaatatatagaaaaatattatatattatataatatagacataatatccttttatggatattatatatttaatgagacattgtcattataccttcctttacttctttaagtatggttttcattagtttcaacactatttctaaaggctactttgaattctttgttaagtctgacatctgggctctgtcacagatagatcccattgcttgcctttttctcttgtgtatgggtcacgcctttctacgtcttttcgtgtctcataatattttgttggaaactggaccttttgaaactctggataatgattctcctccaccttcactgggttgtgtatttgttgctgtttgcttatttattctgggacttgtctgaactattttactaaaacctatttctcccctgtgtgaatcctttgatgtcagagggctgtcttgggcatgtgcagagtcacagtgggataacagttttagcagggatttctttgggtctttccctgatatttctgttaaacagtctgtctctgttgttatcatgtctatctgttggactccactaattgttgggtgattgctgtattgtttttgacagtgtcctggggcatcaattgctccacagtctgatcagatttggacacttttgctggggtattttttttttttttttgaggtggagtcttgctctgtcacccaggctgaagtgcagtggcgcaatctcggttcactgcaagctccgcctcccgggttcacgccattctcctgcctcagcctcctgagtagctgggactacaggcgcccaccaccacgcccggctaattttttgtatttttagtagagacggggtttcactgtgttagccaggatggtctcgatctcctgaccttgtgatccgcccaccttcggctcccaaagtgctgggattacaggcgtgagccacctcgcctggccttgctggggtattttttgaggccagtctttgagatttgttctaaccccaaaagggctcttctttgctggttctttttctggttatctaatgttagctttcctatgatttagcttgtcactgttacacatcctcttaaatgcttaccaccaagatttccatttttttctcagaggacctttagggttttactttcccttatgctataataaaaagtcagttcctttggggagagctttggaactctctgttttatggcttgcctttctgttggtgtacagtgtctgagccattgctttggagttggaggcaaggacaggggtcttgtttctctcaaaatgacactgcttcttttctagctgggtattcatggagtcagtatcctctggtcttctcagtttgcctctcctgatatggagcttctttgctgatagcgagctacaccagtggtgactggggggtccagtgttgttgctctgctatgcctgaagtacagtctccatcctataactggagacattgttgaggaagggagcccctgtcttcttggccatgcttgcctggagtttagcctttgcaacaaagagctgatgttgatgagaattctggaggccttggtctcctggggagatacatagctcttgactgggagctaggaattgtgggtatctcctctttttgtccacacccacctgtactggtcctgctgtgtgaaggggagggagtagatcatggctcaagtgctacagactctccctctttctaccaaaggttagtagacttccttgaataaatctttccttatttgctatatgcattaagaacatttccagagacagtaaatggctgctttagaattttcaccggtatggttgttttactggggagaggcctgcagagctaagtcacaattttcttggttttaggtatgatggatgatttttttttattggctccaagacatattatacattatgttcagggatgctgggtcctatttaaatcttttattttagcaagcagtctccctgtttaggtttagcatataggtcttggcctactttttttgtctgtggttccactgtgagtttaattttcacagcatttgtgttgttatttaggtctcctctgtttatttagtattattggacttttcactggtctctcttagtgctgcctaaggaagccaaggactttccccaagccaagcccttgggtgtcttttggtgggggagggttgtattgagatcctcctaatagtattatccagcctggtgtctcaggtttggggaggaaattcttgggtccatggggactaacaggcctcttagacccatatacttgctgcagttgtctcttttggtagctcttccagcctgcctcaatgtctctggtcaggggaggagagtgtcaggccaatagggacaaagagcctttccagtggctgggcgcagtagctcatgcctgtaatcccaacactttgggaggccgaggtgggtggatcaccagaagtcaggagtttgagaccagcctggccagcatgacgaaaccctttctctacaaaattaaaatacaaaattagccaggcttggtggcacatgtctgtaatcccagctactgaggaggctgaagcatgagaatcacttgaacctggaaggtggaggttgcagtgagccgagatcatgccaatgcactctagcctggacgacagagcaaggctccatctaaaacaaaacaaaacaaaacaaaacaacaacaacaacaacgaaaaaagcaaagcgaaaaaaaaaagcttcccagaatgggctacttgccacaattgggtctcttttattggttctgcccacccaccttgatgcctctgggaaagggaagagagtcttaggctcatggggacaaaggagcatcctatatctagctgttaggtataactgagtccctttttcaatctccgtctgcttatcctgatgtctctgggggaagaggggtcttgagtcctcgggggacttcctgaaataagtctcctagctgtggttaggtcctgtttgcttaatttggttttgtggaccttttgcatatccttgttgtttttctctctagtttttctatcagttttccagagaggaggtcgaagtttctaactataactgtggatttgtctatttctccttttagttccatcagttttcactttatatattttgcatttctgttgtttgttacacacacatttagaatggctgtgtgttcttggttgattgacccttttatcattatgtaatgtccccctacattcttggtaattttgtgttccaaagtctactttatctaatattagtatagctacttattgctttattttaattgatgcctacatgatatatctttctatttttcagtgccttcttttgcttgttttatgtattatgtcaggctggagtacagtggctattcataggtctgatcacagctcactgcagcctcaaattactggcctcaagtgatccttccacctcagcctcccaagtaggtaggacggtaggctcacaccatggcacctggcttgtcatgtgtgttttctgtaaaatctagaattagttggaggaatagagagaaatgtgtatactctgtcttgtccagaaccagaaatctagttcacctatttctgttttcttgaatgatctgggttggctttttaagtctttgaggctccgtgttgcactcacctaattttagctcaataagatcatgttactgagtctactactctgtacatcaagggctgtagtggctcaattttttttttcaaagatcaaattttcaaagtccatatatttttatcaaatatgcccttagccttttgttgctttggttgcatctgtccctccactgcctttgtaggcatttggttttggagagttgcaatgatgtatgatctgcaaatctccatctgctgcctgccactgactcagcatgaatagaaacaaaaattgactataaactggttgacaccaagatagacctaataacatggcttatttgtatgaagttggactctgctattaattcattcagtatgaagtgcttactgtgtgccaggatctgtgttaggtcctggggttacagagctagcagtgccataggtactgattttggagagttcatagactactgagaggagacaatcaaatagggtattcggtgctatgataaaggtgagcacaggttgctgtgacaatagagaacaagggtactcaaattagggtaggctctgttgatggaagtgacacctgagttgagtccctgatatagtttggatatttgtctctgcccaaatctcatgttgaaatgtaatccacaataattggaggtggggcccggtgggaggtatttggatcatggaggcagatccctcatgaatgccttgggccatccacttggtgataagggagctctcactctgaattcacatgagatctggtcatttgaaagtgtgtggcagctgggcgaagtggcacatgcctgtaatcccagcattttgggaggctgaggtgggagtttgaggccagaagtttgagaccagcctgaccaacatggtgaaactccatctctactaaaactacaaaaattagccaagcatggtggtgtgtgcctgtaatcccagctacttgagaggctgaggcaggagaatcgcttgaacccaggaggtgcagtgagccaagattgccccactgcactccagcctgggcaacagagtgagactccgtctcaaaaaaaaaaaaaaaaagtgtgtggcaactactcttgaccactgtctctctcctcctcctgcttttgccatgtgacatgcctgctaccctttcaccttccaccatgattggaatcttcctgaggcctccccaaaagccaagcagatgctaacactctgtttcttgtgcagcctacagaaccatgagctaattaaacctcttttctttataaattacccagtctctggcatttctttctctttttcttttttcttttcttttcttttttttttttttttctgagacagggtttcactctatagcccaggctggagtgtaatgttgtgttctcttatcactgcaacccctgtctcccaggcacaagcgatcctcccctctcagcctccagagtagctggaactacaggcacatgcctggctaattttttgtatttttggtagacacggggttttgccatgttgctcgggctggtctcaaactcaagcatttctttatagcaatgcaagtatggtccaatgcagtccccaaggatccataaccagtcaaggattgggggaaaccttaggaagcagcatgagtaaagggagtttcaagaggaagtgttgcttgtacttatgggctagaatgagatctgtgacctcagaatttgatagaaaccaggacacctagagcccagtaggatatgcgacatattttggactttagtctgagagcagtgagaaggcattgggactttttaagtagaggagtcatttaatttgatttgtgtttttactgaattcctctggcttctgtgtgaaggggctggagagtggcaagaacatggcagtgagttagaaggctgcagggagcagcccagggagacagggttgtggcttggcttggggaagtgattgtggggatgcagagaggtgaatggattcaggaggtttaggaggaagaacagaaagaatgctgcgagtaaaagatatagatggtagggatgagagtgaggaagcaaggaagtttctgccaaggattctgccttgagaagactggagaagctgtgataagcagggcagtgggagagagtctttgtttacatgtggaatttggggagactgtggagtcgccatgttgagatgcccacgggcagtggatctgtggatgggggggctcagtactgcagacatagactgggagggttttttgtttgttcgttttgttttgtttttgagacggagtccccctccgtcacccaagctggagtgcattggtgcgatctcagtttactgcaacctccacctcctgggttcaagtgattctcctgcctcggcctcccgagtagctgggattacaggcacacaccaccatgcccagctaatttttctatttttagtagacataggttttctccatgttggccagactggtctagaactcctggcctcaagtgatccacccgccttggcctcccaaagtgctaggattataggtgtgagctactgcgctcagccagactgggagttttgaggtgctttgtctcatttatctcacttaaaataatttcaaaatatgttaaaaggaaatgttatttgcaatgcatagacaggttttcctcgctagttgctgaggataaaatccaaacaactggacctaaacagacaggattggaagaggctgttctggaccaaatgggatgctaaaccttagaatggattgacaagagaaggccatgcagaatggtgagaaggccctacttacctcagcccagcttcaaggccctaagtgagggatacctggaatgcctctgaagactggcatttggatgcccattccttcccattgcagttgccaagcccaagagcagtggagaacaactgtaccttcttgtcatgaagtgtgtacaccggaaaaaagtaaatgcttgtattttctttttcctctctttcttttctatatacagctctccaaaaacgcagatttctctagatcacagttgttcgtggagaagtgagagtgacaattttagagtaaaaaatttaatattgtgggaattatctctaaccagtcaaattactaatgaagatatttattcttgggaatctagaatcagctatttaagctttctaggatctggagtcacacagacttgagttcacatgatggctctttcacttaccaatcatgagactttgggttaatcactgcatctacttctgaccttcagtttcctcatttgtaaaaggagaatgctacctcatgggactgttttgaggcccaaatactgtatgtaagtgagagggctttataacgtataagttgctctttaaatgttatttaatcattatttagcttctggtttcattctattaataacattttaaagtgttattagaaaaattgtaagattcttgctaatattaaaatatgttgctttatttaaaagtaactcctaattcatgcccacctaataataaagaatatcattaggtggctgtaaacaaaaaaatcaaacagttctttctttcctctatacactcacacacttctggtcatcaaaatgtgtgaatttttccgacagagaccaatactccgacactagctgggtgtcttacaattcaattcagttctgaaactaaccagcattagtgcaggccccatagattaagagctcagtcccacaagtctgccccctccccttcagacatctatctcaagtcccaggttgtcacctgtacttctggctgtaaatcaaggtttccacgaccccctccttgggtttgacaatttgctaggacagctcacagaactcaaggaacacttgcttacatttactggtttattatttaagaaaggatacaataaaggatacagatgaacagccagatgccaaggtacataaggaaaggtatgtggggagggatgcagagcctcttgtcacctccatgtgttcaccaatatggaagcattctaaaccctgtctttttggggttttgtggaggcttcattaggcaggactgattaaatcatttgtcattggtaataattcagtctctctttttatcttttgttttgagacagggtctcaccctatcacctaggctggagtgcagtggcgcgatcacagctcactgcaacgtctgcctcctgggttcaagtaatcgtcccacttccacctcctgagtagctgggaccacaggcgcacggtctcactttcttttccaggctggtctcgaactcccaggctcaagcaatcctcccacctcagcctcctgagtcactgggactgctggcacacaccacgacacacggctaatttttgtttttcctagaggcggcatttcgccatgttgcccaggctggtctggagctcctgagctcaagcgatctgcctacctcagcctcccacaaagtcctgggattatggacgtaagccaccatgccccgtcaacaactcaatcttaaacccctctccctttcctagaggtggtggggctggtctggctgaaagtttcaaccctctaatcacatggttggttcccttggcaaccagccttcatcctgaggctatccaggagcccccagccatcagtcattcattagcacacaaaacatctatcacttcagagattccaacagtttttggaggaatgaaaatcaaaatatatatttcttattataaatcacaataccacagtgattattggtatgtatgcttttaattttaggctaagcgaggattgattctattcaatttttccctcaggcttataggaacacatttaagggcatctgttgatgactcattaactgtttcaaacctaaaatgtgtcaaatgctgtgactttgcaactattgttgctcttccctttagcacgaaatactttaatgatctcaagacatttatattatcagatttttgcatatattcactaaaatttggttttattaatggtctcgatgtgtcccataaatattcctggtttccaacttgagctggatttattaggaagaggcaaaatttagcttatgtgccatacctgaaggaagttacgtatcgtagcttgtgatgctgtgggacagctaaagaacaagcctttacctggtgacagattttaactggggaatagttattgtaaaaaatattttcattttttttagactacaagatatgcgggctagcattggatgcttgaaaggaaaattacatttttgctgaaatccaggcaatgcaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaaaataaaatgctgagacctaccccccaaccatctaaatggacttcctcctcgaccaaggcactcttaaaatttaacttgaaagactggttcaagtcatgacaggttgtggcagtgggacatgcctcatgattacctctctggcattaacatcaacacagaccttaagtctgataagaagcatttacaatctgttctcttggaatcttcctacctggagacttcctctgcacaataagaactttggtcttcataatcctttatcttaacccaaacatttcctttctattgatcctaggcctttatttagataaactcaaccagttgtcaaccagaatttttttttttttttttttttttgagacagagtccagctccgtcacccagactggagtgccctactgcaatcttggctcactgcaacctatgcctcccaggctcaagcgattctcatgtctcagcgtcccaactagctgggattaaaggtgtgtgctaccacgcccggctaatttttgtatttttagtagagacagggttttgccatgttgggtagactggtctcaaattcctggcctcaagtgatccacccgccaaggcctcccaaagtgttgggattacaggcgtgagccacagaaaaattttaaacctacctataaagccggaagctctccccttcaagttgttccgcctttctgaaccgaaccaatatatttcttaaatgtatttcattgaaatcccatgcctccctaaaatgtatacaaccaagctgcaccgcgaccaccttgggcacatggtctcaagacctcctgagggttgtgtcatgggccgtggtcactcctatttggctcaaaataaatcacttcaaatatcttacagagtttaactcttttcattgacactctgccaaaaggagccctgaaatgttggtcagatttggataaggaccatggccatgtggcttaaatggcatttgctcgcttgttggtaatgagttgcatttgaagaggtggaataaatggagacaaccggcatcattgggcacctgtggacaaagaaaagcctttttggttgagccaaggtgatactatccacatctgcctaggaagttgtttttttgtttggagtagctgggactacaggtgcccgccaccacacctggctaatttgtttggttttgtatttttagtagagacggggtttcaccatgttagccaggatggtctcgatctcctgacctcgtgatccgcctgcctcggcctcccaaaatgctgggattacaggcgtgagccaccatgcccggccctgcttaggaagttttttgaaagagtgtttatttgtgaaaatgaaggtgcttctttatgtctatagctttctggctttactcctttcagagatttgacttgtaaggcaatagatagaaatgatagctcatcagcatctaatgagccaaattacttactccataaaatattatcctactttctaactccaaccatacaatttgaaggaaagaagcccaggggtcccgattaagccattgacatgtctggctgaaggatgatatgggcttctcattgactgagccaacaacatgacctgcccaggcgggatccgggctgactcctaactccaggatgaaagcaggaaggtaaacagtctttgggtaatttactcaaattgtagccagtgaatacctcaagcatggcactcaccatgctgtagtgtaattgcctggcttttgtttttgttttattttgttttacctgatgggagctctctaatacttcaaacatggcacttaccatgctgtagtgtaattgcctggtttttgtttctgttttcttttgttttaccagatgggagactatgtctttcatgtctgtcttcccagtgtctttgtccgcagtaatcaattattgtatgttgaataagcaaaattataatttttaagcaccataaattcaacctgccaaaagccaaatccaattttttgtctttcaggggatggcacaatagccagcttttcaggaacctgagtgttttccaaaccagcacttttcaaacttaactatgcacatgaatcactaagttttgtgaaaatgaagattctgattcagtaggtcaggggtggggcatgagattctgcatttttaacaatctcccaggtgaggctgatgctgttggtctgcagactacaccttaagtagtaaaggtctagaccctggtctctaccttatctccaaaatttaatccatcaccaagtcatgttgtctccatctcctttgtcccaactcatgtctgtttctgttgccaccactttagctgaagccttcatcatttcactgcagagattattgcaatagctttcatgtagtctacctgctctttattctccactccactgtctatactgcagccaagatgatatctctcaaatacacctttgggcatgtcaatccattgttaaggggctttcaatgtaggataaagtaacagaccttctgtggttagattgcctttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctgtcctgggaatgggatgcagtgccttgggtggtttcaggagattgacacacttccaggaccaggcattttcatttccaccttaaagaaggagcctgctgtgctttctgagacctactgtatctgggatggccagacttcaggagacaagaagaggaaggcatcctatccttttggtgggtggatggacgggccgaatctatctcagaaatttttaatttttacttccatgtcactttccagtcttcagccagccccccaccgtctacctcccactgctggagtgtggcttcattcaggggagaatgctgagctctgttgacatttggtagaatttgttttcttccctctttaatttagcaactaatcacgggggttgttctttgttcatctttccagggttttccgtacgctgactaatgcttacagctggctctctctggagagaagtgctgggaagatcaatcaaatgaaatcttaaagggtaaatcaggttttcaaatgtgttcaggcagctttaaatcgtttcagtgagaagaagtgcttacaagggcagaaatttgcccagcgaaatgcctcccaatggcaacagaacaatcacaccttggatggctgctttgtagcctgagtgtccagttcttctgagatttccaatggccatttacaactcaagagtgagggacaaaatgaagtgcatttgacttgaaggaattcactaatgcaagatcaaagttgtaaaaactgtaccttaatatgctctatcaaagggctgtatgcagatgttaagaaagggaagctgcacaaaatatcccttttcaataatttcacattttctttagtttttcagctcctataaatctcaagaaataattaacatgaaacctatattatgtttcaggaaaaactccagagagtctttcttaggcttttggaagtcagtgatgctgttttctgtcttcttagagaagtcctaaaatggaaaaattttatcatggaaattgacccattcagagcagagagtttatgtgactttatggtacaggaaatttgaaaatcgcatctcatcttttattttctattgtcatgttaaactatggttgtgcctatgggattaagtgaatattctagccacttgcattaaatgattagccagtcttttcatagtgacagttggttgtatgtgctgctagtcctgcagcggtctagtctgctagtggttaactatggagaattggtcagaggagtccctccccctattatacacatctcattaaagactctctgccactgccaaaccagaaaaggcaacttatttcacgattcattaaagaaaacataattgggaaggtaattttgtaaagtcatcatcaaacatagtccaccacccagtaggaattatcctctcattatctctttttctagatagtcattgacattgttcccctctgttagcatgaataattaaggactgagcataaagaagtggtgtggacctatggtcaatctgaaggtgtcatcagaagagttagcagggctttcttgccttcagcaggccatttattctgagctaacctgccaattgtatttagaacagggaccattaacagggtgactgtttggctggctgtcagtaggctgtggggctttttccagagcaaatagagaagccagctgggcttcactaagaccacccaggaagagagatcatgtcccacctgatcacattccaagcaggtagcaaatgggctccagttgaattgtacttctgaaggctttctgaaggggtaggggaaaatacctcccatcttagaaattatggctgctagtgtccagtttaaaaaatttctggccctcagcaccaagtgtcttagctttttgtccatctatagctgtcagaaagacacgctttgtcttcctggcaaaactgcctctcaaggtctatgccatcattatggcttggtttaatcaagctaccagggttgcccctgtgtctctcatctggctcttccagaagggacagtttgggaaactttcagagattctgaagatttcatagggggagaccacacttaaggaataagaccctccacacattgcagtgagagtgacatgttcattgccaccaaaagaagcccctctgttaaaacaaacctgattccaaacagagctaaggttgcttgggggctccgtattgtaaggcctatgggcatgcaatgaaataggagttgatgtggactctgaaccctgaagaagcagtttaaatcactagcactgctgtttattagctgggaaattttgggcaatctatttcagttgtcaggtcttcagtttcatcatctctaaaatggggaggacagtgcctgtctttttacactcctggacttgtgttgaggagatcatggataaagtgtgttgcacacagtaagggtagttatcatggttattaaccacactgcagctaattgggctctagctaccccatttgtccctggtcaggcaggcccaggactttcttaagcttttctcaccttaaagcggaaacacattccctctcctgtggggtcacgtggctctgtttaaatgtggctctaaatgagatgtgtgccttttgacaggtcaccttgtaaagatacacagcatttccaaccatgtaaaggtggctctaacttcttgaaatcctctctttgagaactgcctttagagctggtcattttagtcacaaaagaaacatctttcaacagggtcttttttttttttttgagagggagtctccacccaggctggagtgcagtggtgcagtctttgctcactgcaacttccggttcccgggttcaagcgattctcctgcctcagcctcccaagtagctgggactacaggcacacaccaccatgccccgctaattttttgtgtttttagtagagacatgatttcatcatgttggccaaactggtctcaaactcctggcctcaagtgatccgcccgcctcagccttccaaagtggtgggaatacaggtgtaagccaccatgcccagcctcaacatggtcatgttttgaatatgcttggacagaaccttgccaccatttctcatagtcatgtgtatggtatttaaaccatagaatgtcagatttgtaatgccccctagaaatcttctagtccagtagttttcaaactatgttccccagatctcaactgtttggagaagggacatcaaggtcagggaaaatccaaagcaccatatgttcttgatgctaagatgccattagttgtagtttgcaccatcaattaatactggcatttcaggaatattaaaagaatgtatgcagtcattctaagacccatccttattttagatatgaacttcaattaaatacagtattagggttctctggaggaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtcccagactccaaaagctgaagaatccggagtctgatgttcaggggcaggaagcatccagcacaggagaaagatgaaagctggaagactaggaagtcagctaattccaccttcttcttcctgctttgttctagccacgctggcagccagttggatagtgctcacccagattgagggtgggtctacccataacactctgctgactcaaatgttaatctcctatggcaacaccctcacaaacatatccaggaacaatactttgcatccgtaatccaatcaagttgacacttaatattaaccatcacactgtccatcatcaaattaaagaaatataatgttttctgttaaacagtataattttacacaattgggtaagcactgtttcattgctattttatagattgggctaatgcctatggtttcatgtcacagatttctgctcctacagagtttgaaaattgacctaatctaacccatttcttctgtagaggtccagacaggagaaggtcatacagatagttagcagcagggctggggctagaactcaggcttcttgactgccactccagttctcttcacaatgttacagtaccttttgtctacagccatattgcataccagcccagctttcctttgccatgacttggtttgcatgcaggaattgtaaacccatcttattaaaagttaccaatgataggctgggcccagtggctcacgtctgtaatcccagcactttgggaggccgaggcaggtggatcacgaggtcaggagttcgagaccagcctgaccaatgtggtgaaaccctgtctctactaaaaatacaaaaaaaaaaaatagccgggcgtggtggcacacacctgtaatcccagctactcggggggctgaggcaggagaatagcttgaacctgggaggtggaggttgcagtgagctgagattgcaccattgcactctggcctgggcaacagagagagactctctctcaaaaaaaaaaaaaagttaccaatgataagaacattttatgttactatagcccttaacattttacagaacaattttatattctccttttccttacatctttaccacagcttgttaggtggagcaaggaggatatcatcatcatcattattatcatcattattaagacaatcacctccattttatggatgagaaaactgatacccagggaggataagcaattggctcaagatcatgcagacagttaacagaactgagaagaccatccgtgggtcctgatttactcattcaatgttgttacacattaaagcaaaacataaatctaaagatacgtcttgaggaaagagttattcactagaagcttgcaagaacatcattttattgctgaaagcagctcaccttcaccagggacgttgagtcattgatatcccagaaaccccgtgtcattgggtgatttcaactacaagttggtgccatagcctgagccctgagccctgagccctgaggatggccttatactgagcattgggtgttttatcataacagagacagttaaggtttaacaatgggctaatggccgatggcagtgcttcctgcactgctagtgagagtgccaaaccaaggaggagctgaggaacagtccagtggctaatgtggggattagctgctgctttgggtaatctgtgtccagttcaggctggttacaggagagcctcaaggactcatttcacttggctgcttcttgacctgcaattttgcatgctgcatgctgcaattttccctttgaaaatacatctttccttttaaaaatgtggtgacatgtgacttctctgaagtttaaatgtttgatcatttttaagctggcacaaaaatggttataaatcttaatacttaaaaatgtaaaaggaaagcataaaccctaccaacttgtttggtcccttttgtgtgtttgagagagcaagcccagctcagcaggccctttggatgtccgctgaggttcagaaagcaatgatctagtcgcatcaagatattgaatcttctgaattctggccttgtgccccccaggtcagggctgttgtgttggttagatggctgcccaaaaaatggtcctgccatgcccctgagtttccctcttgtgaatgaatagaaagtttccatctacagagttggcaagctctgtgctgttaatttcacttagttaaaaggaaaaaaataactaaacacacaattattagtaaaccaccctgcagacaagtttaggattctaaagaacatttggtggttaggcttaaatgctgtaggctatgattacccttaattctgcacacagacaggcttcagagccagaagttacatgatttggtcttgtcagatgaggtcccctttttgccttattcacagggagattatggaggtggtaattgtcagtggattccaaaactccctggtcaatttaagcatttatatgtgggtttaataaaatgatgatataatacagaaagcacactgtcagggaaggaagtaactattagcaacatcatgacaccttaatctttttctccctctgggagagcagaatgggttaaacagaaggtttgcttttattattgaagcacaaaaaatcacatttttgtctaagttgtttagtcagtgagttttgtgtaattcaatggaaataattccatagtaacttagtaagtcagtattgaaaaggctgggtgaaaggacagcattttagagcaggcagtgggaagcctgagggagcaggagagggggagaggggctggttaatcagccgtcatatgccaggacaatatataatcctgtttgatttggtggaacaggccctttatgggtaacatattccccaatcccaaatcaggaactgtgaactcattttacttgctataacctcaatcctcataggactggggcttataaattgtggttgactaagtggggagggctgagttgtggaagatgccacctaagggtagtggggacaagcacttcaccaggaaaatcagtgacagaggatttttcagtgtaactttgccagctggagacctctgcagccagcgatggccatgcctggatctcactcaggccctgggcttgccacaggaggcaccctgctcacttggcccagggggctgtgcttggcttgcactcctgcccagatcccacacttgccacaggatccacactcagcctgcagctgggccgggcatgctgcaaccagcttcccccttgtgtgctgacatctggatgaggggaacacagtggcatctgaacagggatgccaacaacctcaaagccccagagggggtgttacagtgtgctaacagttgttttagtcccaccatccacagcctgagcaaacaggggtgtgttaacagctctttcagtcctgttgccctgctccagcccgcagccccagggctaggctggccctgctgctgcttcctggagcatgaagtggctgcctggcactggcggagggcagagggctacagttttacagccttctttgtacccacgtttggcaggttctgagttcttgtcccacatccaagaagaatgagggtacgttgacaactgaagtgtgaggagagttttattgcatggcagctctcagtagagaggggactcgagaggccagccctcgagtggtggtcccaaagtgtggctgagtccggggtttttatggactcggaaggggatgcacgctgattggtttgtgagtattcaaaaaaggctaaaacaagggcaccactcaaaggtgggcacgacagtataaaaagccaattagggaagggtaggtatatgtaaaataggtgaagggtggggatcaattaaaggaaagcatgccagatgggaagagaggttctcaattttgtccatggatttatctaggacttgtagcttggctttcaagctttaaactgtctatggtttgaaggtggggttttatcagggacttgcccctgtctgcctaagacttgtctgccttctgctgctatgagcagtacacagaggcaggagcaaaagcagaatagagccccatctgagccatgagttgggagattttacaatgggtcagtaaaagggacaaaatttatcaaatggaagagcacaaagatgagcatttggatttgtcaggaaagttccaagagaaatgttagcacaatcacagagggttaaattctgtaccatgaactacagatgaccctgactcctttgttggttataaaatacctttctagctccatataaagcaggatgccacagcctacatgtattaaatcatgcattgtattgagttgaattgaatggtatttgggagagggaggggatagcccaagtggtcccaggttaggaccaacactggggcagctgtgatcttgggacagaaatgtgaaaacacagactgtccagatgcagaacaggtgactttcatcaaatccagtccctccaatgaacataagaggaaactgatgccccatgaggggaagcaacttgtttcaggtcacctaccaggttagttgcagaacagacctaaagggtaggctacctaattttcaatttagtgtttgcttctctttaggctttattgttactttgcaatggagatcatacagatatgggtcaggagactcaagaggacaagtgatttgccccaggctacactagtgagcggcagtagccagtgtttgtctgattccagagtctgtggacgtaactacagggatatatgatagagtgttttgtggttggaggaggagagaattccttaagagtgtgtgctcatgaggccaggtgtggtggctgacgcctgtaatcccagcactttgggaggccgagacaggcagatcacgaggtcaggagatcgcaaccatcctggctaacacagtgaaaccctgtctctactaaaaatacaaaaaattagccaggcgtggtggcgggcacctgtagtcccagctactcaggaggctgaggcaggagaatggcgtgaacctgggaggtggagcttgcagtgagccgagatgggccactgcactccagcctggacaacagagcgagactccgtctcaaaaaaaaaaaaaaaaaagagtgtgtgctcacgaaaggcagctctaaagaggtcacatttaaactgaaatctaagggatcatgggaaagaattagccatagcaaagccaggggaagtccaggctgaagtaatcacaattgcaaagaccctgaggttgatttgtccctgggataaatgtccttgcctgatgatgtgcttgcctaagtcctttttttagaggtaattctttgacagacccattgctgtctggaactcccaatggacaattactgctttgttggtgtatctaattcaagagttagcagcagaggctcatgtcatgaaacttcccttcaagcttgtttgtctgctgagtttttggtaggagcaggatgggatcaggatggttagggggccaggagcggtgggaaggaaatgagttaggaatggtcttttatgtgcccatgagaccaggctactggtaaaatactgataaatatttcccctctaagttttttttttttttttgagatagcgtctcgctctgtcacccaggctggagtgcagtgctgcaatctcagctcaatgcaacctctgcctcccgagttcaagtgattctcctgcctcagcctccctggtagctgggattacaggcatgtgccaccacacccggctaatttttgtatttttagtagagacggggtttcaccatgttggccaggctggtctcaaactcctgacctcaagtgaaccacccgcctcggcctcccaaagtgttgggattacaagcgtgagctaccacacccagccccttctaagatttttaacatatgtcatgctgcaggattcctattccattagaggcttgtatttaccgaggcaaatggacgaaaggcaaggaaccagtactagaaatataaaaccatccctgtgttggatacgccctggaacaaaggaatataaggccaggattttactttctgccctggaactgacttccctttgactctgcaagttttactttcctgctttatgtctgataggcataaaatgcctaccattcttctttctaatacaattgtaatttcatcaatgggattagtgaaggcactaacaaaatctaaattctccatagtactgatcatcagggtgttctttagtagtgacttaaagaaaatcatgctctttgaaagaatatatataagttgcctttacattgctcactgagaaaagataatggagcccaaatctaggcttcttgttcctcgcctcccttttttttcctgggtgatcatacttttcaaggttatgttctttcatattcagtgttgaccatgcaaaactggtgaacaagaattggttctgggatgatttgttccagctataaagtagaaagcattttactaaaataggatgcttagatttgtttggatctacagtttattcttaactaaaattccaggaactgttggtaacagtctagattcatggcaaccagtttttacaagaattagaaagaaacgaataaaatgttctcattataaggttcaggaccgaatttgaaggctttcaggattccagatggcaaatggtagagcgaacgtgaaaatattagaaatttatgctcaatgatcatcatcttctgtccagtgaagaatgtagtttaagcaggatgggtgcgggcgtctgatgtcctcatttatttccacctctgtagctatttaagtgatgatcattcttggtggtggttaaattatgatgcacgaaatactatctccctaaggaccttgctacaggacagaggtgattacaagaaattgttgctgctgatgtaatgtttcgtataccaagattaaaccacaagatgaagtaatgtacattttttgcctttgaaatgcagctggagggaaaccagggtaagaactattgccaaatgaaatataatgccccaggaaaaatataagatactgtaaatgtaaaatcattacaaaactgaccatctgggtcatatattaaaccacagctttcaatttgttatggtttgaggaatgacttcacagtgtgtaccccttcctccgtaccttcctcagcctcaggaaagcattctattttcatgagtgtagaaaaaaaagtaatcttaaagttttgtttttaaaaaagagttccaatcaatagctcttaataaaggcacagtgtttgcttacttctttgcatttagtcctactatatagtcttgtgttgctaattccactttagctgtggcaaatataccagtgtgtagccaccgggccatgaggtaaattgaatccgtgtggagctgacagttgaaaaacctctgtctgcctcagttcaggaaacaagagcgtgttcaactcactttgggaaacccccaggcattaaaattttggcattttcatgttttgagagaactgaggagtagccctgttttgataatcatttaaaaatattttacttaattagagcagaatttgctcaggcagaaaatcacatttatatggtagccaggctgtaacacctcatagctacccattgtctctaatcagaaatgacagcctggtgactggctccatgctgggtgaagtccagcaaactgcaggccctgtaagtgcctaatcccaaacctgggcttccagtggagttggtttttttttttttttttttttttcagtggagttcttcaatgggtctggctttgaaatacttctatcctttctagtttaggaaagcaatggcacaagaaacccatatataagtcagctacttttttgatgtgtaattcacataccatacaatttcccatttaaaggctaaaattcagtggtttttagtatatttacgaagttgtacatccaaaaccacaatcaattttagaatattataattccccagaaaagaaacccctcactctttagccttcactcctagtctccccattcctcacacctctaggcaactactaatctactttctgtttctagagatttgtgcattctgataatttcacataaatggacaaatgcagtgtgtggtcctttgtgactgtcttcttggttcaacatgttgtagcatcaagcagcaattcatttcattttattgctgaataacattccattgcatgaatgcacaatttatttattcattcattggttgatggacattcagattgttttcagtttttaactattgtgaataatgctgctatgatttgtgtacaactctttgtgcagacatttgttttcatttctcatggagtagaattgctgggtcatgtgataactctgtgtttaatcatttgaggaattgtcaggctgttttccaatgtacctgcaccattttatatttacaccagcaatgtatgagggtttcagtttctccacatcctttccaacacttgttataatctgtctttttcaaatagctgtcttagcaggtttgtgaagggttacctcactgaagttttgatttgcattttcctaatgattaattatattgatcatctttatctgcttaatttctatttgtatattttatatagagaaatatctattcagattctttgcttatttgaaaattggattacttgtcttaagttattgagttataattgttctttatatagtctaggtacaagtcttttatcagtgacaggatttgcaaaaacttcctcccattctgtgagttttctttcttgatgttctttgaagcatgaaagtttaaaattttgatgatttccagtttatgtgttttttcttttgttgtttgtgtttttggcatcatagctaagaagtcattgcctatccaaggacatgaagatttacaactgtgttttcttctaagagttttattgttttagctcttacatttctgtctccgatcgatttcaagttaatttttgaatatggcataaagtaggggtccatctttgtccatttgcatgtggacgtcgacttgacccagaatcatttgctgaaaaggctattgttaacagttccctccctgccccatagcagccatgcatggggcaacttccagtgaggtgagtatgaggttgtggcaagcaggcctcagtgatggtggcatgatgaccatgctctggggcttcatctgtaatgacccgttcagtttcaacagcattaacttggagacacttacagaaacttacaagattcctttttacttacaatatcttgccagagtattttatcattgcagaggcatctagtggaaagttaatggattgtattgtgggtaaagcagaaggttcagtagctagggaagaatggcaccgttatgccacagctctttctgttgcccaaaatttccatatcttggtttggctgttaaactcatagagttgttggaggaaatttcagaaaggcacaagacaagggtgcctttggttggccctttaataatttactgtacccctagatagcacagggaaacaagtgtcttagtccatttatgttgctataaaggaaactgaagctgggtaatttataaagaaaagaggttttatttggcttatggttctgtaggcagtacaagaaatgtggtgctggcatctgcttctgggatgacctcagaaagcttccactaatggcagaaggcaagggagagcagacatcacattgtgtgagagaggaagagagtagagagggagtgctgggctctgtttctgaatcacttcttggctgggcatggcggctcatgcctgtaatcccagcactttgggaggccgaggtgggcagatcacctgaggtcaggagttcaagatcagcctggccatcatggtaaaaccctgtgtctattaaaaatataaaaattaactgggcgtggtgggtgcctgtaattccagctactcgggaggctgaggcaggagaattgcttgaacccgggaggcagaggttgcagtgagccactccagtctgggcaacagagtgagactccatctcaaaaaacaaaaagaaaaaaaaatcacttcttgagggacctgctagagtgagaactcagtcattatcatgaggatagcaccaagcccattcacgagggatctaccctcatggcccaaacacctcccatcaggccccacctctaacactggggatgaaatttcaacatgagattggaaggggcaaatattcaaactgtatcagtgagaaaaataaaataatatgagaattgagaaagaagcaaaacttttatgttgcatagatatgattgtacaaatagaaaatccacaattattcttatggatttattacaataaatgtttagaattaacaatgtttaagaagttggatataaattcagtacaaaaatcaattgcatttcaatatacaaaaaataacatttagagaaatatgtcatttgcagtgttaccaaaaaacattaagtgtttaggaaaaacctaacaaaagccatgcaagacctctttgaagtttataaagctttattgagaagcattcaacatgagctagctaagtgggcagatagactgcacttgtagattagatgacgtgatattataaaactggtaattctccccaaattgatccacagatccagtgtaattgcaatcaaaacctcaagtatttttgtgggatttgttaatctgattcctttttttttgaaacagtgtcttcctttgtcacccaggctggaatgcagtggcatgatctcggctcactgtagcctcaacctcccagactcaagtgatcctcccacctgagcctcctgagtagctgggactgcaggcctacaccaccacacctggctaattaaaaacattttttcatagacacagtgtcccactatgttgcctaggctgttaagctgattcttaaacttgtgaggtaacggaaatagctaaattaagacaaaatattcttttaattttttttaatatagagatggggtctccctgtgttgcccaggctggtctcaaattccttggctcaagtgatcctcccacctcagctgacaaggtattcttaaacaacaaaatgggcatacttgcccctccaaatgtcaggctataataaataagactttgtgttagcgttgtagtagttgtccagaccagtggaacagaatttgagaaacagatccaggaatacatggaatttgacatttcttagaggagaaattgcagatcagtggtgaaagaattgacttttcaaagtgtggtagaacaatttgacagccatgtgtggaaaaatttttcccagattactaccttatcatatgcacaaaaaataaattccagatttatgaaaaatctaggtgtgaaaagtaaagctaaaatgctctttaaagatagataatataggagagtgtctccatgacctcaggatagaaaataacttcttcaacaagccattgaagcaataactgtaaaggaaaagttcatatattcagtttcattgaagtgaagtcattttgttcttcaaaagatgtcataaggatcataacaagaccaaccacaagttggaagaagatatttgcaaaagcattacaacagtgtttgttggttatctggaatacatagagaagaactatagctgggaaaaataaataaataaataaatatgggaaagaccattaagtactatacaaaaagagaagagtaaatgggcaataaacaaaaactgcatttggccttattagtaatcaaaaatgcatattaaaatcacgatgcggcaccattataccatgagattggcaaaactaaaaatgtccaaagcaccaagccttggtactgtggggatggagttttactcaattctgtgagtgtaagctggtacaagcaggttagaaaacagtttggggccggctgtggttgctcacacctgtaatctcagcactttgggaggccaatgtgggaggattgcttgagaccaggagtttgagaccagcctgggccacatagcgagatctctgtctttacaaaaaaaaaaaaaatagctgggcctggtggtgtgggcctgtagtcccagctgctaaggaggctgaggtgggagggtgccttgagcccaggagttcgaggttgtgccactgcattacggcctgagcgagagtgagaccctgtctctatacacacacacacacacacacacacacaaagagaaaaaaaagaaaataaaaaaggaaagaaggaaacagtttgacactctaataaagtggaagatatgcatactcttttgacccaggaatgacctcataactgttgaccttagatattgcactatgagacgcaaaatgagaatattcatagtttttaatagtaaaagccggaaacttttaacaataggactatgggcaacttatgatatattcatacaatggaatgctaaacaacacacgaggctaagtttcacaatattaactgagaagggcaaatcaaaaaaatttaaaatataactccatttatatgaagttcataaacaggagaaactaaactatattaggtggtaaattagatattacttggcaatgcctaatttctttccatctatattaggtagtaatacctaatttattgctacttaatattgctatattaggtagcaagcagcaagaagataatgatcacaaaagtgaagaagtggagacctcttggtgagggaggggaagttgatgactagagggacctgagggaggctacctttgggccatggccacatgggtgcttactgcagtctttaatttgtacatatggatgagaacattgtatgtatgctatgactaatctataaaatgagcatatcaattactgcaacataacatatagtaatttttaaaaaccaagtaacagaattgtggttaaaaactacttttttgagtttatcttttaagaaactatatattatagattgtgaaatattagcatgaaaacaagaaagtcatgtttttatgctgcaaaataatggtcacaaatcctatgtaataaaaattgatattgtgatgtaaaacaaaggctattattttctcactggatttttccccactgttttagcacccttgttgacaatcattgactaaaaatatgaggatctggactcttaattgtatttatctatacttatgccaacaccatattttattgtcttgattaatgttttgaaattgagaagtgagtcctccaactttgttctggttttcatgattgttttggatattctgggtcttttatagttctatgtgaattttatgatcaactcattgatttctgcaaagaaaagtaagattttgatagggattacattgcatctgtagatcaattaggggagtattgtcatgttaacaatatcaagttttctgattcatgcacatgggatgttttcccatttatttaggtcctctttaatttctttctgcaatgtattttagttttcagagtataaattttaggcttattttattaaatttattcctaagtatttaatttctagcgatgctattgtaaatggaacagtgttcttaatttcatttttggtttgtccattgctactatatagatataaaattattgttggatattggtcatgtatcctgcaaccttattaaaattgtttattagttctaataaatgtttactttattccttaggattttctatatacaagatcatgtcatctgcaaatagttttacatcctcttttccaactggggtgcctgtatttccttatcttgcctaattggcctacctaaaacttccagtacaatgttgaataaaagtggctagaaaaattatccttgtcttgtttctgatctcaaggggaaagtatcattctttcaccatggagtctgatgttagttgtgggttttttctagttattctttatcaggttgaggaagtccattctccttttttctttaagctattgattatcaggatggatttaggtggtcttgctgctttggaaattgtagacttccttcttaaagcctgctccattttatccttctaagatatgcatgattttggaaagactacaagcttcccagttagaggagggccttcttgtttttcaccctacatacaatgagcctccttgttggatgccaaagtaaggtctttacatccttcattccctacagaccaggcttcttaaattatcaggccacaggtaacaaatatatttcatctcctgtaccaattctgatgttttggtagtagctgcccgaaggattgttaagaaggaatctgaggccaggcacagtctcagtgctgtcattaattagtgttatctggcctggtgcactggctcaggcctgtaatcccaacactttgggaagccaaggctggcagattgtttgagctcaggagtttgagacctgcctgggcaacatggtgaaaccccgcctctaccaaaaaatacaaaagctagctgggcatggtggcacacgcctgtggtcccagctactcaggaggctgaggtgggaggattgcttgagcccaggaggtggaggctgtagtgagccgagatcacacaactgcactccagcctgggttaaagagcaagagcctgtctcaaaaaaaaaaaaaaaaatgagtgatatgtgtcactggtctggtagtagggaaggctgcaaattgatacaacttctggattagactgtgcctgtgcctcaaccaattccagtggcctttttctcagtgccctccgtactccttcaacaacattaaatcttatggtccatacccctttgtaccaccctctcttctttagatctctgttacaaagcaatattctgggtctcctgtaaagtctctggccttccctcccccgacttttcccctcaacatatctctctagctttctcaactgagcctttgatcctgtgtactgtttgcttgggatattttgcccttcttttacatctctccttgctgaaaattgtgccattcttcaaggtccatctcaaatctgcttccctggttttccccatacctgagagactgttctgcccttaaactgccaaggcataggatatttgggtaccatacctagaattgttttccttcatgtacttttctgagttcctgcccagtactgaaaatatgaaattttttaagtccaggcagggactttatattcttagcatatgactccctgcttttactatggtggatgctcaataaatgtttggtccttttaaactctttgcttgctgtctattggaatgattatttttaagatttcatgttatttctattataggctcattagtaatgctctttattttgtgtttttcctggtgtttattccaggacatacaatatataacaatttagtattagtacacatatataactaggttatatattgctgcatgacaacctgtcttcgaatttagtggcttaaaacaacaaacatttattatctaatagttttagtgagttaggaatctaggcatggctttgctgggttctctggctcaaggtctctcacaaggctgcaatcaagatgttggctggggctgcagtcatttcttctgaaggcttgattgagggaggatgcaattctaagctcatgcatgtggttgttggaaggattcagttccttgtagtctgttggactgaaggcctcagttcatcactgactgtcagctggaaacccccatcagttccttgccccatggaactctgcatagggcaatttgccacatagcatctattttcatcagagaaagtgaaagataataagagagggtgaacaagagagaaggcagagtctttttttttgtaccataatcttggaagtgacatcttagtacttttgcgctattccatttgttatgagtcattatatccatcacccattcaaagggcaggtattacacaatgacatgaataacagatgttgtggatcattggaagtcatcttagaggctgcctaccataacatccttctaacttttaatattctaccttgaaataataatataccattttagatggtatattattcatgtgaaaacctataacaatatattttaattttcctcttctcagcctttgaactacctttctcatcatttttctacatatgttataccacatatagtacaatatagtattatttaattaatttatttattagagatagggtcttgctatgttgcctaggctgtttttgaactcttggcctcaagcagtcctcccacttcagcctccaaaagtgctaggattataggcatgagccactatatctggcctattatttttgatttaaataattatcttttaaagagattttacaaatgagaaaccaatatttaatatttatgcacatttttatcatttacagtgttcttcattcctttttgtagctccagcatcccatctggtgttattttccttgtgatgaaagaactttattatttcttatagtgttggtctccttgcaatgaattctccctcaaaaaaggaaaaagaaataagaagtgtaagaattgatagggaagatataaaactatcattacttgcagttggtatgatcatctgcagaagaaaaacaagataatggatagaaaaaatgataaaaactaataagaaaatgcagcaacttataaaaatcaatagcgtttctctgtaccgatgataactgatccaaaaacagctggacttctggcagtaattttctcagactgctcccttatttcacctaatttttgaaagacagttttttttttctgtaaatagaatgataaggtgtcagttttttctttcaatacttcaaagatgtcacactattgtttttggtttgcatagcttctgatgagaagtatgccatcatttttatctttgttcctttgaacaactttcacattttttcagtacttagataatgatttgctatggtgtggttttttccttttatttttggcttacagtccattgaaatttttagacttgcgcatttatagttttcataaaatttgcaaaacttttggtcctttttcttcgaatattttggtacttcattgaaccctgtggtgtttcccatagctaactgatgctctgttctgtttgtctcagtcttttttctctatgtatttcattttgaccagtttctattgctgtgtctttaggttcattcatcttttcttccgcagtgtctattgtactagaaatcccagcctatgtatttttcattacagatactgtatgtttcatgtctagatgtttgatttgagtctttcctgtaccctccatgtttctacttaacatgcccagtctttcctctagctcccctattaaatgggagcatatatataatgactatattttaatgtccttatatgttaagtctataatttgtgtcatcttagtttgtttctgttgattgatttttctccatttaagagttgtatctttctaattctttgcatgtctgataatttttgattggatgttggacattatggattttatattgttgggtgctttattttatcatatttctttaaatactattaaactttgaaccagcatgcagttaattggaatcagtttgatccttttgaggcttgatttttatgctttcttagggtagtatcaacgtagcctttagcctgcagctaattttatttcactaccaagacaatacacttttcagggctctaattattgccccatatatcacaaggtctttccattctgctggtaggaacacaaactgttcctgtgtctttgtgagcttctggggactggccctcctactttttctttttttagcaattcttttattggtcttgggtagtttcctcccatacgtatgccaatcagtactcagccaaagacataaagggatccatctgaagacctccagagctctctcctatgtagctctcttctctctggaactttttcccacaagttttaattattttggcctccctcttccctgatttctgtcttctcaatgcaggaaatcactgggctgtttgcactgcatcgtggaaagcctctccagtcagtaagctagggaagatttaggggtgcctcacttgttccccttctctgagggctagcaatcttgtactgactgttgtctagtgtctgaaagccatttttttttcatgtattttgtccagttttttagttgtttaatctgattgcttttactccatcatggttggaagcaaaagttgttaatacgtttttgtgatgccagactgaactttcattgtttggctattcaagggctaactcttcagcttattaaaatgcagagaagcttatatatatatatatatatatatataaccttatgttgataaagagagcatatatgacaggacacctttttttcaaactgagtagttagtagaagcatctagaagagaaaacatttggttttctaaactattaggaagatattaagccatttagggcagtgttccccaatcattttggcaccagggaacagtttcgtagaagacaatttttccacggacagggggaggtgggggatggtttcgggatgaaactgttccacctcagatcatcaagcattagattctcatgaggagcgcaacctagatccgttgcatgcagagttcacaatagggttggcactcctataagaatctaatgacgccactgatctgacaggaggcggagctcaggcagtaatgcttgctggcccgctgctcaccacctgctgtgcagcctggttcctaacaagccatggaccagtacccattcgtggcccagggatggggacttctgatttataactttgagtcactcaggctaacagcatcatggttaaggggatatttagcaacagaaataaagtgacttttctgagagtatgcaatgactccattcgccctaggtccaaaatgatgagaattgaaacacatatgttactaagattgtaaatggaagagggcggagggaggtggtgaacatcagcatagggcagaagttgtcacatccacactttcttgtatgtcccctattcctggagctgccttccctatttttttgcatgtctaaagagcaagtcatatcactgatctctgaataataaaagttaccatttattcagtgcttattatgttccttgcactgtgctaagtttatatattatctttcactgaatcctcacatctgcctatgaggtgggtgctattactattaccattttatagatgaggaaattcagatatagagaggtttaattatgtacttaaaggctatacagattagtgattggctgagctaggactagaacccaggctttttgactccatactctgtacttttgccttcatgtctccacctgagttgggatttcctgttcttccaaatcaatctcggcattatttagcactgaccacgattctttgcatcccttgcccccgctccccccgcccccagcacctccaagtatctattttaggcgactccagctcaggaagagcctcgatgttactcggcaacaggtatctctcaacctctaaaatgttccaccttctgatagaattccaccttatagttttgtcatgttgcttccttcaacactagatggtggacttcctcattgtctcctgattagaccttaatcactgctgcctttaaatgtcatgttccttcaaagctcaagacttagttggctctttcagttagtctttcctgatggatcacatgctgtcgaaatccttctaatgctttgaattatcagcatttaccttggatttggttagatggtctttctgactttctctgagattctctggtactttgaatctctttctagatgtttatgacatagcacccctatattcatattataacctgctcaaaattcccaatcatagaatatttactgagttcctaatatgagcaaaacactgattttaacattgcccttctcttttgagacaatcagtgtttccactgtttaatttttaattttttgtgggtacatagtagatatatgtatttatggggtatgtgagatattttaatacaggcatgtaatacgtaataatcacatcatgtaaaatggggtatccatcccctcaagcatttaccctttgagttacaaacaatccaattacactctttaagttattttataatgtgcatttaagttattattgactctagtcaccttattgtgctatcaaatagtaggtcttactcattcttttttttttttttttgagacggagtctggctctgtagcccaggatggagtgcagtggcacaatcttggctcactacaagctccgcctcctgggtttatgacattctcccacctcagcctcccgagtagctgggactacaggtgttcaccaccacgcctgggtaatttttttgtatttttagtagagacgaggttttaccgtgttagccaggatggtctcgatctcctgacctcgtgatccacccgcctccgcctcccaaagtgctgggattacaggcatgagccaacactcccggctcattctttctaactattgtttttgtacccattaaccatcctcacccatccccagtcccccacttcccttcccagcctctggtaatcatccttctactctctgtctccttgagttcaactgttttgacttttagatcccacaaataagtgagaacatatgatgtttgtctttctatgcttggattaattcacttaacataaagtctttaaactcttcatgtttattattcctccaattatttaatatgaagatctgcctggtgacagtattggagtgacgctcctatagaaccaaaagaggcacctgagttgcagttttcatcaaagtcatgtagtatacaccataggcattcagagtcactgtcagtccattgataagatgtaaggcaacagattagaacccacagcccagtgtcagcaagcagaagtgatgattgataccagtgagaggaaatagatgaactaacaagtatggccagctgccagatagttgtttatatgtcagtatcatcattgagcatcacattatcataacctagtacagtaatagatattcctaaagactgagacaaaatgcatataaagccctcatctaatgcctgacacgcataaagcacagaataaagtgtgtgtctatgtatatacattttatatatacacacaaatatacaaatgaaaaggctaaattataatcattgtattttatatatatcatatatatgtgtatatgtatgtatatcattatatacattgtaccttatagaagagaagtatacatgacattttagaatgatttccgtggaagtagctagaattaaaaaatatttttcgtttattgagaagtactttcagttatcacagtgcaacactgctttctgtaatgaggctagaaaaatgaggagccattgtatttaataaaataagaattttttctgtctccatggtaagattaacgaacacacttcaacataaagtaatacaattgctaccttcttcctggtggcatgctccctgtgttaaatttaagtgacagtaaaacgtaatgagttagaggagaaaaattttaatttattcgtttatttgaatagggaaacccaagagatcagtgatagaatttgaactgcgagacaaaaagaaagaagaggttttagttttgtagctaaaattaaggtggtggcacttgaagtgaaatttaaaaatacacattcacttagttttcttggccatattctgcttctcatgtgaaactggacttcctgccttttagccttgtattctgtccctttggaaactgtatcatcttttaaaaatgaagtacgtgactttcgtaatgatcttttatattataaaaataggccgggctcagtggctcatgcctgtaatcccagcattttgggaggccgaggctggtggatcacttgaggtcaggagctcgagaccagcctggccaacatggtgaaaccctgtctctacaaaaatacaaaaattagtcggacatggtggcacatgcctgtaatcccagctactcaggaggctgaagcaggagaatcacttgaaccccagaggcagaggttgcagtgagctgagattgtgccactgcactccagcctgggcaacagaacaagactccatctcagaaaagaaaataacatcaaaataaataacataacataacataacataacataacataacataacataacataacataacataacaataggaatttcaaaaaatctgaaacccgggcctggcacagtggctcacacctgtaattccagcactttgggaggctgagacgggtggatcacctgacgtcaggagtttgtgactagcctgaccaacatggtgaaaccccatctctactaaaaatacaaaaatcagccgggcgtggtggcgcatgctgtaatcccagctactcaggaggctgaggtacaagaatcgcttgaacccaggaggtagaggttgcagtgagctgagattgcgccattgcaatccagactgggcaacaagaacaaaacttcgtctctctccccacctccccccccacaaaaaaaaaaaaaacctgaaacccatcatgactatatcatgatgctgtagcctcaaaatggacttcacaagttcacctgtgattccctcaaaagcacttgagttttgatttgctgattgccagaagtgtatttgaacagtcccactttatatggagccccaagcatattaaatggagattccagataattagtgagctctggatgaagctcctgggatgcagtggggaaaaaactggatctggagtgttaaggtttgggctctgggcctgactttttcccttatcatttggaaattaggctcaggattgtgtattggggaaacacagcaagctgtatgcctatagtaaatagacaccctgtttagtggcattcaatagacctcaatgccatattcattcttccccaaccctatctgtcttggcttcaggcagatcttggcatagggcaccctcatcctcccccactgccacctagctcctgggtgaatgtctcccagcctgggaagagttctgttgaacttcatgaacaatgctgtctgcctagcattggagctcataccctgagactttgccttagtcctctcctttgtgcccagaggcatacatttgagagacagtcaatagagccttagacccctaactttgcacatataagtcctatgaaccatctgggccactcactctgcttagagcaattgcacactgctccctctcctttccttccatttacatctacagggagatttttagtttactaagccctggtaaatgacagttactaagatgtaatacaaatcttaacagtgggaacagtgactactgtttatcacgtgaatactataagtcaagcacaacaaccctttgtggtgctgctagagttaaggaggcatcctcagaggttgaggaatgtgcccaacctcagatgctagcaaatggtagagctttgttcagagtccaggtcctcattctaccacatctcactgcctctttatgttctgatgtctctactgtgtatatcaatgcttctcaaacgcagtatgtacacagttggccctctatatccgtgggttccacatttatggattcaacctaccacagacagaaaatatttcaaataaaaagcaataaaacataacaatacaacaataaaaataagacaaattttaaaagcaatacagtgtaataactgtttatatagcatttacatttattggatacgagaagcactctagagatgacttaaagcatatgggggatgtgtagaggttatacacaaatactttgccattttatttatttgtgtgtttgggtttctttttaagatggagtctcactctgtcacccaggctggagtgcagtggcacaatctcggctcactgcaacttccacctcccaggttcagatgattctcctgcctcagcttccggggtagctgggattacagacatgcacacccacgcccaactaatttttgtatttttagtagagacggggtttcaccatattggccaggctggtatcgaactcctgacctcaagtgatcaggctgctttggcctcccaaaatgctgggattacaggcgtgagccaccatgcccagcctgtgttgccattttatatcaggctcttgaacatttgtggattttggtaccacagggggtcttggaacattgcaatactctatgaatactgagggacgactgtatacatatcacctgggaatcttgggaaatgcagattctgatcttgtacctctggcatgaggccttgattctgtgtttctatcaagttccaaggtgctgctgctgctactgatccatggaccacattttgagtagcaagagtgtgcactatcagaaatacaaggggagtcaagaatcttataaccggattggacatttttaacaaaaatactgttgaaaatttacaggataaatttttgaacattttgaaagaacaaaatgttttatcaactagaactttgcttcattttcaatatggtcttcaaaaacaaaaacaaaaaatcaaaaccacaatgagataccatctcacaccagttagaatggcgatcatcaaaaagtcaggaaacaacaggtgctgaagaggatgtggagaaataggaacacttttacactgttgctgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttgttgtggcactattcacaataggaaagacttggaaccaacccaaatgtccaacaatgatagactggattaagaaaatgtggcacatatacaccgtggaatactatgcagccataaaaaatgaggagttcatgtcctttgtagggacatggatgaaactggaaatcattattgtcagtaaactatcgcaaggacaaaaaatcaaacaccgcatgttctcactcataggtgggaattgaacaatgagaacacatggacacaggaaggggaacatcacactctggggcctgttgtggggtggggggagtgtggagggatagcattaggagatatacctaatgctaaatgacgagttaatgggtgcagcacaccagcatggcacatgtatacatatgtaactaacctgcacattgtgcacatgtaccctaaaacttaaagtagaataataataaaaaaaaaaataaaaaaaacttttgttctttcagttaacatttttttttttttggtaaacatttggataaggaaacctgcttatccaaatgtttaccaaaacagtatcatccagatgatgacagttttgccccacttgctgaattcagcttcacattgctgacactctaagcaggggtctttgaatgtgcttcgggagattcacacttctcctccccatgatcatatacacagtcattcatatatgtttctttgtacatgttctgaggaagaatcggaactgttcatcacattctccttggacttgcaaaccagtgctccaggagaaaggtgcactccttctaatggttctggaattccccatcaccaaatccttgaccaagaagaatacatagtaatatatgcaatttatttgtatcaggtgctatgagttctcaggctgctgactacataattgaagcccttggaaaatgccagttgaatgctataattaggtaaaaataaatgcactaggccttttagataactttccagatgattgtcagccaaagcccaggcagaagtagtccctaatttccctagagctgaaagtcagtgaccttcagcttcccttttccacccttgtgattgtcattagggctgtgcatgtagcaccctcagccagcaatacggtagaagtgaggctcatcgttacttacctaggtctctgcattttcaatatctatctgcaaaatgagcttgatcaatatttaattattagtcaccaggaggtaattagagttacagaaaccaaaaagaatacatatagatgagctcaaggtgttctgagcacaccaaaccattctgacgattcaacatggaaacagctctgatcccaataatagccatagaagcctacctttaaaacccatccctgctcatttttattaggttggtgcacaagtaattgcgggttttgccattacttttaatggcaaaaactgcaattacttatgcaccaacctaatgcatttccatcattttcatagacctgagcacttatgagccatggccttgtagtcagactgcatggattcaaatcccaattattccacttaatagttgtatgaccttggtacattattgtcctctctagtctcagtttcttcttcctgcaacataagaataatgatgctaataataatagtgatagatagtactgctctcatggggtagttttcagattaaatgaaatgatctatgtcaagcacacagccaaatgactggcacatagcaagtactcactaaatgctaactgttgttattactttctaggccaaaaacaatatgtcctctttaacaggagcattgggtacaaagagttactgttgcctatgaaccttaactctttcagttagtggaggagaaattaaaaatctttgtgttatctattctgttcccttggtctttgtgcctatttttatactagtaccatgttgttttggtgactgtagccttgtagtatagtttgaagtcaggcaatgtgatgcctccagatatgttctttttgcttagtcttgctttggctatgtgggctaattttaggattgttttttctagttctgtaaagaatgatggtggcatttatctatcatcgtctttccttccacccagaacatcagagctagttgctacttacttccacattgcctctctgtttctccaccttcctagctttgatgatctgcatttctgctccattgtacttccctcacatacccactaccaaggtcacatatttaaccttacactttcgtatgtggatccactcctaagacctcaacctctgactacattcatcttggactacatacatctcttcctttctcacctcagaatctgctcttggtattcccaggactcattgatcttcataccgttccctttgacccagtatagaagcttctccctactttcagccacttccccccttctcttgccatggattcacactctcctgtatcctgcacaccattgccagtcatttcaacagatgactcataattccaaaatccctcaacaccataatcttatatcattcttgatttaatccccagcataatctctctgctcttgaagtaccaagtgttggtggaaaaagttgcaaaatgatgctcattgggtacacagatcagtagtactttctgatcttagctgggccctccctactgcttgaatgctctcttggatgctcttgtattcctctcttgccatcttctcagagaggcaggatggcacagcagttaatagcccaagcacaggcaactgatgagacttagacgctgaaatcctgggtctgctacttgctgcctgtatgattgggaaaattgatctaatcttaggctttagttttcttcacctgtaaattgggattgctcctcaccttaggggattgcttgtgaataccaaatgagatcatatatggaaagcacttataacacagtgaatggcacacgaagtacaaacacacacacacacacatgcacacaagcacatacacatcagctctattgaggtatgaattatataccataaaatctaccaattgtggcaggacacgttggctcacacctgtaatcccagcgctttgggaggccaaggagggcagatcacttgagcccaagagttcacgaccagcccaagcaacatggtgaaaccctgtctctacaaaaaatagaaaaattagcaggacatggtggtgcgtgcctgtaatccagctactcgggaggctgaggcatgagaattgcttgagcccaggaggcggaggttgcagtgagctgtgatcatgctgttgcactccagcctgggcaactgtaatgaaactctgatatggtttggctgtgtccccacccaaatttcatcttgaattgtaactctcataattcccacgtgtcgtgggagggacctggtgggagataattgaatcatgggggcgggtatttcttgtgctgttcttgtgacagtgaataagtctcatgagatctgatggttttataaatgggagttcccctgcacaagctctttattgcctgccaccatgtaagatgtccctttgttcttcctttgtcttccaccatgattgtgcggcctccccagccatgtggaactaagagtccattattaatctttataaattacccagtctcgggaatgtctttattaacagcatgagaacagacgaatacaaactctttcttaaaaaaaatctaccaactgtaattgtacaatttaatgattttagaatatttatacagttgtgcaattgtcataatctagttttagaacacttccattaccccacaaaattccaatgtgcctgtttacaaacaggcaattgtagtcaattgccattttcactcttgacctctggcaaccactgagtgaaccactttctataattttgctttttcttgacattcacataaatggagccatataacatgtagtcttttgcatctgacttctttcacacattataatattttgggggtttgtgcatgtggcatcatgtatcagtactttattccttttgatggccaaataatattccattttgtggctataccacattttgtgtgtccattcatcagtagatggatatttgaattgtttcctcagtgtttccaattgtgaataatgttgctatgaatatttgtatacagctctttgtgtggaaatatattttcattcctcttagatctgtacctaggagtggaattgctgggttatatggtaagtgtgtgtttaatttttaagaaactgccaaagaatgttttaaagtgtcagtaccattataccttctcaatagcaatatatgagattccagtttcaccacattctcaacaatacttgttagtgtctatcttttattacagtcactctagtgaatgtacagtggttctccttttgcttttaatttaatttccctgatgtctaatgacaattgatggcatatacttattaaacattcacagatctcctttgatgaaatgcctattcaaatattttgcttataattggtttatgttctcattattgagttgtaagagctctttatatagtatagatacaagtcctttatcagttctgcccataatgaattctctcagactttgtttatctgggaatagccttattttgccttcattttcaaaggacagttttactgcatgtagaattattggttaccttttttcatctttcagcattttttttttttgagacagagtcttgctctgtcaccaaggctggagtgcagtggcctaatctcagctcactgcaacctctgttcccaggttcaagcaattctcctgcctcagcctcctgagtagctgggactacaggtgtgtgccactacgctcagctaatttttgtatttttagtagagacggggtttcatcatgttggtcaggctggtctcaaactcctgacctcaagtgatctgccctccttggcctcccaaagtgctgggattacaggcgtgagccaccatgcctggccctctcagcattttgaatgttactccactacctacagcctccattgtttcagacaaaaagagcattaattgtattgatgctctactgtacataagaggcttttttctgttgtttctttctagatttttctatcctgtcttctcttttttgtttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtggtgaacatatttataagaggtcttttgaagttctcatccagcaagtccaatatatggggacatccagaaactttattgattgctttgtttttcctgagcacatctcacttttctgtttctctctaattttttgttcaaaactcacattttacataatatattgtagcaactatggattctggtgtttttcctctgatggttggtgttgttgctgtttttctttgtttgtttgtttgtttggtagtttctttgtttattaacttgcctgatctaaatatgtgaattatgtctcccacatcgtgtgtagcccccgatgtctgtgctcagtttttaaattcttgttttttatttttaagcatggctttctattggttcttttctctgtctgtgtagtttagtgtacagaggctgtgaccaaacatcttgtgccattaaggctactatcttctgttggtgggtctgtgtttggtagagttgctcattcagggtttaagctattttcaagtctgccctggctattactttctactgggccatcttacatcatatgtgttctctgtaagttttagttgttatgattattatgactgtatattctttcctctcagcagttgtaccaaaggcttttttgctctccagtagctctcctttctagcttcttcaatctcagcaggtgaccctccttcttgctttctgaaaagatgtcggccacacagtatagaacccatgacttccgatttcattttttttattgagatataatttacctaaggtaaaattcaccattcagagtacacagctctgtgtgactgttagtataatcacaaagatgtacaactaccatcactgtctgattccagaatgttttcatcacccagaaataaaccctgtgcccattagcaatctcttctcatttctgtttcccaccaactcctggataccagaagttgtagcatgaatcattgcttcattccttttcattgctgaataatagtccattataagggtagatcatatttggtttatctgtttatcacttgatggacattggattggttccacattttttctgttgtggataatgctgctatgaacttttgcatacaaattttagtgcagacatctttttggttctcttgggtttacacctccccactttatattttatttaatgtaaagtatatattataataatgttgttacttacttctcattgttgaagaattaccttctacgccatgaagaattcttaaattttattcccactctctatcaccacttgcaggaccttgctccaacaatatcactcctcatcagtatctctcttcttgctcccacagtatctctccttaccagtcatttcatcttctcctctgagtccatgctgttagtctacaaacatgatctgatatgtttgatcccaagccttcagttacctttaacacttcccatcattcttcttatctaattggttgccaaatctggccaattttatcttcaaattaattttgaaaattattttgtactcctcttccacattcctaccagtcaaatcactctctatgccccagattagacacagttactcttttctctatagcactttgtactttgtgatggcacttagtgtcttgtggaatagtcatttttgttttagttgtaatttgttaatttcctcctggctgcaagaataatcttttattcttactcattcttgcatccccagagcagcctagcattggatcagagcaaaggagtagcactcaaaacatcataacatctgcagattgtggtttaatttggactttcaaatttattatttctcatggtctctctcctttccatccttcatctctctccctccttctcttactaccattgtatataaaactaatttctatttatatgtatcttgaatggtgtaaggtcagagataaccagtttcacacatgtttgtgtctttccacagtgtcagacttttattgatgctatttcaatcacaaaatccatgagccacatggagttcccaaggaggcaattctccttcgtacttcccattcactcggaagtcagagccatgccacagaggcacaagccactccataagtcagtcaatattgcaaaccacacaaaacagtacatttcatctatatatatatgttacagattgaacattccacaacaaacaaattaacatttaacatcaagagaaagaggataggaaaaggggttaatgaaccagtctaggaagacagatatagacaaaaagaatgtcctggtctggaccagctggtttgtcaattttgcaaggaaaagtctcatgtgggcagagcctttggtggcagatgctgggtgcttatcacgagtgaaagcaagacggtgtcagttaagacagccatttggagctgctgaagtcctgctccttttatggccacagagtcctctggtgaggactgatagtggaaaagtatgcctatgtccttatctggttggttgcagtctttatttattaagcaaaacatcttgaccctcttaaaaaagtgccctatgaaatgtaagatggagtctttttctaagatggagttacttatgttaagggcgctctgtacaatatatgcttgacatatgttaggcactcaataaaaagctgttggttaacgcaataaaaaatggtaaaggagatatcaccaccgattccacagaaatacaaactaccatcagagaatactataaacacctctacacaaataaaccaaaaatctagaagaaatggataaattcttggacacatacaccctcccaagactaaaccaggaagaagttgaatccctgaatagaccaataacaggctctgaaattgaggcaataattaatagcctaccagccaaaaaaagtccaggaccagacagattcacagctgaattctaccagaggtacaaggaggagctggtaccattccttctgaaactattccaatcagtagaaaaagagggaatcctccctaactcattttatgaggccaacatcatcctgataccaaagcctggcagagacacaacaaaaaaaaagagaattttagaccaatatccctgatgaacattgatgcaaaaatcctcaataaaatactggcaaaccgaatccagcagcacatcaaaaagcttatccaccatgatcaactgggcttcatccctggtatgcaaggctggttcaacatatgcaaatcaatgaacgtaatccagcatataaacagtcccaaagacaaaaaccacatgattatctcagtagatgcagaaaaggcctttgacaaaattcaacagcccttcatgctaaaaactctcaataaattaggtattgatgggatgtatctcaaaataataagaactatttatgacaatcccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcgtctcagcccaaaatgtccttaagctcataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcaaggaaataaaagaggacacaaacaaatggaagagcattctatgctcatggataggaagaatcaatattgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaggctggaggcatcacgctacctgacatcaaactatactacaaggctacagtaaccaaaacagcatggtactggtaccaaaacagagatatagaccaatggaacagaacagggccctcagaaataataccacacatctacaaccatctgatctttgacaaacctgacaaaaaccagaaatggggaagggattccctatttaataaatgctgttgggaaaactggctagccatatgtagaaagctgaaactggatcccttccttacaccttatacaaaaattaattcaagatggattaaagacatacatgttagacctaaaaccataaaaaccctagaagaaaacctagacaataccattcaggacataagcatgggcaaggacttcatgactaaaacaccaaaagcaatgacaacaaaagccaaaattgacaaatgggatctaattaaactcaagagcttctgcacagcaaaagaaactaccatcagagtgaacaggcaacctacagaataggagaaaatttttgcaatctacccatctgacaaagggctaatatccagaatctacaaagaactcaacaaatttacaagaaaaacaaacaaccccatcaacaagtaggcaaagtatatgaacagacacttctcaaaagaagacatttatgcagccaaaaaacacatgaaaaaatgctcatcatcactggccatcagagaaatgcaaatgaaaaccacaatgagataccatctcacaccagttagaatggcgatcattaaaaagtcaggaaacaacaggtgctggagaggatgtggagaaataggaatacttttacactgttggtgggactgtaaactagttcaaccattgtggaagacagtgtggcgagtcctcagggatctagaactagaaataccatttgacccagccatcccattactgggtatatacccaaaggattataaatcgtgctgctataaagacacatgcacatgtatgtttattgtggcactattcacaatagcaaagacttggaaccaacccaaatgtccaacaatgatagactggattaagaaaatgtggcacatacacaccatggaatactatgcagccataaaaaatgatgagtgcatgtcctttgtagggacatggatgaagctggaaaccatcattctcagcaaactatcgcaaggacagaaaccaaacactgcatgttctcactcataggtgggaattgaacaatgagtacacttggacacaggaagaggaacatcacacatgagggcctgttgtggggtggggggaggggggagggatagcattaggagatatacctaatgtaaatgatgagttaatgggtgcagcacaccaacatggcacatgtatacatatgtaacaaagctgcacgttgtgcacatgtaccctggaacttaaagtatagtaataaaaaaaaaaagaaaaaaaaagttgttggttaaatagtctctgctaaatttgcgacacatcttcccagataagattcttctctccgaacctttttttttttcctttttttttttacacagagtctcactctgccatccaggctggagtgtagtggctcgctgcaacttctgcctcccaggttcaagtgattctcctgcctcagcctcccaagtagctgggactacaggtgcatgccaccacgcccagctaatttttgtatttttaggagagacagtgtttcaccatgttgaccaggctggtctcgaactcctgacctcagttgatccacccaccttgacctcccaaagtgctaggattacgggcatgagccaccgcacctggcctctctgaacttttttaccagtatttattttaattttggttgggggcagtagagagatgcagaaaaggaaaggaaggcatgaaactgcttgagaaatacatcagtgaataaaagttttttaacatttgtggtgtaatgacaaatcctggagaagttttagttcacacctggagtattccagcagaagttggatgccagccgctaggcattcattctgcagaggggcttctctgttaggtacaaggttgggttcaagtaccttctgaagtctagctcagtgtattttttggagtgtagtatactaacaggcaagaacaagaagtggaggagatgtgccaggggaggaatagtgatgacgttgtaggtgctcagctcccagatgatgggaaaagtgtttcatggcctcacacatcttttgggttttttgttgactgtctcccccattactcaatgagctgctacagcatagggaatgaatcttcaacttgtatttccagtacccagaacagaggcttgtactaagaaggcattcaattggtatgtaatggattagaataagttgaattgaagattgaactgaagtcaaaatctgatttctaaggttccttctggcctgaaaattcagactcctctgatttcaaccataacagcctggctaagcctccttgagagaaaccctgtgcttccttagtttaaccacctctttgtggttgaatagtataggttttcaatcaagtcctaggagggtgtcagtttcttgttgtacttaccaggatgtgataggatttcaaacaaggcccaaaagaatgtattttcaggagttgagatgtagccacactttctacatttacaatggcctgaaatgggttacagtttagaacaagctttcttctttatgatgcacaggatttctatgatgggtggctgttaggcaatgagtgtgatgggggagcattttcaatcttagctcaccttagcacaccttagcacaggactctagttacagggtcataattccccatgaggttagcccctgtagtatcagctactttgtatgtgatttaagccagtactgattattctcctgcttagggagaagcggtagaaggcccttggaactgtgagttttgcattccaacttgctaattcaacatagatcctaattccttaaatgcttgtaattagaaattctcgtgaactgtattggtttttgtcaagcaatctgtttggggaacttgaccaactggggcactgctggctagggtgaaatttatttaatttgtttttatgacattcttcatcttggaaatggggttttcaaatattgctttcccaggcatcattacttatttgctggtttttatttcaggattgggactagctcagggtgccagggaagcgttttgtggtgctctatattagagtcgtaatatccaagaaaattgtctgattgtatgtggtatcttggatgtggtaccttatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaatctctgttcactttagaattcacattgaacatgagctgatccaattgctacagccttggcagtgatagaggcaggagacagccaaatccctaggcagatagggaaaggtccccggagaatctccgacctgccccacaagtgttgacaccagatgttttgtgcagataagggaacctgcacagggggcttgcctgggcatgcccacagcatactggaggcccactgggggaatgggatggagccactaggagttcacaccttatgcaggggtggagcctggcctcatcagttcttgtgtggtggccctggtattcaattgtgagggggaaacctgcttggaggacccctctccttactgagagctttcttttcacttaataaattctgccctcttcaccctttaatgtgtctgcatgcctaattcttcctagtcatgagacgagaacctggatttaactgagccagggagcagaaactcctgcatcagtagcaattttacaactgtttattaaggaatacatcttgcccgaggaggttttatattgtatccctcaaatggctattttcccctcctccgtttaaatatttttactcaagtggtttccttcttttggaatgccagtcaactccatctcctacttgatttccaagaccgtctcctccaagatgcctctcctgtctcccctttccatacaatagaatttatgggtttatcactgttagtaccaagggcttcatcatctgctctcttatgttccctgcttgtcaaggtgtagcttattgtagggttcaatgagctgctagccactgtcccatttgactagcagatgcttgagaaaagcaagtacacagtttggattcgatcctacagtgtcttacatagttcttggcacctgcatgtttgctctaggaacaaccttccttattataccgagctgatccttttgggcagcattcattgagtcaaatggcctgtgtgaaacggggtctgaccctaagtggacagagctgagaggttagagctgaaggactcaagccccagacttgctacagattagtagggtgacttccagttacttcagttttctgagtgtagtttcctcattttaagctttgtaaatattaatatctggcatacataatttgaaaaaatgctgtaaggattagaagaacgaatatacgtgcaaacctttaagaaattataagtgcaaacacacgtagtacatttccatttttagagcttcatttttttcttatctgtaaaatagacatgtaaatgcctacctttcttattgggttattgtgaggattaagtagaataacatatgtggaagtgcttagcaaataggaggtgtttaataaatgttgcctggatatgaattcccctctcgggactgtcctgatgtgaggcttttccagcccttgggggatgtgcatttaaatcaggctgcttgtaccttggattaggcaacttaaaaaaagtgtagccttgttagttccaacttctcagctataaaatgcagagtaattaaatttgctagtaaatgtttccaggcctttgaatggcagccaataaaaaggactaaatattattcttttagaattcatgtccttgatgtagaggaaatatcatatttacttacacatactcctgccttggctttttagaagaaaactaagaaaaatgttttcccctctacatttcccacttgaaggtgttatctgtattgaaacagcaatgacagctgccagcaaaggagtgtgatttttctttgccaaggtaaaccaagggttaacatcaaggagtgttggggcccctgctggtgggctggaaccagagctaattccttagcagtcactcactcttctgcctcttcagctgtctctcacccccctcccaccataaaggagtgggtgttccttcaggactgtgcactcgcctccctccctctatccctctttttcccacccacacatacttcccagaacctctccaccctgtggctgatttatctttcctgggaccaaaggcaataaagcctcaaaactaaaacttgcaaggaaagacaatcctaatggtaaacacctaacccgcaatgctgattacttgaaaataagctgttattctgtctccagatcacaaatagcctcacttaaagctctacccctgaaagaactactgaaagattcaggaaggtcaggagatccagattccaattaacttagcacctgatgcctgtgtaactctggatgggtctcagttctctagtagttgaggactggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacctgcattttggaagagaggtatttcaggatcttctcattactgaagcctctcattgtaggaccatggtcatttttaaatctcccacattgaaatgaccagttggcaaaaaccttcaattacaaaatctcttccaaagaggctgagttttttttttttcttggatcacttcacatccttttgaataccctgaggcagtatttttatgggctaacagcaaacagagtgtcgtgtagaaccaagtgtgtcccttcactttctccaccccctgcaaagtttgtgatcttcaaagcatgctggattttaaaataaaacatctacttctagtccaagcctttggctgtagactttgggcttaagtgtgtttttccacagaggtgttacatccccatttctatcagctaaggaaaatgaattcattcaaggtctcccctgccattcatcgaggctccccaagaggagctttccagaaagatctgtgccaattgtaaacttacaagatcctcagcccataacaaaatgcccagacaccttggctctgctgacacaggctgagagagataaaggaaacagctggctgaggtcctgacttttttttcacatttttttcactttttttttcacaaaggcccgctagcctttgcagactggggactttaagattgttcactacccatccagcagggctgggcatacagataccaaagctccatctccagagacgtgaactctaaccaaggatcctcaaaccacttaaatcatgaacctgaaccttgaaatgaagcaaacattacatttaaactcccatgtttaaaatcagtttgcccttttcgctcactctttactctgggggatgcataaacaccttgggtgcctgctgtgacaatcaagttggcaatacatgccacctgctggaaccatagtctccaatctgaactccttccccagctacctgtttcctgtcacaggccttggcattccctgtagcttcattgcttacctcatagaatcatgcttctcattagagagtattcaacagcttcttgtcactggggggtgcacttcatttcctctactcttggacttctgctctacttggacttcatactcttggctgtctctgaggtagaggcagagagaacatccctgactctctgctgcccattttctgccatgggccgccccccccttccagaggaggaggtgttggggaacctctcccacatggcagaacaaccactcaagtctggggaggtctttggcagtcatcttgggccagatgttgtgctagaccaagactgagctgggatttgggttttctattctcacatagccagttggaaagggtggaaacacatgtgggggtcccaaggaaccatgagagacttctcatcattactgcggagtttgactatgatctggcatcctgggctgttgtgtggaggtctctatcatgaccgacctctttggcttctcttgtgccctaaggaaggtgttttttttgctagttttgttttatgtttttagactgagtcttgctcttttgccaggctggagtgcagtggcatgatctccactcactgcaacctcggcctcccgggttcaagcaattctcctgcctcagcctcctgagtagctgggactacaggtgtgtgccaccacacccagctaattttcgtatttttagtagagacggggtttcaccatgttggccaggatggcctcaatctcttgacctcgtgatccgcctgcctcagcctcccaaagtgctgagattacaggagtgagccaccatgcccagccggaaggtgttttaaaattgaaacaaagttgcatagttggttgtgttaattgattcaaaatctttcttttttgcaggggcagctctaggccaaattcttcttgcaagtttttatggatcacatgtttgtctaaagtacacacagatcattcccaaggccagagcaggaatgctctggaagtgccctctctgatctagggcaagcctgtagtttcagggttatcgatagacctcgcggagggcagtgtacaaggcctctggctgcatgaagagaaatctggtgtgtgggactgctctcagaagcagagaggtgtagaaggctgtcaaatgcataaagacaatgtctcttcacttggaggacaatttgtctgccaaggggacggtgagatttggcttcatctcttaagaacctgcattgagggctgctcacaatttcacccgaggtccagggcaattctctcctctccagatcccatatctagtgcttgttgctgctcattcagtatatggatacttctattcttaacaagttcataagtttgtttaaccgatgactgctcatgtctttaaagccattcattcattcatccattcattctctccctcccttgtcaatcaacaaatgtgttttgaaattaagtctatgctggaatttagtgattaataagacccagatccaccaaactatgagcttcctaagagcagggagtgcatatttcatttatgcatacacagtgctgggcatatgatttccataaatatgaatggatgcttcaggcaaatgcactttaatgaagtttgccacagaggcatctaattctcaaaccaaatgctggtattttaatatcttttcataaccagaggtctgagggcatgggaaaattgctgggaaggagggctctggaataacatgatattaagatagatgcatgagtgatgacccaaagcttcttgttgtcacccatagaataacttagtttcctgtcttccctggaagaaatgtaagaggatgtgtggggctagaaagagcaacaagcttatatcacccatatagtagaaaaggagtgagtggagcatcgagcctgatcctgtgcatttacagtagcagtaatagagtaaaacagagcaattagtgcctcatgtagacttggcattgagcaccccatcgcaaaatagccatgttacatatttcagtgtttaccagtgacaacgttttcctcttctttatgatttttggttcctgagatgtttaactggccttaatgcagttttgagagattgcaggaagtgatgggctgggttgggaatggctgggcattcaagtgatttagccatgggactcagcagtgcattgcttttactcctgaaggactcttggaagaaagctctgggcctctgcagagctttgatcagcttgttcagaaagagagcgttttatcgattttatcatggttacctttttttattgttaaaagtgtctatgttgtaaggcctctttgtgtgataaaattctgaaatgatctcacattgatttattttttcctgctttcaaaacacagcaatcttggtagtttcttagtatcccaaagggataaggagtcagcttctcaataaaccttttctggttatgaacactgtatgtattaaataataagcaagccttacagagtttatatgatcacattaagggatctgttaaattccaagagttattgttatgtgtgcaaaatactacagaagcacttgattttgttccagaagcactctgctgggaatgagtgcatattggttctagtgactctgccagtaattagctgtgacctttggtaagtcacttctcctccattccctcttgcatcctgatctgtaaaacgaggagtctcttagtcccttctaagtccctcaccagctttaacattctgaggcttaaaaaagctcataggagacaggctgttctttgcaatattttccatacaggtagtataaacaagtggagaggtaattgaaagactgactttcaaaatctagtacaaggaccttatttatatgggattttaaactgatatcttgagtcggactatgaatgactacgactatcaatcagttatctgcaccaataaaggacaaccgatgtgaatcatttggagatcttcctactcccagtagatgcaggtttcgtgccccagaataatactggaatgtgctcatgtctttagcacataccaactaatcttggtgagaagtgaccccctaaaaaggtgttggaaggcaagggaacacagtggctagagcttaacacatttgttggaaagaagagcatttttacactgctgacaatatgaggactatttgttttcttattttattattatacttttaagtattaagatacatgtgcggaacgttcaggtttgttacatatgtatacacatgccatggtggtttgctgcacttatcaacccgtcatctacattagatatttctcctaataatatccctcccctagcccctcactcccccaacaggcccccgtgagttatgttcccctccctgagtccatgagttctcattgttcacctcccatttatgagtgagaatatgtggtgtttggttttctgttcctgtgttagttcgctgagaatgatggtttccaacttcatccatgtccctgcaaagaacatgaaatcatcctttttctggctgcatagtattccatggtgtatatgtgccacattttctttatccagtctgtcattgatgggcatttgggttggttccaaaactttgctattgtgaacagtgctgcaataaacatacgtgtgcatgtgtctttatagtagaatgatttattaccctttgggtatatacccagtaatgggattgctgggtcaaatggtatttctggttctagatccttgaggaattgccacactgtcttccacaatggttgaactaatttacactcccaccaacagtgcagtgtaaaagcattcctatttctccacatcctctccagcatctgttgtttcctgacgttttaatgatcaccattctaactgggcatgagatagtatctcgttgtggttttgatttgcatttctctaatgaccactgatgatgagctttttttcatatgtttgttggccacataaatgtcttctttggagaagtgtttgttcatatccttcacccactttttgatggggttgtttgtttttttcttgtaaatttaagttccttgtagattctggatattggccctttgtcagatgggtagattgcaaaaattttctcccaatctgtaggttgcctgtaggttgcctgttcactctgatgatagttttttttttgctgtgcacagctgtttagtttaattagattccgtttgtccattttggcttttgttgcagttgctttcggtcttttagtcatgaagtctttgcccatgccaatgcctgaatggtattgcctaggttttcttctagggattttatggttttaggtcttatgtttaagtctttaatccatcttgagttaatttttgtataaggtgtaaggaaggggcccagtttcagttttctgcatgtggctagctgttttcccaataccatttattaaataggaaatcctttccccattgcttgtttttgatagttttgtcaaaatcagatggctgtagatgtgtggtattatttctgaggcctctgttctgttccattggtcaatttatctgttttggtaccagtactatgctgttttggttactctagccttatagtatagtttgaagtcaggtagcgtgatgcctccagctttgttctttttgcttaggattgtcttggctacatgggctctttttttgttccatatgaacttgaaagtagttttttccaattctgtgaagaaagccaatggtagcttgatggggatagcattgaatctataaattacttcgggcagtatggccattttcatgatattcattcttcctatccatgaaaattgaatatttttccatttgtttgtgtcctctcttatttccttgaacagtggtttgtagttctccttgaagaggtccttcacatcccttataagttggattcctaggtattttattctctttgtagcaattgtgaatgggagttcactcatgatttggctctctgcttgtctattattggtgtataggaatgcttgtgatttttacacattgattttgtatcctgagactttgctgaagttgtttattagcttaaggagattttgggctgagacgatggggttttctagatatacaatcatgtcatctgcaaacagagacaattcgacttcctctcttcctatttgaataccctttatttctttctcttgcctgatttccctggccagaacttccaatactatgttgaatagaagtgttgagagagggcatccttgtcttgtgccagttttcagagggaatccttccagcttttgcccattcattatgatattggctgtgggtttgtactaaatagctcttgttattttgagatacattccatcaatacctagtttattgagagtttttagcatgaaggcatgttgaattttatcaaaggccttttctgcatgtattgagataatcatgtggtttttgtcattggttctctttttgtgatggattacgtttattgatttgcatatgttgaaccagccttgcttcccaggaatgaagctgacttgatcatggtggataagctttttgatgtgctgctggattcggtttgccagtatttcattgaggattttcacgtcaatgttcataaaggatattggcctgaaattttctttttttgttgtgtctctgccaggttttggtatcaggttgatgctggcctcataaaatgagttagggaggcgtccctctttttctattgattggaatagtttcagaaggaatagtaccagctcttctttgtacctctggtagaattcagctgtgaacccatctggtccttcgttggtaggctattactgcctcaatttcagaacttgttattggcctattcagggatttgacttcttcctggtttactcttgggagggtgtatgtgtccaggaatttacccatttcttctagattttctagtttatttgcatagaggtgtttatagtattctctgatggtagtttgtatttctttgggatccgtgatgatatcccattgatcattttattgtgtctatttgattcttctctcttttcttctttattagtctggctagccttctatctattttgttagtctttaaaaaaaaaatacctcctggattcattgattttttgaagggtttttcgtctctctatctccttcagttctgctctgatgttagttatttcttgtcttctgctaggttttgaatttgtttgctcttgcttctctagttctgttaattgtgatgttagggtgtctattttagatctttcccagtttctcctgtgggcatttagtgctataaatttccttctaaacactgctttagctgtgtcccagagattctggtatgtagtgtctttgttctcgtcggtttcaaagaacttatttatttctgccttaatttcgttatttactcagtagtcattcaggagcaggttgtttagtttccatgtagtcatgaggttttgagtaaggttcttaatcctgaattctaatttgattgcactgtggtctgagagactgtttgttatgatttctgttcttttgcatttgctgaggaatgttttacttccaattatgtggtcagttttagaataagtgccatgtggtgctgagaagaatgtatattctgttgatttggggtggagaattctgtagatgtctgttaggtccacttggtccagagctgagctcaagtcctgaatatccttgataattttttgtcttgctgatctaatattgacagtgaggtgttaaagtctcccactattattgtgttggagtctaagtttcttcataggtctctaagaacttgctatatgaatctgggtgctcatgtactgggtacacgtatatttaggatagttagctcttcttgttgcattgatccctttatcattatgtaatgcccttctttgtctttttgatctttgttggtttaaagtctgtttcatctgagactaggattgcaaccctttctttgttttactttccatttacttggtaaacctttctccatccctttattttgagcctatttgtgtctttgcacatgagatgggactcctgaatacagcacactgatgggtcttgactctttatccaatttgccagtctttgtcttttaattagggcatttagcccatttacatttaaggttaatattgttatgtgtgaatttgatcctttcattatgatgctagctggttatttttcctgttagttgatgcagtttcttcatagtgtcgatggtctttacaattttgtatgtttttgcagtgactggtactggttattcctttccatgttagtgcttccttcaggcgctgttgtaaggcagcctattggtgacaaaatctctcagcatttgctcgtctgtaaaggattttatttctcctttgcttatgaagctcagtttcgctggatatgaaattctgggttgaaaattgttttcttataatcaatagcttaccaaccaaaaacagttcaggaccagatggattcacagccgaattctaccagaggtacaaggaggaactggtaccattccttctgaaactattccaatcagtagaaaaagagggaatcctccctaactcattctatgaggccagcgtcatcctgataccaaagccgggcaaagacacaacgaaaaaagagaattttagaccaatatccttgatgaacattgatgcaaaaatcctcaataaaatactggcaaaccgaatccagcagcacatcaaaaagcttatccaccatgatcaagtgggcttcatccctggtatgcaaggctggttcaatatatgcaaatcaataaatgtaatccagcatataaacagaagcaaagacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatgtccttaagctcataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgctatctacaactatctgatctttgacaaacctcagaaaaacaaacaatggggaaaggattccctatttaataaatggtgctgggaaaactggctagccttatgtagaaagatgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaactgcaacaaaagccaaaattgacaaatgggatctaattaaactcaagagcttctgcacagaaaaagaaattaccatcagagtgaacaggcaacctacaaaatgggagaaaattttcgcaacctgctcatctgacaaagggctaatatccagaatctacaatgaactcaaacaaatttacaagaaaaaaaacaaacaaccccatcaaaaagtgggcgaaggacatgaacagacacttctcaaaagaagacatttatccagccaaaaaacacatgaaataatgctcaccatcactggccatcagagaaatgccaatcaaaaccacaatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggataaagaaaatgtggcacatatacaccatggaatactatgcagccataaaaaatgatgagttcatgtcctttgtagggacatggatgaaattggaaatcatcattctcagtaaactaccgcaaaaacagaaaaccaaacaccgcatattctcactcataggtgggaattgaacaatgagatcacgtggacacaggaaggggaacatcacactctggggactgttgtggggtggggggaggggggagggatagcattgggagatatacctcatgctggatgacgagttagtgggtgcagcgcaccagcatgacacatgtatacatatgtaagtaagctgcacatggtgcacatgtaccctaaaatttaaagtataataataataaaaaaaattgttttctttaagaatgttgaatattggcccccattctcttctggcttgtagggtttctgcagagagatctgctgttagtctgatgggcttccgttgatgggtaacgcgacctttctttctggctgcccttaacatttttttccttcatttcaaccttggtgaatctgatgattacgtgtcttagggttgctcttctggaggtgtatctttgtggtgttctctgtatttcctcaatttgaatgttggcctgtcttgctaggtcggggacgttctcctggaaaatatcctgaagagtgttttacaacttggttccattcttcccatcaatttcaagtacaccgatcaagtgtaggtttggtcttttcacatagtcccatatttcttggaggttttgtttgttccttttcattcttttctttttttttccaatcttgtcttcacactttatttcattaagttgattttcaatctctgatatcctttcttctgcttgatcaatttggctgtttatacttgtgtatccttcgtgaagttctcatgctgtgttttcagctccatcaggtcatttatgttcttctccaaactggttattctagttagcaattcctctaaccttttttcaaggttcttagtttccttgtgttgggttagaatgtgctcctttagcttgaaggagtttgttattacccaccttctgaagcctacttctgtcaattcgtccatgtcattctccttccatttttgttcccttgctcgcgaggagttgtgatcctttggaggtgaagaggcgtgctggtttttggaattttcagccgttttgtgatggtttttcctcatcttcatgaatttatctacctttggtctttgatgttggtgagcttcatatggggtttctctgtggatgtcctttttgttgatgttgatgctattcttttctgtttgttagttttccttctgacagtcaggcccctctgctgcaggcctgctggagtttgctggaggtccagtccagaccctgtttgcctgggtatcatcagcggaggctgcagaacagcaaagattgctgcccgttcattcttgagtaatgtttagcaggcatagtaagccttcttcaatatttaattgtctgcatactgatggatatttttagggatgaagataagtggttcttgtttgcagtggatacgatgcttatgaggaaagaagagctctttttaaatagagtctcttgggtagaaactcccttgattaagttcctgaagtcttttactttgctgatcctcaattcagtttcatcagctcacccagagtttatcaaactttggaggaatgattttaagaaccaaatatggccagatgcagtggctcatgcctataatccgagcagtttgggaggccaaggcaggaggatcacttgaggcaaggagtttgagaccagcctgggcaacacagtgaaaccccgtctcaaaaaaaaaaaaaaaattaagttagctgggtgtgtcactgtgcgcctgcagtcccagctactcgggaggctgagttgggaggatcacttaagcccaggaattgggggctgcagtgagccatgattgtgccactgcccttgagcctgggcaacagcgtgagactctgtctctttaaataaataaatatgtaataaaagtggaaaaaacaggcaaatgtataagtcactgatctataactctaacgtgatagtttgtttatttactaattatattgccaactgacactgattgctcagacccttaagaggcactcttgtgtgaggatttcactcaagacaccaaattacagacagtgaatgttccatggagaacagagttgaaatacttccatgcatattgtctctgagaaaaccacctcttttccaggagaggttgttctgcagagggtgccagatcccaatcctgaagaatccaaacaccttttgaaattgtattctggggctgaggccctgcttgttcaccttgatcagacaggtgaatttcctcagcttcctcagccattgatttctaaatgatctcttactttgaggtgcagataagctttcttgatgtagatcctttccattttccttgtaggtacttcgtggttcaaactttcactactgcaactacggttaccataaagtgattactatgtgctagattgtgtactaagtgctttccatgaaatatttagttgtcacggcaaccctacacaggtctggccaataaacatttctgcaatgatggaaatgttttataatactagcaccacctaactctggtagccattaacacatgtgaatattgagcattgaaaatgtttctagtgtgactaagaaactaaagttttaattttgtttagttttgattaattaaaatgtaaatagctagtgtggccagtagctatggtattgacatgatgcagatacaagtactttgattctcatattacatgtagagaagctacagttcaaagaaattaaataattttctcaaggtcacagaacttgcaaatggcagagcaaggatttgattttgaagtcagtgtccttatccctatagtgtatggccactatttagactgtgcctgctctttttgtatccaaatttgttaagaaacacctctggtacatttgcaattaaccattgaaagaaataaaactgataattatacaataaaggacaacagtcattaaaacagcactaccctggtcccaaaatagaagtatggctaatggaacagaagaaaaaatgtacaggtatgaaaatagatgttcttgtgttatatttatattcttatattactgtgatgaactgagcatcacaaaagaataagaaaggaagagctatttaactaatgacttgggaaaaactggttatcaattaaacattcataagctcccaacctagtatattgtatgaaaatatatttcaaatggcataagattcaattattaaagaacaaacttgtttaaaaaatcaaatcacaagaaacagcagaaaattcatttaagaaaccatctgttccatggtaagttctgaagaaatcatgaaggaaaaaattacagatttgactgcttaagaaataaagactaatgaacaataaaaatatacatagaataaaaaggataacagatttggggaatatttgcaacgaataagaaagacaagggtgataattacattatcaataagaaaaccttaagatacccgggaaagttaatggaaaagaacgtgaacagacagttcacacaccagggaatataactagtgattgagcttatggggaatagttgaattagggcttttcaaagaggtacaaattaagtgatgacaagatagcatcttatgccttttgaattagcaaacatttaagaaaatagtaattctttgtgttgaagataaggcagaaaactgctgtatatgctgcctgcggcagctaaaattactctgatttaggaagcaaatttgatgaagtaatcaagaaccataaaaatgttcattcagtctgacttaataatccgcccctgaaaatttatctgagaaaaaaatcctaaggaaaattcacctccttttaccatcaaacctttaaagtagaggaaaggccatatattaaataatgtgaagattttaatttatagagttagccctaataaggaaaggaagggaagcaatctaaaatgctgagtcattggtgaaggccattaaatatattatgacacatatactctgtagaatattatgcatctgttaaagtgataattatggccactgtgtagcaacatggaaaatgtttataatggcaaacgaaaaacagcaggatacacatttgtatcttgtctaaaatttcaatcctgtcgaaagatacacatgagggccaggtggtggctcatgcctgtaatcccagcacttagggaggccaaggcaggcagatcacttgaggtcaggagttcaagaccagcctggccaacatggtgaaaccccttctctactaaaaaaatacaaaaattagctgggtgtggtggcatactatgactgtaatcccagctacttgcgaggctgaggcaggaaaatcacttgaacctgtgaaatggaggttgtggtgagccgagattgcaccactgcactccagcctgggtgacacagcaagactccatgtccaaaaaaaaaaaaaaaaaaaaaaaaaaagatacacatgcctaaggacccagactggaagggaactcaaggcaaacaaaaacagttggtatgttagggtcatgggacttgtttttatttttatttacctttgtcctattttctcaataaactcaaactagaaatggaaacacagtcacagaaatgaaggatattcataaagcattgtttcctgttggaagctgccttttattctcctttgccctcagacatgtactcctcattttgatgagcagcaagtgatcagaattatccagccttcagtcaaacataatctgtagaagaaagcactgctttatgcaaggagatttactgtgtgatggttggcaaaagaaaggatgcacaaagactctgtgtgggcagatttagcagaggtactgaaagtgaaaggagaggccatctggtagaatgtgctgtggcaaattaaactgagttttatgaacatgaaataccagaagaaaatccaaatgccctggacttggaaaaagcccatctgaggcaccataaaaccaatcaactacagactgacaatatgccactcataagctcagatatgcccattactagggacagcatcattcaagccagattttgcagagctcatttgatgtggatttcccgtaggggaaaaaatcaacaaattacccaccgtgtcccccacacatgcgcagatgcctgatacagagctactgtttcaataaatatggtaaatgcataatgatctggaaggcattggtttggcttctcctgcctcacattcattagtgaactctgacacccaaaccagacaactagacttgggtatggatataaggagccatttttccctccctccctccctcctttccctgcttgcctttctcttttccctcccaattattttcattctttcctctcccctccctccatctctccctccttctctcccttccttccctctgtccctccctccctcacttccttccttctttccttcctttgtttctctctccctcccttcctccctcccttccttcctttctttctcgctccctcccttcctccctcccttcctgccttcttttcttcattctttctttcctgtccctccctccctccctcttcctcccttccttccttccctccttcctctgactctctccttccctccctttctttcctcccctcctcttttcttttcttcttttcctaagcagttcatatccctatcctttagcctgtatgtctggaattctttatagttccactacacttgccccctcattttgtcctaatgttcctccaattctccatttcctctttatttttactctggggctctttcgagtgcatgtatcctgcatattcagctacttctgcttttcctcacctttaatgctttgattgcttccattagagtgttgataattctgtcatgatccttgtctgtatatagttcttccttatatttcaagtccctttatgatagctctgctacaagtgtgttttcaatggcactgtagttctgctgtggctttggggctgctttggttttctttggaaggagatagctacatgggtagcttgattgaggaagggcacaaaagcagtctaagtgtttgaaggactgtctctgggaagaggagcttagctattcccatgtggctagaaagggcacaacaaatcccactgggaggtgtacttagactctgtaaaaggaagcacattctaatatagcaggtcaaagactgaatgggctatttccagggccgacatatctgggtgttcagtttgtgcattgtacaaagacacctggccgagaaaatgaatgggagctgaaatgcagcccgtgctttgctcactaagccctgtgctctggagtgaggccatgccgacctagaagaacgggtgccaagataagttaccttttgatattccacataaagacaccagtatgtgctagtggtagccctagctatcccaggaggggatattgtctactgttgcagaacaagggagagaatagatgaacttgtgtgctagaggaagtgcttgcctcttctccaccatctccacatttcctggatgtgctttgattctattgcactgccaaacaatccctttttctaaacttgtctgtgccaatcttgtgtcttcttatctcacatatgctaacaacatccacattaagactctcaacttccccgagatggataggtgccatcacataccgtgctggattgaattctcatttcagagaatacatcttctttctacttttcaatgaggatcagcatcccattcttgcccaccacctagtactttgttaggaacacaggaggtaaggcaaactgaaagcactttgaaaactgtgaagaattttttcatcaatatcattagacaagatcctgttacaccaggaagtcaagaggctttactggcatttagtgcctcttgtttcaccatcaagattccctgtctacaacagttcatagctgagtctctattcatcaaactttctgcagggttgacatacacaccatttatttggctctcagtgtataacatttggtggtgagtcaccctttcctgtgtacatcttgtttaccccagatagactgtaagctcctggaccaattcaggaaaccacatactggtttcctggtatggaaaggaaatgttttatttcagaaagtcacttctctccatgagcaaagaacagtgagggtcattttaaactgttgtagctgaattccaaatggcaactgagatggtcccaagatttgggccatgtcaatttagggagtaggtaattaaaggcagtccaacaatttcacaaatttatagttaggtgccatgccgtgcactgtcttggaattcctcacaaggacattgtgtaatgtatactttttgaattcaattgaatttatccttccttccacctttcctcccttccttcaacaaatattcattgagactgtactatgtttcagtctttgttccaatgaacctaaacagacaaaagtctgtgccgtcatggaactttctattcttgtccagatctgccatttactagttgtgtgtagactcaaccaaatcacttccttctccggaccaagtgtgttcttctgtgtacactgaaggtttcacagatgtttccatttttccttcctattattttttctttaatcaacctccgtacttttaattgctttcttggttatctatttttgcctaatatccagtactgtaaggaaaataacaaggatgtactttttcttttcttttttttttctttttttttttgagacagagtctcactctgtcgcccaggctggagtgcagtggcgtgataacggctcactgcaacctctgcctcctgggttcaagcaattctccttcctcagcctcctgagtagctgggattacaggcgcccgccaccacacccagctaatttttgtatttttagtagaggcggggtttcaccatgttggtcaggttgatctcgaacccttgacctcgtgatccacccgccttggcctcccaaagtgctgggattacaggcgtgagccaccgcgcccggccgaggatgccctttttcaatggttcacctttgggtatttttatatctatgtttgcctagatcattcctttgttttgatatcatcaatttgtttagcccaaagataatggctgttgtatttccgtcttgagtgccaagctcacaatgagctgttactcagtttttgaagtattttctcccattataacatcaaccttctttcatttatttcctttagtcctctgtcctgagagcatcccccagagttatagccttggattctcaagctgcaggagattgcatgtttaaccatgataaatactcaggacaaaattgagcctttttttctctcataattttatttgtttaaatcttgactgcttatagtaaatatcctctcaaagataatttcatttccaaacaatttggtacctgatctgacgcagcttgagtgtttattttggggatgttgtttttcttttttaatgagttccccaaaatagcttttattgtttttacatctttcttttttttccccgggctatcagagggattgtagttagcattgctggaggattattagtttattaataataattatctcttaaatttcttttttggaagcagcatttggtcattattgaaaaaacagagcttttaaaaaatggaatgactttaaggaatctgaagaaaagataaatgtactcctgtatgatttttatagtgtttgcaatccagtgatcattctcacattgtttaagtttcagtttcaaggtgcgttgtccccctttatctgtggggaatgtgttccaagacccccggcggatgcctgaaaccctatatatactatgttctttcctacacatacttacctatgataaagtttaacttataaattaggcacagtaagattaacaacgacaacaataaaatagaacaattataataatatgctgtaataaaaattatatgaatgtagtctttttctctcagaatatcttatactgtgatcacgtatttcctgactgtgagtgaccatggctcactgaaaattgaaagtgaaaccacagataagggtggggactatgatagtaaggtaagattggtattaatatattgtctgagcaaggcaactaaatgtgttccttttggaatgcatactgttacaattcaggtttaattattaaacagcattggtctaagtggatgaaggttctgttttcgacccataatttaacacatgtcaagtttaaatgtacacagtaactcaaaaaacggcctgcctttggttgttgtttccaggatactgtgagcattgcaattagcaataaggaaagcactgaccaactcccggaaccacatctagttgcctggcatggaaaggaaatgcttttattttagaaagtcacttctctgcatgagcaaggaacagcgagagtcattttaaactattgtagttgaattccaaatggcaactgaggtggtcccaagatttgggccatgccaatgtagggagtagaggattaaacacagtccaacagttttacaaatttctagttggtgggtggctgggaactgtttattattgttaatgttactgaaaaatcacttgtttcgtgttaatacatcatcccttctccagtcctccagccccagtgaattttgtgttgatatagcaatgtgttcatagtgccactttactgaatcagttgttaaacaaatatttgtgccatacctactattttacagacattatgtcaggcactggggaatttatgttggtgaataaatagacatggttcctgctctcatgaaacttaaaatctggtctttttaagcaagctatttcacttttctgagagtcagtttcattatcttaaaataggcataatgcctatctggaaggattgtggtgagaataaaatgagactatgtctataaagcactggtgtgatgtttggcacatagaacatggtagaacctcaacaaatgatggctcttataatcattgtgagtgctggagagccccagtgctggtctatggattgaagagctatcgaagaggttcttgctgaaggttcaccccttggagtatctctactcaatccactgagtgggaagatttgaaggtaacaggctacgggggttgaacttttcccacatggacattttaaactcagttcaaatacatttgaatgagagagcaaagtacattaagcacagaatttctagaactcaccttgggaaatttaaagctgaccattttctctagcattttggaaattatcaaaaggccagacggaatgcacaattcacttcttggctgccaggagtgaaggagagaagaggtgaggttgaatgatttgaaattcagttcgtctgtgttagaacaagtcaaaacaattctagctgttaattttagttagttgagtccagagtaaaggtttgtaaagggcataagaaagcaacattacttttttctcacaatgagcacttaaaagatcttttaaaagtgtttctgtaatgtaaaagaaatagtcttactgcagtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgattcacttacaatcataatgtagggcttgatgtaaaacatgagaagacttgatgtttctgggtaacaatgggtgcagctcttgattattcatagtctgattatccttactggggagtatcctgtctcattttacttcttgttgtctgaatgcctaccttttacctttgtaaactccagatttaaagtttgtgtagggtggggtgcggtggctgacgcctgtaatctcagcactttgggaggctgaggcaggaggatcgcttgagcccaggaattcaagacaagcctgggcaacaaagcaagagaccatctctaaaaaaaaagaaaaaaaaaaaaaagccaggcaccctagcacacgcctgtagtcccagctactcaggaagctgattcaggaggattgcttgagcccaggagttggaggttgcagtgagctatgattgcatcactgcactccagtctgggtgacacagcaggagacactgtctcaaaacaagaacaaaaacaaattttgtttaaaactgaaaatggggggatagatggaaactattttactttttatcttaacagcttgtgcaggtagaacagtttaatgaggaaggagctgacactcttgcctatggtgtgttgggagattatagattttagttatccatgtttatgttgtaccccaggactacagattattggcagctggctataaacaaatgaccaaataaatctacagttgaagttacctagtgtctccaagatttcagggatgatcaaggacaggtagcagagcctggggccatcagctgtgtgttggcctcatctcattctgaacccctctcctactttaatcagaaccctgatacttaagggactgaactagctgtgacatccatttatccattttatagaatggctgtaggtaactacagggccataatcggaattctatacagggatgggtccctaggctcattaattgatgacagggtaggagaagactttgacacctacagattcattagagacagctgaatggatttattccaaggaggtcacctttgaaaacgcaatgaatttctatgggtggataacaatgcaaataggcaaggatgaagctttagatttaatctacatctgctgcaacaatgttctgatatagaattgtttagcccaagtcctaattgaaaaggtgagtaacattgatattgtctttctgaaatggattagaaatagggctggaaattggatgctaggaagagggacatataaggtttatgaggtaaaccccaataaatggaatttactatgattatattaaaaatagagacaatgtcatgtttatacagcgtgtaatatcatgcataatgtcaaatgccctttggagttactcctgtcccttgtactgataacatggcagttttttgagtcctagcatagggaaacagtgaaaatttccaggagtgcatcttttcaataatgcaaaggatacatatcagtgtttcacaaatttctctcttttttttaagagacagggtctcactctgttgcccaggctggagggcagtggtgcaatcagctcactgcagccttgaactcctgggctcaagcgatcctccctcctcagcctctggaatatttaaaactacaggcgtgcatcaccacacccagctaagttttaaagttttttgtagagacacggtcttgctgtgttgcccagactggtctggaactcctggcctcaagctattctttctccttagcctcccaaagtgctgggataatgggtgtgagccaccctgcctggcctcacaaccttttgaaaaagatcatcccctaaggaggaaattcaatttaaataatcctaatgagagaacttaaatactaaggaaaaagatttaggggaggaggattggatgtgaagggccacaatctactgtaatatctttttttttcactttccccccaaatcaattttcttccccttatggacaatatcacccttgttggaaatgcatgatatagatctgtgaagccagccaatttatgatgtgatatttaaattgtctctggttatggatattgtttccattgcccacattaaccctcaagaggagggcagtaatgccaattaagttcttgctatgtgttagatcctttccatgcattgtttaatttcacccttacaacaaccctgaagttgagaagttaagcgactttcccagactcatacagtggcaagtcaggggttgaacccaggcctttctgatgccagagactagaatatttctaacacttacttatcttacgggaggcattacaagatgtgtcttacatagaaaggacataatggtgggtgtttatttctgaagttgattttggagtctctggattgcattttggttaccctcaggtagaatagaaaagagaaacttgattaatactaaattttctcttttattctctccacccctctttaatggtttgtattgtgtttcttagtattatgtggaaataaccttagcttcttgatatgtgctgagatcctaggaactcagtgacttacagcacaggttggataaggttaatattatgttaataacacagattttatagctcttctactaatctttacatagattaatgcctctcaattttacaaaaaatagaccattaattgtgaagctggaagaggacaattcatggcagaaaatgttaggttagtagaacaatagtcatttacacaggattgttaaagaaagggaaaggtaaactgatgttcaacatctagtgcttgagaagttgctctgcacataaaatcaaaccaggcagctttgacctagctcttgggagagaatatatcaggttgtattgatgatgcattgatgagaatacatcagtgtgtatgatgtgggagcgtgtgtgtgtgtgtgtgtagatgtagaaaatagcattttcttatctggactttagacttcatagttaaagtaaattatgttcatacatctgtatgtgtagacttcctacctgtgctttaacgcctctatctccacctccatccctttcttctgtctccccagggggcaatggtgcaagtaaaccaaattcgaaatgcttggtcccagtgttgttagcagctgattcataggtgctcccctcattttagataagaagaaattgagatttgcaaaagtcacacaaactggagctcagattgcctgatttgtactggtatattgcactgtctgtcggccttcactctttctgactctctgcttcttagaaaaagagagtgtgggaaaatgtgctggcaccttcatctggtggccagagaccaattctaggccagaggtaagctttaaagagaataaaaagtgaggaaaattggctcaccagagcacgtcattatttacataataatacattgactacgatgtgggctttaaaagaaaaagaaaatgaaagtctttctcacaaaatactctaaaaataaactttttagggaacattataaaaccatacaatgtattttttcccaaacacaaagtcccactgaaatctgtctcttggttttttagatgccaaaagtcaactcatcttgatgtagaaaatgaggaggtgctgttagtgcatggagaaatagccttctgctaagaggtagttgacttagtttctaacttatgttttcgtttcatgctatgtgatcttggtcaaatcattttgcctctctggactttgatatccttttctgcaaaataaaagggttcaactggatgattttgaaagcacctctctcttctataagtctctgcaagtgggaagatgattagtttgtagtcttataatgtttagatggtttaacactgctatcttctagcttttctaaaagttttctgatgttgtcataggcagttttgtgtacaaaggtcatttgatggatgctaatgtacctttggttgataggaggttcgtaaaagaaatatgcatcaaaccttattattcgtgtattagataaagcagatctactgacattttaatgtcaccaagtaagtaatttataaagtcagtgtgccccactgaaacatttccaaagatatttactattgagtacttgggttctgctgagggtgaatactgaaatgtattctttttgtgctaatgtttgcagtacagtgtttcccagcagtcagaatgattgtctgatattgttagtgtaacccctgtgatctaacataggcttctgtgattataatgatttttatttgaaaaggtaattgtgtttgcctggcaacctccccacttgattttttttctgtatacacctctttctttggctctttaaaagccagcagtagagtatgtgtagttaaaataccttcttcttcttgcatccacgtttttgactgtgtctttgcattgccattggggggactggagagttaatatgctgtgttgcctaaaggaataaaagcaaaaattatctttgcaatcaaaatattaccagaaagaatttattaaaaattacaacagagagaaaaacggacattaaaaagagatttttatctttgtttgctttttgttttattggcttgccgagctttatcagtcattaatgatgaaggaaatagaagacctctccaaacctatgcatttgaattttgtccagttatcaagctttcccctgtgcacacccaattttttttactagctcaaggacaaagagatttttctcattttcccattttaagataagctatataggaatctgggtacatttgagtatgtgaggaaagatcaaggactctgtaagcatgcatctttccaatcatggcccttttagcaatttgcagtcattggaatgtgggagtttagggagagtgctgtttccagagttagacacttcggtaattccactactttagggtttcctgccacatgctgttggctttcagtaacaagtttcagtaaggattctcttggagtatgcatagaattttcttaacaatctgtgagtgattataagcagtatattctgggctcttgtgttttcgggagttaagagacctctcttttgcagtccccaagagtccatggcgctcatctatgaaaacggcccaagtgacagccagatgaatgtgtgctgagcgccactgaggctaagtgccaggaaagtagaaggcaccaccctgtggaagagggccaggaattctagaggacactactcctttgaacaaaaaggatgtggaaaacagttttctttgtttccttttgagttagctttgggcatgggctgatgccaagcttcgtcctatgacaggctcattgccatccatcctacccaggagggatgcatctctgagcatggagacagtgctgaggaaggcaggttggatggtgcttccttatctgattatcagacaagccatattttttcaaaggaacagtgagaacagatgatctttctgatctcgtgttaaatacagtactgggcatctttagcatatgtgctttaggttattgccttcttagcctgctcagaaaaaaaacacagcactggcagcattccgtttacttactcattagaatctaagggctggaagatcccttgaaagtcatctactccaccacccacccccatctgatgcaccagctgtttctacaaccaagtcgttatccttgcctatgcatgatgttctcaaagacacggcattagaacaccttccattgattgagttgaaatctttttcccattgctgtcatgcactgatgctagctgggcttcttggaaccatacaaaacaagtctaatgttcttctctatgccagcccttcggagctttatgtcacattccagtctcacccttcctttccatctcagctgcagtaaggttgattaacctgaattaaggaagacttgagggtggggtgagaagttgcacatctgttcctctgataacatggatttgattctccctctcccttttggtccctctgatagaaataggctctagttcttccatattcctcttaacaatgttcagatgtggtctcactagtgttgatgatctccgtctttatacttaactttgattcagcagtggagtccaagattctgttagttcttttggtgatctcaccatactagagattcctattcaacttgtacttgataaaaattttattattgtctgtgcttcctctaagccactggtgctcaaccggggtgatactgtcatcccccacaacgtccccaggacatttggcaatgtctggagacaattttgatttttatggcttgggggatggtatactactggcatctaatgggtagagtccagagatactgctaaccatccaacaaggatgcacaaaacagccccccatgacaaagaattatccagcccagaatgttaatagcatcaaggttacagaaccctgcttcaagccacttgtgtccatattccttccaaattttttctctgtactgtgaaggtagctttgttgactcaagtcaggatcttttgcttattcctatttaatttcatctggttagaaatcatacagctgtagtgtttcaagaccttcttggacttgatatatatcatcaacgaacatatctgcagtacctccagcttcatgcatgaacccctcttgcttctgatggactattaataccaaattcagggaactctcctcttaaccaaaagcaaattgttttcctagactggcatgggattccatggcaggtggactgatgatcattaggaggtgctgtgctcagttttttttcttttttacatttttggtactcccagacttccttagtagagagctggtgtgatctagaatggcatttgtatcttctcccacccaattagattagcaagagagagtttagccaagcaccactgctctgcaaatggagtctccaaatgccacatcagcagaaagaaaagtatctacactcataagagcatggggtagggggaaacaaggatgcataggttgttgcttggcaaatccattcactcctagcactgttccagtgatattagttccacatgcctagacagatagagaatcactgcgactggtaggcaggtcctgctgtctctaatgggatctgttttaaggaaaaagttcttgcatctattctgatttctgtatcaggccaaacaatgctagagttgctgacttaatgaccacattggctccgctgttggtcaagatcatcagactctcatttcagctttcaatgatattgcatcctgcaaacaaaccacttgagatgagcttggtataagggtcctactaagagagttctgattaccttattcacttgagatgaaatttttcactggagtgaaattaccagacaactaaaatgttttttccaagggacaaatgtgcaatttttgatccccaagagtagaccagaggccaaaagctacagccattctaccttgcctgctgtgtttctgtggcacacaaactaagaatggtttttacctggttaaatggtaggaaacagtcaaaagaagattttgtgacatgtgaaagttgtatgaaattatatgaaattcacatttcattgtccttatggcggggtcatcagaacgcaaccacacttatttatgtgttatttatgctgctttcttgaaacaaaactagagtagttgcaacagagaccttatggcccacaaagcctaaaatatttattttctggccttttacaggaaaagcatgccaatccctggtctagagcttaatttgtgtaaaagacccttcattttgtgacttttattctgttaggggctgagaaaataaacttcttatgaataacgtatttgatgggagtcttttggtgtctgagtgtggactcaaggaaggcaccgagggcttttgagactgctaaataaggcatctatttctatatatactgtcatggtctgggagctggaagaaatactttaagaagctcaagttgccggatgggatttctggattttttatgtgcacaactaatagcctctcaacctagagttgtaaggtaacttctaatgttcatagggattttgagaattgcttcctgattaactctaagagttgttcagttatttacattctttcagtagaattcttttatacctcctatgtgccaggtaataaatgtggagacctttcccaaagctttttgtatatatttaatttagagagcttctacctcaattttgttgcaattaaactgatgctaaattatgttcttcccttttgaattatggctgattgtgtctctcatcatacatagagatgttagaaagctaagctttacatttcagctgcttatattatatatacacacatgcaacacacattcacatataattgaactaaattgacattgacattgagagaatatcccctgatatttatctatgtaatttttattcttaggattagattaatcagtgattgagactgatcctctgaatcaatctctctctcgatgaaatacacaatatgtataatgtatatattaataattataattattaattgttaatatataataattagatattataactacacatatatatttaaaatttatattttctccagaactttgagttttaaccctagagagactctatcacagcacccagaatattctattttaatagttcatttaggataccaacactggaaaactccagttttccagtgatgaataaagttggaaactttattcatctagcacgacgtatggtgctcagcatagtagatgcctctgaaatgctgattgaatggaactaaactgactttaatcgagagaatagccttgagatttctttatctatataatttttatccttaggattagattattcagtgatggagacttgacctaaaaatatggctctgtaatttcactgatattgtcaagagcttgtttatgctccatcagcatcaggtccgtgggtgttgattccacttataggagtccctgtggtgttgggagggggccagaaaagtaaagagtggtctgctggaagtcagtggattagctggagagctcattctgctgatggctgccctggtagagcaccccatttggaagtggagctgaagggagagacagtagtgatgctaagagaaatgagaggaagatgagaagggaaaaattagctcatccaggcagaacctttattaaatttagttccagatcttgagttcacaacttaaataccctgtaagatcagaaatgttattatttgtacctgtagatcaagacttagaatacaggaggatcatggctatccaggatggaagagacattggagcctctctatttcagccctctagctcaatggttcttcatctgggttagtcagtggcttccctgaaaaggctatgtgtctatgcatttttcttgagaagagattccacgctttcattattttctataggatgagtccaggaaacctccttcatccccactcccccaaaaagttaaaagccacctctctagaagatgtgtgaactcttcacagggattctgataaacaattgctgacagatctcatgtaaaccttcctataaaagcgaatgtaggatttcatgaggcagcacagctggaattgttgtgaaattattccccacattgagtggaaatttatctctatgtaactttccccaacttcattttatttgtttgttctctgctccctaaagtaactgaaagtaagttccacccctcttctatggtcctttgaatataaggacacaatttgtatgccttccttaaggcgacttccccagggaaaagagcctttccaaacttttctcatgtatttgtgctttacagactcttccctgtgttggttgttttgtctgttttgtctttgtccctcataaagtcatggcagctagaattgaagatcgcatttcgggagtgttctgaccagcacaaatcagaatgctatcatctacaatcccctcgttctaggtaatatatttctagtaatgcccaattaactagtttctgtgatagtgcctcacactgctgactcataatgaactgttgattgctaaagcctcctccaagctgcgtttggaggtttggcatgtgaatctatttatacccacttttttatatttaaaaaaggcatcacattgatgcccaaatcaggactgttatgcacatgtatgtagatgagtaagtttccctttatgaatttaaaaaaacacacacacgtcatttaactttattattcttgttgctttgcaaaatattaaggacatcttgatgctttcagaatgaacaccaaaacccatgtaagtggtataatacttaacaatgttcacacatgaaaatacataagtggtttatttaattcatgatcaattatttgtttttgaaggaattttcagcattttttatttggacattctggaaatgaaatagtaaacatgattagttcaggtagcattgagaacttttaacggatataatacttatgaagaatttatttgcagcagaaagtggtcacttgctatttataagatgaggaagatagtgtgagccaagtaggaggtggagataacctcctgccaacagatgccaaaatgggagactgccactcggggctgcctggaatgcaactgcacctagaagcatactgtgttgtatgtgtaaacaagcaagaacatccttgtgtaaatgtgtggtggctctgctccttggagaaatagaatggtttctcaacatcattttcttataaattccttgctgttaaatcagtagccatttatccagatacttgtagtggagctagagatccccctctggttccaagtctataatgaattgtggataaagactgggctggcttaaacatcccaggcatggcaggcccctcatatgggaatagagtcaccaggatctatctccttcagaggctgcttctgtcggatgcactgatgaccagtgagagtattctactgtgtgtggtaatctggaaaggcccctgccttcatccacagatctgtctattcagggcagggggaggggaggaagagaacaggccagcctggaagcactgtttctctctgtctttctctctcgggattttctgggaatcaaaaggaaaatattttcctgatagtttagcaaaacatttaattaggggtggtaatgaaaagtgattacagcagcacaatgcgcttgcattatgagttcgagttaacatatttaggggtacttgcgcacaagctgtttggtgattagggaccaatccgctgaacatgaaaataaataaataaatgaaactgctgtgtgaaaaatgaatgtgctgaaattaggctgtgtataattgcaacgaaaccaaaattgagcagatacagttcccacagagaggtggaaaaccttgtcagggagcattcgccagcctgagctgttgtttgtggctgtgtgtggaatggactcaaagcccactgtggctgctggaaagtggtagggtgatttgatctattcagtcagaactagctgatgtagtgaccgaattatctcaagtgcttcccctcctgttatgtaggcaaaacctctaaattcaatgggttggattttttctaacctttaatcatttgcgtttgatatcatgtcttcattgccagtttcctccttaacccaacgtctttcatcttcaatcttcttaaactttaaaagatacaacccttcatctttcctttgatcttcacctgatgggcatgttagctgtgtccatcagtttcactaacctatttctatgaaaacagagaaaatgtttaacctagtatgacgggcctatagattataaaaataattgactaattttgttgtaaaaaaatactactctttgtaaaaacaaatcagcaaagctggagttttgtctttataaaacatgatgcttggttgcttgcttttttcaccttttaactggctatttgggtatcaagttcaactgaagtgtacttttgagaactgtcacagtagggcctccccattttatatggtagctcaccaaactgactgctgctgccagcacccttttggtttgctcttaattctattgggagccctattgctggcaagaaggctcctcatttaattcccataataagcttcattttcagcaatgcctccctaccctgagcttcataaagagtatcatgcctgtcgattttctttacagaaaggtgagcggtacttctgttgcccagtttgatacccagtagggagattcacaagatgccaagggtcttctacagaggaggtactagaagagtatttgtggagtatatgaaggaccaaggatgcagcaactaagcaatatgtatactgattatagatattttcttgattttggggggaaaaacctccagataagaaaagcagtctcattggagacctttggaaaaatgaacaataaatctttggagctcttctaaagttggtaagtctcaagtttctcccatagttctacgtaagagtactagctcattatttctcatagaaataattgagagactgaatttccttcaaagtatgaaattgggtgattgtatgagatcatgtgatttcatttcctctgttagggctttctcaccacttgtaactagaatttaagaacaactttgttgcacttgaaaaagaattaagctctgtaagcctactgctttccactggcccactccagttttaaaattgctttgcgatttttatgaaccacccctgtgaagttaataaaacacaaacatggtatgcattatatatgagagggaaatagaaaatgttcaacataaccgcttttatcattaagaacaggcagcatacagaatgatttaagaataagtgctaatgtttatgcatttttgtacctgcacatatattagaattgacttcaattcttagtcatggccagataaggacacaatggctgtaggaagggcaaagtaggaagaagaaaaaaaggggaaggaaaggagaaatagagtgaaattaatattttatgagcttccaaaatgtatcaggcactgtactaggcattttcacacacccaattccatttaatccttaaaacattcttgcaatatacaggcttttaaaatcccaataatattaataacatgtgttaggtacttagagagaaagggagggagggagagagagggaggatgaagaggaaggggaagaggaggaggagggagtgacaaagggaaagagaaagggagagtggggaggagggaaacccaacgcttgcctcattccaaaatatttgggcttgattgactttgggaacctgcattattgatctcatgattctgagtctcccctctacctcatgcaactaaattcaattgttaaattaactggatctttgtgggtataatatcaaattagaactaaagatacttgtttcatagtcaagagccaagtggttgacccagttcacagctcttcagctgctcttactacttctgcagaggctctaatttatttattatttttttttgagacagagtctcactctgttgctcaggctggagtgcagtggcaaaatctcagctcactgcaaactctgcctgctgggttcaagtgattctcctgctcagcttcccgagtagctgagattacaggcgtgcaccaccatgcctggctaatttttgtatttttagtagagatggggtttcaccatgttggccaggctggttttgaactcctaacctcaagtgatttacgtgtctcggcctcccaaagtgttgggatcacagacatgaaccaccgtgcccggccagaggttctaatttgaagaggatactcatttgcatcttcccacttccatgggaagctgttttttaccctcctcttctggttgcagatccttatcatcttgaacaattgttgatcctcataggtaacttttttttatgtgtataaatttaaggtttacaagtgcagttttgttacatggatatattgcctagtgatggagtttaggcttttagtgtaatcatcattggaatgatgtacactgtatctattaagtaatttctcatccctcaaccccttcccacactcccacccttccgaggttccagtgtttattattccacactctatgtgcatgtgtgcacattatttagtgcccacttataagtgacaacgctaggtatttgactgtttctgagttgtttgacataagataatggccgtcagttacatccatgttgctgcagaagacataatttccttcttttttatggttgcatagtatgccacggtgtgtgtgtgtatatacatacatgtgtgtgtatatatatatatatatatatatatatatatatatatatatatacacacactacattttctgtatgcagtcatccgttgatgggcacttagatcgattccgtgtctttgctattgtgaatagtgttgtgattaacatgagtgcagatgtctttttgatataatgatttcttttcctttgggtaaatcacagtagtaggattgctggatcaaatggtggttctatttttttttttttttgaggaatcttcatactgttttccatagaggttgtactaacttgcattcccaccaacagtgtataagctttctcttttctctgcattcttgccaacatctgttttttttttttccgactttttaataataaccattctgactggtgtaagatggtatctcattgtggttttaatttgcatttctctgatgagtaatgattttgagcattttattatatgcttgttggtcatttgtatgtcttcttgaaaaatgactattcatgtcttttgcccgctttttaattggggtgtttttttaaaaaaaaatagtgacggcaggtggtatgttcctcacacttgacttgtcatttacaactgaatttttcagctcacgatattgaaatccagaaccactttttctatagtcaagtgtgattcagcaaaaaataaaaccttcttgcattcatttggaagtaatatatgtccttttggaatttctgtgtaagtccttttttagtgagaaaaaaatcaagtccaagttaaaatgataaaatactaaattcggtgttgccaagtagagtttaatttcaattcagatactataatttataattctgggtcttaggagccaaagcctccttagaccatccctttaatccaggcctatcatttggagatctcatagctcccttcactgtaatcaccgtctggtgctagatagtggaactgagatacttctttgctaatgacctacttgctttcagatacagggcaaccagcggatggttcctgggatctcatctgatgagtgacatctttccggacagaactgatgactctctggcagtaaaagggtggagagggcagggcagatatgtttcacgagcaagaagggaaatagtgtgttgtaaagctttgctgtaggcctgccaggatctggtgaagtgggtgggcggggagagcttgtgttcacagaagagtcagatggttaaagaatttatgataattaaaatgacgtttctatgtaagtctgaaggaatacagccataaaaacataattgctgtaaaacatgctgcatcagactaaataaccacttgatgatggcaactatgcctgtgccataaagaaacctgtgcttttgtgaggagaaaaaaatatgtatttattatggctatttgcgtctcatgttaattgttcacaacaaagccattgattaagcaatgactccttacaagatggggctggatcaaataatgcacagagtacagcaaacaaaaaatggttgtgagatgaaaggatgattctgagaaacagggtcaagctgagaactctctgaactctccttgggcacctgcagtcatagttctagaagtgtgcggaacaatttgaatgagagattagatctgagtttcggggttttcttttcccaaattctactctgtaaagaatggcttgcctggatatggaagaagtgctaatggagggaaacaataaggactgtttcacaggaacctgccacacagggttcctgtttgaggtagagatttagtgacactgcctgaactcaatcagagtgaagccaggctttctgcattctgctagtttcactgcaaactgtggccagtggggccagcattcagtcagaaacacctgtctaggaagtcacaaggccatttatgattagtcttcccaatctggacatcatggagcagactcaggcacgtgaatggcgtctatttacacacacacacacacacacacacacacggctatactgttttcctggacaatcatttttcccacatttcctggaggaactactggaatcacaaatcacaatttgtggcttgccctgggtaatgagtcattggatggaatttcatttggtagatttaaagagagttagtgttgatctatgaagccagatgatttaagaaattgaagcagtaacaagtaaattgcttttctcttgtactgcaaaatgctttctaggcgtttttggcttttctttttaaaatggatttataatgccatttctctccacctcacggctcaagtaaacctctttgctctgatgaatcctaaatgactcctcatttcccacaaacagattgttcaaaggagttcttaatatcttgttttacactgtggaagctagaatttttaattctataggacacacaaatgaatatacattccctgttagaggctttatttattctgactcctctcatgaaaaattatgtccaactatgttcaaattccttgaccttataatcaaggcctgccactaaccaacctaaactcacttgcctttatttatttgttcatctggaagcaataggaaaggcttagaatctgccatgtagtatgctagttgttaaagaggatacagaaaagaaaaaggatctgggatacagataagtccagctgcttccttcaagcaatttactggccattggccagggcagatatgagagtggacacttctatgagatatgttgaacctgtgttgaagtgtgtgcaaaggactatgagaggagaggagagctgttgcttctcacagcagcacctcctctacatgggatgcagagagtccaagaatgctccaaaatggccttttccatcttcataatggccttccagccttcccatttgtgggcacaggggccccctgccctagcaaccttaaggtgccctgttgccagtacccttgagactccctcatgtttacggatagattgtaaattacacatgaaaaaggtctcatattaactattttaactttacagaaaccccacagaagtgcagcccacttggtcttgagctccttgaaggcgaggactatgtgatgccacatctgtaacccaagaacccagcacaaagtgttgcacatagcagatgctcaataaaagttttaaactgctgggggaagaaagtactatgggcatctggaagaggggccagctaactccacataggggactctggagctgtgctaaaaaatgtgtggtccactgcttcacttgaagagcctaaaaaatgtgtagagatttatgagggattaataggctcaagaattcgaaagggtactccagacagctcagagctcttgcccccagaatatgtgaggcatcgaaacaggaaagtaaaatgtttctagcagatttcttcccccctccaccccagacagtcttgctctgtcacccaagctggagtgcagtgtcgcaatctcagctcactgcaacctccacctcccaggttcaagcgattctcctgcctcagcctcccgagtagctaggattacaggcgcctgccaccttgcccggctaatttttgtatttttagtggagacggggtttcgccatgttggccaggctggtctcaaactcctgacctcaggtgatctgcctgccttggcctccaaagtgctggcattacaggcgtggcctaaaatgtttataacagatttcttatcaatctggttctctaaaccacagggaccacttggtgaacctgaagttttgtgactacaaggagatacataaatgtgtatttgagttaccttcatacagctacaatttggagaaggacgtccaggaagatactgagaggagaagtaatcatcgggtactgtttaagagagccgctgtcattactgcctttactgggttggggtcagagacaggtgggggaggtgctctgcaggttgtgttttatgtaattggtgctccgtcctcctccttctgttatatcactcatctgtgcagcttttcatctcatatgtattttccaccatggtggcctttgtaagacataaggtgagcaaactgcttattaaggtaagacaatggaggccccattttaaaaaggttaagatgtcctcaaaagtgtcagcgcatcccaggaatcattaacagtgtatggaatgcacagcctggtattttccaaaggccacactaaccttttcaagcatggaacaggctaaaaggaatggatttcttcaccatttgatgagagaagaaatctttttaaatgcttatttttatttgcttgctgagaatcatctctgtgaagctcaatatggagaaatgaattctgaacattttagcaactcacttaaaataccattagaaagcacttgggttattaaaagctgaaaacaaaggactaggagccctctggcactaataacacttagggagaaagcgagagccacctatgccctcatgtttgccaaaaatgtatttgaatttaaactcttcattgttaagaagggaagcttaagttttgccaaaccctttttgcctttcagtacaaccacttttccatgtaattggctcaacactgctatttgcataattgtcatatttttctgcttcccaagagggctgtaaagcgtaaaggtgaactgcaaagctttgacaaagtgcacatttatgtgtgatgtgcaattctcaaattacgaagaaaattatatctttttcattgagtttatcttacacttggaaatgaagtattcagaactcattgccccctgagatgagtttagcctgcttttctttaacttggccaaagtgcaatttcctgagccttgggtcttcaaataatgatgttgccacaggaccttgactgtatgaatgacctaaagcagaggcatttttctttaagccgcggaataacaataagctcttttagttggaatcagagatttcatcacagctgggccatccgttaagctctgagaggtcaaacagatcatttaacctctcaaagcctcagtttgtttaactgtaaaatgggcatgcctttaactcacacatgtattgagtgcttatatgtgaggaagtattttacccagggcttggtgcatagtaagtgttctaataaacacatgatattgcctcgttcctcttcttttatagcaggtggatggcatttaaatgaatgagagggcttgaactttggcacgggaaaagaatggagttgagtcctgcctatgtcacctttttagggagtgggaggatggggttgcagagagctgtgtgaccttgggcaggttacatagcaggagagcctcagtttctgtatctgccaaatgaggatggataatagaatgtgattgtgcatataaacagcatgtaaatgctcagtgttacctgtagttattaacatttcatccttaacagcggtcattatcaggtttaagatatggccctatgaggagttaatgggtgcagcacaccagcgtggcacatatatacatatgtaactaacctgcacattgtgcacatgtaccctaaaacttaaagtataataatttaaaaaaaaaaaaaaagatctggccgtgaaaacttatgttccctccaggtttgctgtgtgttgtcccatcacttttcacattggggagagtggaatgttcaacttcccttcctgtgaatgctcctggaagcctcctgcttacttccccaagtggggactagatttttacaggtttcctaattgctgtgtgcttctggctgcagcctgagggcatcagattacagtgccaaatggaggaatagtattctgggtgtgatactgatcagatcaggaagatatcaggacactagacatccggcatctgacagctggtcacaggggtcacttttgatccctagtttccccttgacaaggttagccactacatgccaagtgtttcatgggcagaattctagccaagcactaaactctgacagagaaggagaaatacaggctggcaggagggctggcattgccctaatgtcacagctggcactcacattccaatgaatgaatcttggatcaattgctaatgtacggggcccaacacaacattaacagatcaaaataagaggaagttggaaagtattcaagtttccagaaacaggtagttaaatatattaacgtaaatctacttgataaacttatctaatcattttaaaaaaatgaaaacatggtaattaatgttagaaaatgcttatgttgtaatgttaggtcaaaaaggataaaaatatatagtataattagaaatgtaaaacaacaacaatagacaaatctataaagacagaaagtggattagtagttgccagggtctgggaataatgagggttgtggaatcattggccaagggacgtggggtttgttctgggagtgatgaaaatgttacaaaattgattgtggtgagggttgcatcagtgaatatactaaaaaccactgaatggtacactttacatggatgtgttgtatgttatgtaaattatatctcaataaagctgttactgacaacaagaacaagtcttatacatacaaaaatagaacagaaagaaattttccagaaggctaacagtgtatataagttagtagcaaattgggactgatttttcttctgtattttttcacattttaaaatacagtgattaagtttaatgatcacatatgtagtctcatatattaaaataaaaaaactattggaaaggcaaataaacaaaaatgaattaatgccaacttttttagctcatggaattgaaaatataaataatttaaaaagtaagagaaaaaattatttttaaactagatgaaaatgtagcatagagtatgtggccccgtgtactctggattaaatatcaatacttaaccttttcattaatattttggcttgtaatgaaattgccaaacacaatggtatacataagacacatggcataaatattggaaaatctgtgataaaaaaatttttaataaactgttttctcagaattgacgtctatccttgtttagatttagagcttttgaaactttcagaatataaattaaaaattatctttgtaatcataatgcacccctaatttacatgtcctgatcttaaatctattatttatattagcttttatcaaaacattcagataagtgatcttcaaatgattagtacttaagtactggttggagatgaacttttgcaagtgaacgtcatacaatctattatttctattggagcttaattctgaagctcagagactccctagctctcctcgcctcaccatggtaatttattattatcctttgtctcctataatgtttgcttctttggcctacctgtagcataaaccttttggttgttctgcagctatttcagttaaataactcaagccctaaaaaccacagaaagaagagaatgtgcaaagcgatcatatttatggaccaccagatccttctcagcataattgccaggctttttatactgaaaggcaagaaacagctgccttgttctactttggtgtccaactcagctgtttcagattcatcctgttgctttaagcatctgttgacaggtgggaaagctcactgtgaagagaaacattgttgccctgggtggcttctgcctaagacaggcctgacccttttgtttctcccctggaaaaggaccgaagtgttccttccagccttattaagtacagctgtcgggtacattttagtagatgagaaccatttccaaagtatctcggttctgagaactgagaggcagtgtccagaaggtagttggacaagctcgtgtgctgtagaatgtctgtaagtggctgggacttacagaggagaggcccgcacgttgctagtcctccttgtcttggacatcttgagcctcccacttgaatatcctcttaggctctcattttgtaccagaaattctggaaactggaaggctattttgttggaaccccttattttacagattagaagaccgatgccagggttagttaagtgttttgttttatgctacaaagttggttagtggaattcttctgcctatataataacatcacagtatttcagagttgttttctgtcctctctttgtcaggtttctgggaaatctctttctcctcatgtttattatttggcccttaatccagcataataaaattacaggtacatatagtttgtcacaggatttccagttaggtctcagagacctaaaggaaagaaagttattgaaagttctggaaaaacaaaagtcctgagatagtttcttgacatacatcttctttgaaatctttaaaatcaaacaaaacaacccctagtgtcttccctgtcgcccccttcactaccttcttttgtattctgcatatgtagccattctcttgggcaatagcagaaaggtacatgtggattaatggaatttatgtattcactggcggtaaaaggcactgggaattcctgcactgggtgtaaaaacttgggccttggggacctcactaatgacttttcaagagcagttctttacagagcccaagtcttcaatcttgtaactggaccatcaaccccagtgacagcctactttgaaggaggcctcataaagacaaggttcaggctctttctaacggttttggctaatggaagacctggaggggaaaaatgaaattgttctcaaacttcttacaggtagaaaggagaaaatctctggaagttctgagaagtgacaggaatgtaaaattttgtgtttaaaatgtaagaagtagcaggggatgatgaagaatgcttaaaaatgcttgtttttattataggcagtggaaaaaatgtgagtctcaatttgcttgccctggaattgctccagctagcagaataaatcaaggctagaaccagatcagaatttcttacgagatgacagggatctgaaggactttacctctatagtcgttttgcctttttaggcactgggtgacctggtcccatgtccatcctagtgggccctgtatgatccaatccaaaggcccctttaggtttgcgttttatcattccctctttctcagaatttgatgtttgtatgtaaaagcactctggaaaatatttaaatcatggtacaaatataagagaagtcatgcaggtatggaattgctttgagaagtatcattttattaatttgtctggcttgataccaattacctgatgcagttgttaagggcagatccatccagaaacctttgggttctctgctccctgattttgttttgcaaattatataaccatacttcatagaaaacaccagtggtggctatgttgttcacagacacaaagtgattctaaggcaaccacaggagagagacacaaaagaaatcacacaaaaatctctcatcacaacataaatattgtgacaattgtgtggtactttttgtcttttttgttctctctgttccttttttgtcagtacaagtaagtcatcatgaacaaataagcttttgtatcctgcttttttaacctgacatgttcacagaacataacctagtcacacacgggcaagtacatcttctatccagtgatttgtttcaccatcaccctgcacatcacttttctcatgtttcaaatgatttcctcagaagagacatctggaaatgggattactgagtcaaagattctcaacctcttttaaggcccttgatatgtagtggcaaattgccttcctgaagggctgtgccagttgacatggctggcaggggcaaggcttgagtcttcctctggacctgtacatgggtacagttaacattaaatttttttaatgagtataatttacatacaataaactggacaagccttcagtgcataggcttggggaatttttacatacctacatttgggtaaatgccacccagatcccagatctctctctctgtagacagatagatacatacatacataaatacatagatacatagattgatctatctgagcagcatttatatttatatatgatatatcacatatgatttatatatttaatattatatatgatttatatgttagtatgaatcatatacacataggcttaatttatgcataaacatatgtgcttcacatatctttacatagataaatataaatataagtatgtatatatatatatatatatatatgttccttacctacaggatccaacacaagattaacttagatactttccagcttagatattaacttagatctttccagatcagaataagaggaagttggaaagtatctaggtttccagcaacaagtagttaattatattaacatgaatctactcgatagactattatgtcatcattttttaaaaatgaaaacattgtaattaatgttagaaaattcttatgttataatgctaggttaaaaaaggataggtgtgatttttatatataaaatatatgtacagcatatatatagctacatatttaaatatataaatacagcatatatatatttatatacttaaattataaatatatgtacagcatatatatacttaaatatataaatatgtatatgctgtgtatatatttatatatataaatcacacctatgtttgtgtgtgtatgtgtgtgtgtgtgtgtgtgtgtgtgtgtgtgtgtgtgtgtgtgtatatatatatatataaaatatgatatttccattatccccaggaagttttctagtgcctagttggtatgtagtgcccagtcggtgtctccacccacccccaaggtaaccactattctgaaagtccctcatttttgagtgatttcggaaatgttcttctctcatctgaaatgatttgacaggcagtctctgaagggagattgccatggctttggtgttgctcggatttctgccaccttacattggcaggctcaagaagatatgcacagtctttatttcattgatgtccagttgcctgtattgagcttagctatcctgtgcccaggttgccttagggatcactttgtgactatgtgcagcttatccactaccttttttttcccttcaagaattaacaaaaccactaccatctgttctgaaccatgtgcggtagcaggtagggggtgacaatgaaggtgtgttacagaaataaagtaggagccatgctgactttaaagaaacacccccacccccaaatgctcctggctgttttctttctatagatgagttaaaacagagggtatgaagtgcttggtttgcaaatcctgcaatactttgccatggcaagtccctaggaagtagattaaaagtggatctcccagagtgattaggattgggcagataaaatgatatgtttgttttggtcaattgagttcgaaatacaggttcagacagtaaatactcccttgctgagactaaacagtcattttgttgttcattttgatgaaaatcatggctcccaattttccgtgaaagctatcctttctgagatagactggctcttcatgagttatgaagcacctgaaatcctctctaacagcaaaatcgaggggcaacatcaaggttaggaacatcacgagcaagaacttacggctcagcagtggttgtaggtgtaaattcagtgtcccaagtcagaaaccaagaggtgtaagcccaacatgaaaggcaaagaggggaggaaattaacaaagatggaggctaggaacaacgttaggggctttcatatgtaataatccatttaatatttgcaataagtttatgaggttgatctatataaatctccctttaaagggagggaattgaaacatgtccagagtctcacagttacatttcttctttgcctctttccttccctcttttctttcttttttccccttttcccactgttgacacattccaggacacacatcctcctcctgttttccttttccttcacatctttctcgtcctttgctgtaacatcctgtgccataacaaactgtcacttatccagtgtggcatgccctgtgaagccttccctgacaccgtgaaccatagtaagtttacaggacccttcagtgttggagttctatcttttgcagctcccacagcacctatagaagttgtgttcacagagcactcaacaatttctaggcttgaataatgctgtgacaaagatggggttctgttgggaagacactgtagccactgtcagcataaagatacaaatggtccttgtaaatggatggagggcctttgagtgatttcttatcaatggaagtgccttaggaaatgcccagttgctgccttaaaatcaatataattatccaacattggtcactgagtttgttcctttgccaccctccccacttgcatgtggaaacctttttggccatattttattttagtatttcgccaaggagttttcagtcatcttaattaataacaaaaacacatcaagctggaaggagatggcctgaccatagtacattcctttaccaggactctgtagacaggtccccagctggcatacggatcaggagctcccattccctccaaggacccgtgaacagttcacacctacagtgttagattagaacagatgtgaaattcaaatgccactaggttgttataggtgttctctgaaaagaacagtggtaaaataattagtgcatctaattatcagtgtgttcacatgctttatatttttaaagggccacagcagtggccctttatatatatatataatgtgagctatatatatataatgtgagccatatatatatataaaatgtgagccatatatataattttaaagttttttagtagtcaatttaaaaatgttgaaacgtgaaattaattttaataatatatatttaatttaactgagtaggccccaaatattatcaccttgacatgtaaataatataaaaatattaatgagatattttacttgtttttgttctaagtcttagaaatctggtgtgtaatttatacttacagcctacctccttttaagctggctatatttcaagtgctcaagagctatatgtggctactggcgatcatattggccagcacaggcccaaagaaacttctagtggagtctttcttataaagatggagctacgtttgttcataggcaaaaccaaaaccaaaacaaaaaatgactctgtatgtttattggtcccatgctctgtgctaggcactagagtggggagacaaaagggtgcagtgcagcctctaccgtaaagcagtcacacgtgaaaagtgaaatcattttggttgtaatttataatgtgtccaagcacaaggcagtttttgtgattaattctcaagcaagtgattctggcagcttaggactgtgagtttaaaggagaaagtaatccctactatttgagatggtcatggaggacaggggacattggacaaagtataatatttgtctgagatggggaaagaggagaacaagcagttcatgtgggggagacagcttgaacacatctacagaagcattgtgacacagagagtagattagcttggctataactgagaattcacataaaggaaattgtggaaagaaagatgggattccttttggctgtattaaagagagttggactatatagagagatggctaagagacctcagttaacaacaggaatgaaaataataatcgcagctagcatgttcctgattagggtccagtccctgtatcaaattctttgcatttttttgtcactgaatattacaaatgagaaagtggaatctctagagaggtagaagtacttgtccaaggtcacacatccagaaagttggcctagcaaaattttgaatacagaaccttctgagttcagagcatttactttaaccatcaggagatatgctcctgagaacgttggaagcagtgatctctgtgtttgattaatgggacgccccccagccctattgacaaaggtgctgcccaagtgctgacgtaccacctcaacataggacagagaatttccaggccaaggattctctgcagtttgtgtcctctgaacagatacaaatgggccttttagcatgatgcccctgaaagttgactgaagtcactgactcaggtctttacaacccagtgttccactagttggtttcctcctttctctctcctcgtataccccagtatcatactagaatactgggatctcagagaccttttagttcaaggccctgttcttatagaacagaaaacagaggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaaggcctgaaatagctagttgctacttaatgtttgctgcttatcattgcatttgctgggacctggtgcttgtcatgcttatgcagtacaaggagggaccaaagaggcagaagacagtccctgccatagtgaagtgtagtcattttagaggacaggactaaaaaacacgaagcaatgaacaaaccccccaaaatacaatagtgtgctgaatgatgcagtgcagatacttcttagaggtatttaggtgtagctgggctagattgtttctgtattgcatcaatagattggtccatgttgactattccacttcacaatatctcagggatggacaagatggcagagttcaggccccaaatttaccaaaatagaaattttctccatcaactaatgagtggataaagaaaatgtggtatatataacccacggaatactactcagccattaaaaatgaaataatgaaataatgtcttttgcagcaacttggatggagctgaaggccattattattattattattattattattattattattttttatgaagtctcactcttgcccaggctggagtacagtggtgtgattgatatcagctgactgcaacctccacctcctgggttcaagtgatttttgtgcctcagcctcctaagtagctgggtctacaggtgggtttttttttttttttttttgtatttttagtggagacagggtttcaccatgttggccaggctggtctcgaactcccaacctcaagtgatccaccagctttggcctcccaaagtgctggctttacaggtatgagccatcgtgcctggcctagaggcattattctaagtgaagtaacataggagtgaaaaaccaaaattcatttgttctgacttataagtggaagctaagctgtgagtctacaaaggcatgcagagtgatacagtggactttagagactcagaaggaggagggtgggagtgggccagggattaaaaaaaactacacattaggtacaacatatactactcaggtgacaggtgcactgaaatctcagaattcaccactatataattcatacatataacccaaaaccacttgtaccccaaaagctattgaaataaaaaaattaaaaaaatatgtaagttccatttcagcatgagaaatacttcttagaggagtgttcataacataggttagtccccatgagatttgtgcataaagaggactccataggcaagccattccatatcttcctcttggagacttaaaagacatgttcgttcgtatattaaaggctatacagctttcaaacttttttatcaaagtcttgcagtttgtaactttgactttaacccagtattaaccaaactagtcttcctacagagcctttatttcgtagtccatgttccatgggccttgtggcagaacacacaatgggaaatgctgctttacagtggactcttggctccccagtaatggctaaatgcctgatttggttatagttctgtcagcccctgttccttccaaacgagaatcttgtgcaggaagtaagaaagagaaactagcccaagctattttgacaacaggcctctgactgaaacaacctccctgaatggttgataaacattttccctctcttaagggaaaatcatgcacagaaacaagcacatataaataatttaccaagctgtaatatgctgtaaataacaaccctgctaaataatgaattaacccaactgctgattcataggtaaatgtctcttgtaaagcagcatttttatggattttatagcttagttaatatccactcatatttcattaggacacttcaggtgaagtattggggtaataatctggatatatttgaaactgacatagcacatatcaggagtccaggcagagtttggggagctgccaggatccttttgtcttagctagagcatgaggagagattgtactgggccttactcttctccttcctccatggtcttggtttgcccagctcctcagtgcaagcctgagttgctgagcaggatgcggctctgatatcagagagggtgtcctctctgagaccacgggcagggatggaaggagaggtagctctgggccaggggaagaaagggacacagaaatcactttggcctactcgacagagccagctcttctgagtttttatgacacaggtgtgcagactctggagctgaactctggatatttgcatctttaccacttattaactttctgacttgggcaagtcacttatacactctgtggctcagtaccctcacctgttaacagggacaataaaagtacctactcctagggttattatgaagattaaatgagtttgtattgtcaagtgctggaacattgcttggcacataagcaagtgctttcatttatttattttttgagatggggtctggctctgtcacccaggctggagtgcagtggggagatctcagctcatagcaacctccacttcccagactcaagtgatcctcccacctcagcctcccgagtagctgggattacaggcgcatgccaccactctcagctaattttagtatttttagtagagatagggtttcgccatgttgcccaggctgatctcaaactcctgggctcaagcaatcctcctacctcagcctcccaaagtgttggaattataggcgtgaaccaccatgccgtgccagcaaatgctttttgagtacagtattagctgttatatttgttagaactggactcttttagattcttcattttggcattctccagctctggtgttggattctgagaacctagaccctggggattggagggcctgggtggggagggggtcaccgggatcactcagatgcctcttcttgcctctaaagaatgggaacgggggccaagtgcggtggctcacgcttgtaatcccagcactttgggaggccgaggtgggcggatcacaaggtcaggagatcaagaccatcctggctaacacggtgaaaccccgtctctactaaaaatacaaaaaattagctgggcgtggtggtgggtgcctgtagtcccagctacttgtgaggctgaggaaggagaatggcgtgaacccgggaggtggaacttgcagtgagccgagatcccgccactgcactccagcctgggcgacagagagagactctgtcttgaaaaaaaaaaaaaaaaaaagaatgggaatgggaagcaggaactatgatttcattacagtgaggaaaaactgcttttgatgatctctcagtaactataagtaagaaatattctcttatttaaaaggaatgttatctatctttgttaatgagggttttatggtggggggaggtgatgagaattatcagtcaaatcactttgagaaggaggagatctgaatttcataaataaaccctaatttgttaatgggaactgatgccaaaaacaaggagtttttcctccttgcggtgacactgaatgtcctgggctgtggagggtagaaacaggacattctcagtgttccagctcacaggggtggagttagagtaaatatcctgcccagtttgccatcacactaacactgcataccctatcatcagcctaatgacctttcaattctgattgaatggaagagcactccggcccttgatccaactcgtggttgattacagtgctcatgccccattaccccaaatattcctataaattaccagagcgagcattcacgcttatacaccatcatagatttagctcatgccggtggttctcgatagcagccatctgaagctccttttgcccacagctccctggatagctccaccattccctgcatgctagtcttgtggtttggtcttcagcctgctgtctgtactttctcacacgttgcatgggctttctccgatgcctacaagcaaaatctcttttccattcttcctttctctggctcctgggttcagaaatctctagggatcattatcagtcctctggctgccccctctcctacctacctccatctaccctagctctaggacagacctatggcgatgcccaactttctgcattttgaaataggggtgattgctttgacttgggccctatctattagggtctttcatctgtctattttggacaaagacaatagcagtgaagcagggggcctttgcattgagaggctcagactctcaaactctctcttaaaaaaaaaactgtctggcattaaggggcatagtctgcttgccttcaatagacctcaggctggggaggctcgaggtgcctactagggcagccagtttgcatagtgccttctaaaagcaggaagagccacccttgctgccttacagcctttgtccttgggccttagaatgaaacgcttcagagctcacaattaacatttggccaagcctcttcctcacccccacccccgtgaagtgggaagaaatacggtggcgtgacattcactttgacaaagctctttttcttttctctacttctcaaaaaagcctaaagaaataaaaacagttgctaagctactgggtgggctctatcggtgtgttttgttgcagtcttggcgttaaggactcatgctatcatatatgcagcagcttagactaaagggaggaagcaaagtgcttgagagggctctcttgcaagttcacttttttgtcaggtcaagtgcttggctctgggatggcaggggacatggagcatgacaactgcaattctctctccagatgggaaagtagaagggaggatttcttccaatcctcaaattcttccaaaagagaatgctgttttggaaccttgtctttctttaccatttatttcagaaaggttggatctctaggaagcatgggtcatactcttagttctctgggtattgtcttttgtacacatcacatgcagttggtgctactgatggggcctggacactagctagttctggtgagctcctagctcagtgtgccagaccgttgtactgtattgtatttaatttttttgtctccagcattttcttttcaaagctggtgaatcccaggttttgcaagttttcatttaacaacattcacataatccctaaattcagcatggtttataacttgttaggtccgtttgctatatacaaatgccatacctccaattggtactgaggaatggttccccactcctgatttaaaggcattaacactgagaatggtggaaagagagcctatttcccaacactgctttgcaacatcctctaaatctttcataatggcctaatccacccattgcgcgttggttctcagtgtggggacaatgggggcattactgattttaaacttgttttcatcaactagctcattctgtgtagagttgagtttagaaaaaaaaaacataaaaattaatgcagcctgggacaccctctgtggaggatacattgaaaatacatcttaaataaaaacccaggaaattgtcccttctgtctttcacctgtcagaatcagcaatagaattctatagaccattcagtggcatacttaattaagcaacctatctgctgaatgtgctgggggttggctgacagtgcttttcactgctgatttggatgacaaaggatatggtgagatactcaacagtctggtggaatggaaagaaactcccaattggtcacacctacctatttctcttggcatgttgcattagctctgataatacagaaaatagactggcttttatgcattgagaaagtcagtggacaccaacctcttgccttttgctcttccacagcaagccctgagttttgcacacatttccattacagatgaatacagattttagttgtaggtgagaaacatgagcttgtaattttcaagagacaaaacctccagctgctttttttaatcctagtgcagaatagttccttcctgatcatcattctatattttgatggcagttattgcctatccctaatgtatattattagtattagggacagttttgcagtgtttatctggtgccagacacatgccaaagcatcatccctcttgccaactctgtagggtaatactctattttgcagatatgaaaattgaggctcaaaaaacttaagtgacttgcctgaagtcactcaaccaaacagtaagtggtgggtcaagcttagaacatagagctcttctaccctgcagtccgtgcttttaaccgctctcttgcatcgtctctcttgaaagccgaaagagtgtcacacagtacaactattaataactaggggttggggcacacgtgtattaggattacaaaccttttgggagtctctcccacaaaattgggctcttcacctaggttttgtagagcctttcagtatccataaagcccttcaaactagatgcaaaaatatgtgtgtatattcaagggagataggccagagttttcatcaacttcttgaagaagtccatcacacacaagagggttagtaacttccacataatcctaaagtgcatgtagcacttgccaggcatgaatatgattcatgaatatgtgcatgaacttaagcaaactcatttcattctcaccatagctatcagaggtaggtatgattatcatgcccattttacagaaggggaaactgagactaagagaggttataaagctaataagtgacagcactgggatttgaggccaagcagtctagctcctgcttttaatcacttttgactgcaatttcctttttatttacttgcatatctccagcacagtgcccgacacataatgggatgtttattgatatttgttcaattgaattgatttgcacactgccggctctgtgtagatttcatcttaggaatcattctcaaaggtgtgactccgtaagtcttggctggacgaatgaaaagaatcaacatggtcaaaagataatttattagagtttctaaagacaaatggcttggcaaagcataggcattttactttcaatcagtgttccctggagggctgttacactgatttccaagcccattcttctcccaactggctcactagattgttccaattggttatgtggtgcccctgagtatgggctaggtaactctgcaggccccatgaatctatgtgatgtttcatttcctgattactatgcataatctcccctgccttttatttccaagtgaccaaccagaagccacccaaaccctctgcatattgacatgattcaaatgtaggtctctacaaggtatgccaagcttattgaggggaaggtggggggagatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacatgttccaaggtttaactttgtggcctccactgtttccctaattttacctgctgcgatcttattttacttttcattttattctctaatcaccgccaattagagccctgagtccatgctggttctgttgtctgcctctcagcctaatgggcctctttgtactgaggcacagaacccagctggcagcgagacttcctagggcccggaagcttcattactctttgttggcagtgaactctaaagttgctgtctttggagttgggttttctcaagtacagtcacttaacatttggtctcaaagttgttgtttttcagatttttttctcttttttcctaagtcaatcagatgcatgagctaattataagccagcaaatattttgagaaaacttccctccagtggagacccttgcacaaacttcagactatattcccagtaattaatatgctccttttatttcctttgaggtggaaaacagtcattgacaatcattccctacccatttggttcaaataactaattttgtacctgaagactaattacagtagtgacaccatcttttcctattaggtctctcacttgaagaactcagagcaatttataacctttgaatcttggggactagtttaatctgttcgtgggcagcatagcagtgaacattgttatcagaaatatagttaaacctctttaattgagcccctattaattcaaaaggtaataattcaaacagtgtgaagaacaaacttgaaacgtctatgacaagaagaaagtaagttggcaaaggggttatttaaactgccaagtagagcacacttttagaagtgccagttcacatgcaaagaactggtaagtacacacaaattgttccattaatagactcagaatcttaagattaaaagccctgtagtacaactgttcataactcaaaaaacatttgttgagtaatgctatgtgctggggcctggggatataatttttttgttaatagcttcattgagatataataaatacaccatataattcactcatttaaaatgtacagttcagtgatttttggtatagtcaaagagttgtgaaaccatcactacagtctattttagaacatttcatcactctagaaagaaaccctgcatcctttagccatcactttcccatccccctattactcacagccctaggcaaccactgtggggatacaaatttgactaaaacacagtacctgcctttgagaggatggcaagctattgaaagagacatcaggcaggtgaagcgtacttatcatagcatcgtagaatgttgatattgagaggcactaagaagatcatcagatataatcttctcatttcacatatgaggaaactgaggcccaaagacaagaaatgacttgcccaagaacaaaaagctaacagagccaaaattaaaactcatgtattgtgccatcttagcctgttgcaatgttaattacaatacaaacttctggagcatagtaacagttgagagcatggattctagagccagactgcgtggatttgattctcagcttaccttttataggctgtgtgacctcaggcaagttacttaacctctctcagcttcagtttcctcatttgttgtcttgaaataataattgtaactaccttataggactcttgtgaagattaaatgagtttctatatgaagtacttaaaatagtgtttggcacagaataatcgatacataaaatgattgttattattatttcattacctagttattaaatataaaaacatttcgtaatgtcctaaagtatattttaaatatttgttcttcaggttttaaatcctgactgtattcatacataatttctatttcgtttcttccaacatatatttttgagtgttaggggctaggtataaaaatgatgtttaaaacagagttcaaatgcctaagaagttcagtcaggtaaggaaggcaggtgaacagatatgtagctataaatcaaggcaagcaacaggaagtgccccaaataaagtatgtatgaagcataaagggtataagaaaggcttcaaggaggctgtggcatttgacttgggttttaaaatgtgagccagatttcaccagactgaagagggcgagagaagaagacattccaggctgaggtaacagtagaagtggagaaaagaaagtatttgccatggtttgggaaaggctaagtgttgtatgtgttcatcgcatagggttttgcaagatgtcctgggagacgagcctgaatatagatggggccgtgctcagtaggaaaagggaggagaatttatacttactgaacaccttttatataccaggttctgaggttgggcgcagtggctcactcctgtaatcccagctacttgggaggctgaggcacaagaatcgcttgatcctgggaggcagagaagtgagccgagatcgtgccactgcactccaacctgggtgacagagtgagacaatgtctaagaaaaagaaaaacaaaaacaaaaaaactatataacaggctctgtaaaataccaagtactagatatgtatgggtaactattttgattctcacaatcatcctgaggaagcagtgtagacaggtgatataaattgatcaatatcacacccaatatgtggcagactccagattcaaactgaagtctctctctgatgctaatgcttattccctctccatataccacaccaactcctgaacttctgtaccagcttggacgttatggaaaatgggagctttaaatgttcttgaaggccaggcacggtggctcacgcctataatcccagcactttgggaggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaaaagtcaattgtgaggcttttacggtaggtaaaaggcagcgaggacatgaactaggggcgtggtaatggagaggaggggacacatataagagagggattgacaagacaggacatgtgaccaatttgatgtggtcagagcaagagtcaaagagagtcaccaatgaaggcatgattttttcagcctgtatgttgtgatgggttgaactgatggactgagataagaagcctgggcatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataaggaaacggaggtcaacattgctaagcgctaaagaatggccaagttagatagactgaaaaatgtcccttggatttagtaattaagtaatttagtaattaaagaggttattgagtaataagaagcaaaccaagtagaatattatgggtggaaattatgtggcagtggtttggaaactgaatgaggaatggagacctggagacataaatgtagacaactctttctagaaacttgtctggtaaggtatagagagatgacagaatcttgaagacaaacagatcctgaataacttttttttaattatggagaaagttgagcatttattttggctgagaggagtgagtcagtgaagaaagagctagtaaaaggggagaaatcgggggataacggataaagattggagaggtagcaagaggaccaaaaggaaataggaaaccacagagagatggttagctatggacttgagcccttcctctgagatggggttttgaagcgaggatgcacaggggcacagataaactaaaggctttttccaacagagtctgaggtatttgtgattgattattttctttaatttagaattctctgcgtaagaaaccttgctctttttacactatgtaaaatccttatggaaacaagaacaacaaaaccaaacacaaaaacctactttatttaaatgtgggagaagggcttgaataatttctcccccccccaaaaaaaaaaagatatacaaatggccaataagcaaatgaaaagatgctcaacagcattaatcattagggaaatgcaaatcaaaatcacactgaaataccacttcacacccattaggatggccattattattattattttattattattattattattattattattattattattatttgagacagagtcttgctctgttgcccaggctggagtgcagtggtgcaatctcggctcactgcaacctccacctcctgggttcaagcaattctcctgcctcagcctccggagtagctgggattacaggtgtgcaccaccatgcctggataatttttgtattcttagtagagacagggtttcaccatgttggccaggctgatttcgaactcctgacctcgtgatctgcccaccttggcctctcaaagtgctgggattacaggtgtgaaccaccgcgcccggccaggatgtccattattaaaagaaaattaaaagtaagtattgttgaggatgcggagaaattgcaacctttgtgcactgctggtgggaatataaaatggtgcagctactgtggaaaacagcatggtgctttctcaaaaaaattaaaagtagaattaccatataatccagccattccacttatgaatacagaaccaaaagaactgaaagcaaggatttaaatagatatttgtgactatagtcaataataatttaattgtacattttaaaataactaaaagagtataattagattatttgtaacacaaaggataataaatacatgaggggacagatatcccattttacgtgatgtgattaatacacattgcatgcctgtatcaagactgtacaaacaaaatgtgatatatatatatatatatatatatatatatatatatatattattcagcctttaaaacaaagttctgacacagctacaccttgaagacattatggtaagtgacggatgggtgaactttgaagacattatgctaagtgaaataagccagttacaaaatcactgtatgattccccttgtatgaagtacctagagtagtcatattcatagagccagagagtagaggttgccagaggttgcgaaagggaggaatggagtatggactttcaatttggaaagatgaaaaaagttctggagatggtggtgatggttgcacaacaatgtgaatgtacttaatgccactgaactatatacttaataatacttaaaataagttttaccaccattaaaaaaaaactttctagagccaccattttagcttgactggggtctcctgggttgttcgtaacctagagtagtggctctttccactgctgacagatagcaaatccagagcagacacctcgtgtaagagctacctcttagcagaactatgattcaggtttgtgtgcattacatttaagccagctgacatatcactttctttctcactgctgtgtacacaatagtgacatgatcaaacttgaaagtgcatgagaaacaatcacttggagaacttgttaaaaatgcggattcacaaaatcatctcttccatcaaactaatgtagtaggtatatcagctagtttgtgctatataacaagccacccccaaaactaagtgatttaacataactgtttattattttatagcctatgagttggctggatggttctgctcatctgggccaggcttcgctgatcatagatgtactcagctgcagtcagccagtgggttaaccagggcttggcttttccaggatggcctcagttgggatgactttaatctgctctacgtggcctctcatcctcaaaacatcagcccaggcttgtttttgtgctgtggcaggagtctaagcaagcaagcacaataatatgagggaacaagaagaaatgcacatgagctcttcaagtttctgcttgcatcctatttgctaacgtcctattggccaaagcaagttacatggctgagtggagattcagagtgggaggggtgtacaaagagggcaatagcaaggatgtagagaggtcactgggtccactaatgcagttaatctactacagtaggtttcagtaaagcctcggaatctacatatttagcaagcttctcaaagtgatttttttctttctctctttctctctttctgtctctctctttctctctccttccttccttccttccttctttctttctcatgatctcactgtcacccaggctggagtgcaatggtgccatcacagctcactgcagcctcaaactcacaggctcaagcaatcctcccgcctcagcctcccaaatagctggaactacaggcatgcaccaccaggcctagctgtttaaaaaaaaaattacagagatgaggtgtcattatgttgccaaggctgatctcaaactcctgggctcaagcaatcctcccacctcggcctgtcaaagcactgggattacaggtgtgagccaccatgcccagcctaaagtgatactgatgcaggctatcccttaatattttcagaaatattattctagtatctcttaacaccaagattggaaccagcatcattgaacgttcagaaaacgaagactcagtggggaagggagcacttattcttctccttatttccagcttatgattcaggcctcttggtctcttagaggcagatgctgaaacgaacactctctgtctgcttttcagacaatctcatataatcatttacttgttacaaagaacaatggagttggattaaactgataaagtgttatttttcaatgcaggtcaggaaggcattgttggtttgttttgcattgctcattataatttctatttttgtcctggggaagctcatggtaatggaatgaagcatcgaggtggtttatgggccatgtgataggatcataaagttgaggttgttgcttggacaatacctttcttagaatagtaatccaagcaaagagaacatggacaggaaagaaaagaaacaataagaagaaacttcagttatttagccagttgtatgaggttttcattgctcagatccttagttaaaatgtgggatcagaggcctgcaggtaatgcctgagctcaggaaaggcagggaccatgatgcttttgcattcctgatacgaaccacagtgccaaccacattgtcagtactcaaaacgtatttgttgaatgaatttctgctaattcctgggatctattctcagagattctgattgagcaggataagtaaatagtttttcacagtgtggtccctgaaccatctgcatcagaatcacctacagggcttgtttaaaaaatgaatgccagggccgggcatggtagctcatgcctataatcccagcactttcggaggctgaggctggaggatcacctgaggtcaggagtctgagatcagcctggccaacatggggaaacccagtctctactaaaaatacaaaaattagccaggcgtggtagcacaggcctgtagtcccagctactctgtaggctgatgcaggagaatggcttgaacccaggaggtggaggttgcagtgagccaagatcacaccagtgcactccagcctgggtgacaaagtgagtgagactccatctcaaaaaacaaacaaacaaacaaaaatgaatgccaggatcccaccttctacttcttgcgtttgatgcatgagaaatcctagtttacacattttattaaatctgggactggttgtaactggcactaatgtagtcttgtgtgaaggtagtggtgcgatggtcattctctacccttgccccacctgagagcctctagagggaaggctgtggtccagtgcactgacctgaaccctcaccacatgcgtcccacacatatggaattgggagcagtcatttagcatctcttagccatttcgctctaatttctttgtttgccatttttgttgactttttccttgggaacctgaatttaaactcatgccacttttttgtcttccttattctagtgggtaggaatttgatcttgaccccaaaagcaatgataggttcctacagttctgtaaagtatccattgcttctgaaaggccttctttccccattgtctttgacaatttagattttccaagtgctaggattttggagaaagtggagccatgagcccaggcaagtggggtagcctgataatgccctcccatgacacatggggctggggatgtaaaaacttcagagtttccatgtcaaataatctcctttgccctgtggccttcggttacaggaatcatttatattacaggcacattttgaaatatcaaaacaaattggacactttttccctattaggaagaaaggcatgttaatttaagtgtggagtgtgacatttggaaatgtaaaaagaggcttttggggagtagttgggggtttgagtggaatatctccctttttgtatatctctcttgtttttattcatcctgtgtcttattcagatagtgattttcattcacctgcctgatcttctggaacagggattttagagaaagccattttctcagcagctccacaagggcgagatttccaaatgggcaaggaaaggctgcagagacacatctagcttggaagtaaatgcaccaagccagccaaattggaattgtcttatagggatccttgtgtgctgtcacagaagagttttcaggaggctttcctttgggcactaatggccaaccactgctgctgagtttctcccagccttctggagggaatgccagccagcgcactctcagctgtgacatgaccctcctaggagctgttcaatgctagcgccgttttgctctgatgcccagcaccctctgcttttagtcactttccttagcgtcctttcgcagtgcttgcatttcagccaaaatcgtgcctcgtgacttttcttttcctagagttttcgcttctcacagtgaagaatctatcagctgtttcctgaatccttctatgtcttttaaggtgttaacattttcaattttgccacattcagcatttttggcctactctgacctgagctcgataaagagcatcagaaattgagtaaagacagaaataagtccctataagcatgagccctggcactgtccacttcctcctcctcccctaccctgacagcactaatctcccttcagctctactcattggaccccctttattctttaggctctctttagtgatttatcttagtttagctatgagaagaatcaagctttttaagggcttcgctgaaaacgtaatgaaagttgtttcaactctttaaattttaagtgaattgtggccatctcaggcccactagttcatgtacctgatacaatttttatttggagccactgtattcacatcttcctgggacaggatttcacataattggggtaggttaatgagtgtggatttggcactccctttctatagagagtggtaaggagctcaggccttggagtcagtcaggtgtggttccaatcctggatctactattaggttggtccgaaagtaattgccatttcggccattaaaagtaaccgcaaatacttttgcaccaacctaatacttagtagctgtgcagtcttgggtaactcgtttcacctttcttgtgtctcaatgtcctcatttgtaaaatgggcacaatagtcccaatcacataggttgaagactaaaccaaagaccccatttcattagcttagccttatccctggcagataccatgaactcatatgtcattataattatgataatttacttaccctttcaattaggggtataagatgctacacagttttcctctaggacagggcccgcaaaccatggcctgcagcttgcctgtgagctaacaatgattttcatatttttaaaaggttgaaaaaaatcaaaagaagagtgccgtttcgtggcatagggaaattatatgaaattcaaatttcagtgtccataaataaagttttattggaacacaactgtgctcactcatttatatattgtctatggctgcttttgctctatcatagcagagttgagtggttgtgatagagattctatggcctagaaagcctaaatatttgccaccttgccgaccacttgccctaagacatttagccatgtctctggaacatcactgtgatagatagttcaggaattatttgcatattatcatcactgttattccaaaactctgactgcgtgtgtttctgtgtggagagtgatttacaaaggaagaaattatacaagtcataacaaaaagaaaaaaaaaaaattacacaggtccatgtaagacaaatgagatgaggcttttgtggcagttttagctaaggactcactttgtgccttcgagggatcagaaagaatttagaagtagtagcaatattggttaggagaatttacagattctcttgttttcttttcctctatcagtaccttctctgcaaggaggagagaatggatgttagtttctccttgtaagatgaattgaattgcttgtgttagtgtactaggactctgggttggttgtgaatgtggtataccaaggcaaagtctcatctgagcaaataccaccataacaccctgttctcccccaaaaggcaatctctgtagagaattataaaatcttagaatatcaagattggaaggagcctggagatctgagggaatgatattgatattaatatctccttgccgatgtagatacaatatcctgtttgaaggcaaaacattgtgtaataaacccagtctactcaatctattcaactaaggtggcctctagtgggtgtctgagtactggaactagatttgaatacttgtgagatattaaatttcatatgctttacaaaacgtgcagccatccgggcacacaaacaaaatgcccacttttggatgtgaaagtgggggcaggagtttttcccatttaggagctaaaagctctggagctctggtcctcagattcatcttgtgtctggcctgtggtcgcagtgagatgccttttcagtagggatgaggtatacttggggctgggagaggggggacatttggaggtctggcctcccaggggtaggtatgtgtttagccgggctatgcagatgaaccaatctgggtgtctctgtcagggaagaggctaggaaagctgctggtgagaggggtcagagactggtttgccccaagggggatgggggaggcagggaggctgtagaggagctgttgggccagatcttgttgagaaaatctctcagacccgagacttctcccctcctctcatttcctatatttgggctttcacacttaagggactggtcttaaggagagatgtactttttaacatttgatttgcccatgttgtgccccgtacttctgcgtaccaccagaagaccacaatgacaaagaccagcgaaggccaaaggtggccatgtgtgtatagaattgacactccaaggtcaccggatctgcaatctaccaaacagtcttgactcacaccctcaggtttcatatttgaacctcctttgcagggctggtcctggctcctttcaccttctagactgcctttcctttcttactgtcctctgagaggcacactgaacatctgtggacagtggcagttggtagctatatatatacatgtatatatatcagaatttcctctttgtacactgtagcagtggacttccattttgatgatattatacagggtataaatctgcctatctcaacaagttgctttaaagaagaatcagtttcaatgtccaaactaccacttcagtaaagtaacagagccaatgccctgtgtctttttcctttatttatttatttattttgacataggttcttgttctgttgctcaggctggagtgtagtggtttgatctcggctcatagcagcctcaacctcccgggctcaagcaatcctcccatctcagcctcccaagtagctgggactataggcacatagctaactaatttttaaaaattttttattttgtagaaatgaggtttcaccatgttgcccaggctggtctcaaacttctgagctcaagcgatcctcctgcctcagcctcccaaagtgctgggattacaggtgtgaaccaccatgcccacccccctttttcttatgaatgggtgaagcaggagaagagcagtgagtatggctagagatgctgacaccatgtagtatagcaacttgtgggcttctgccttcttcctcaagatgaggccaagaagagcactgggacttccagcctctggtgcatgtgtttcctctgggctaggtggtatgtggtgtccaggtatctgcacacttgctcggggcagggttctaagcagtggatggtggcaatggatatggccaacaagagacaatcatggcagtgtcactgagctgtgaactcccacagaatcttttggcctcccaagctcagagaagaagcttaagggagaaaacctgtcaacagtccttttgccatatttattcactggagtcacacttttataacaggcataggctcaaaggtgtaaataaagccaattattttagttcagcattgattttcatatataaattatcaatatagttttgatttagtaataaaaataacagcctggagttttatcccctgccatggccagtgagagctgtttttaagctgtttctttgtacagggaagcatgtgtcaaagtcacacctcctgattaataaaaacaataaccttttagtccttcctatgttccaggcattgtgcagagggctcacaaatactatttcatgtaatgctactcataattctctgaggtagattagtatttgtatacgtatgttatagacggggaagctgaggctcaggaaatcacttacccaagacagcagctggcaattctaagaaaatttttgaaattctaaaatgcatctgaggacctggcactgtggctcatgcctgtaatcccagcactttgagaggccgaggtgggtggatcacttgaggccaggagttcgagactagcctggccaacatggcgaaaccccatctctactaaaaatacaaaaattagccaggaatggtggtgggcacctgtaatcccagttactcaggaggctaaggcacgagaatcgcttgaaccagagaggtggaggctgcagtgagccgagattgtgccactgcactccagcctgggtgacaaagcaagactctgactcaaataataaaataaaataaagcacgtctgctgccttcacaccccattttctgtaccatgcatgtcaacttctatagggcccttctcttgtatgggtgtccattaggtcatatcttgcagatatggcagagctagagacctagaggtaaagcaagatactaggaaaacaagtaaaagggagctattttctgggagactaggaaaaagaagagactaggaaaagtaagtgaagaagctctaactagtagggggccaataaggggcaaacaaaggagagaagctggctgcttagctaaccaagtagagagcctcggatctggaaggaactggaccgaacatctgtaactgggcagggctggccttgggcctgtcttgacttccttgaaatgtctcttttacctggcctccttctcatggctgtcatcaagcagccctgttgatcatgttcctgaggaaggacagaatggggttggggagattaagtttattagcaaggcaatttcctctagggagaccccaaacctggcttggtaactacagtgaaaggagagcgtttgagccccttcccccttctgcttgatctcctctccttcaccaggctttcttcagacctggttccaatcattataaggcagatctaaagccactcttcctgacactgaaactttgctgagcctggaaaaatcacagaggctcagtttggtgtttttgcatgcaaaatacgagaggcagaggtgaaggtgcattcctggtgccctgcggttcccaggcagtatctgagtgcattttcacctgttatcgcttgcctttcaaatattcgttagctcccccagaagtttagccacgagtcatcttctaggggaaatagctgctctgctctgtttgtagaatctcatagtttattttggaatgaagatgtattttcctggaaaagtgttactactttacagtgtccccttcatctgcgaaactgaaaaggcaggcagccttgctgtatgagaagaccacacacttgcggacagaaaaaagatgcatccgggcttctcttcaagtccaagacaattgatgacaaaggaagtatgacacaaacttattgagatctgttattatccttgtgctgcccgggttttagacaaaaacaataagcagattacataagtgagtgtcaccacttttgcataaccaaggtttcatttttctcttctcacttggttagtcttccgtgagctaagcaacatcatggtagttttctgtagtaccacttatggctttccttgttatcatcacctgcctttgacacatgccttcattaatgagttgatatatttaattatatgttatacagatattttatattacaagcaatgttaattgcattcattcagaacagctcccaattaaaatctataaactacttagacctctataaaaatcccaccatttaccttacagcttcacattaatatttaccctggagaggataaacatctcatcctgtatttatctgttagatcatttttgttgtcataaaaaacaaaagccacatgtttaattggatcccttcggtatgaatttttaaaataatagtaggaatccttacttgggaagatggtttcatagggcatcctaaaaccatcctttgttccaaatcctttgaggatgcacacatttaatgttttccttcttactactatgctatgaacttaacagtgctacatgctaaagtacaggcagcagaagttctctgggaaagtggagatccctagcaagtaaggaacccaagagaaggccattctaagctgtagtcccttgttggaccaagggaggaaggaaacagatagcatccacctggcgctgcaattctactggcctgtggggtggtctggctttaggaagctcactgtgtaatccatcagaggacaatcctgccaagtcttcttttcaagtaaaaaatgttaatgtttctttccatactttgtctcataatcaatattcaattttcaaggcagtaaaactaatcaaagaatataaaatgaatccaacacaagagaaaggagggagaatgagtaagctgcaaatgggactgagcaagaaaataggaggatattataactatagaattttttttttttgagacagagtcttgctttgtcacccaggctggagtgcagtgacgcgatctcgactcactgcaacctctgcctcccgggttcaagcaattctcttcttcctgttggtgaatttctcccaggaggcatgagccaagatcctgtttcatgggtttctgggtataccccttgaaacaccagagtcaggagtcaggaacaacacctagtgtattagttggttttcacactgctgtaaataactgcccgagactggataatttataaagaaaagagatttaatggactcaaagttccacagggctggggaggcctcaggaaacttacaattatggctgaaggggaagcaggaacgtcttacatggcagcaggtgagagaagaaagtgaaggaggaacagccaaacacttataaaaccatcagatgtcatgagaattcactcactgtcacaagaacagcatgggagaaaccacccctatgatccaatcacttcccaccaggtttctccctcaacacctggggattacaatttgagatgagatttgggtgggggcacaaaaccaaactctgttacccagttagaaaccggccagtcagcatgtagtccctctggagctcacaattgcagatcatggtatgatggagttctccactgcacggtaggctctggggcttaggcaggcatatggggcagcagtcaacataggggatggtgggagtgaggtgctctacagcagtggtcctcgacttttttagcaccagggaccagtttcatggaaaacaatgtttccatgggcttagggggtgggagatggtttcaggatgcttcaagtgcattacatttattgtgcactttattttgataattattatgttgtaatatataatgaaataattatacaactcactataatgtggaatcagtgggagccctgagcttgttttcctgcaattagatggtcccatctggaggtgatgggagacagtgacagatcatcaggcattagattctcataaagagcacacaacttagatccctcacatgtgcagttcacaatagggtttgcactgccatgagaatctaatgccactactgatctgactggaggcagaacagagctcaggcagtaatgcaagtgatagggaatggctgtaaatacagatgaagcttagctcgctcatctaccgctcacctcctgctgtgtgacccggtccatggcctgagggttggggacccatgctctacagcactgttatggcatgttccagactcttgagaatcggtccttccttgcatctcacctcaccttcaactttattgttcacttttagttcaacctttgccagcaggtaaagaggtaaagagaacaatgtgtcctgtgaagtatttatgagagaagcagataaatcattagatttattgagaacttttgaagtgcactaggcatctcacacacattacttcattgaatcacctccataatcctatgtggttgataattatattatccccacattctggatgaagaaagtggagctcagagaggttatcatgacatacatactgctcacaaaaccattctgtggcagaagtagattcaacagctcaaaaataaaagagggctgggcacagcagctcacacctgtaatcctagcacttttggaggctaaagtgggtggattgcttgatcccaggagtttgagaccagcctgggcaacatagtgagaccctgtttctaccaaaaaatgcaaaaaacaaaaattaggcaggcgtgatggcatgcacctgtagtatagcttcttgggaggctgaggttggaggattgattaagcctggaaggttgaggctgcagtgagcagtgattgtaccactgcactccagcctggatgacagggcaagaccctgtctcaaaataattaaaaaaaaaaaaagtaaaagagaacatgatgatttatggggaaattgacactaaaaatgtcttggatgaaataaagtgacccaggcatcaggatttaggggcttacatgggataacactgttctactccatagcacctcacctgtctaattagtgtctaattagagacatttttaatcagataagtgcatttatgaacattgcaatttttcccaaagtttaaccatcagtttctctgaaaggacttctaaagcctagaaactcacctcttgttaatagtgctgctcttcctcttaaggattctgcccaggagttcaacaccagcctgggcaacataggtagaactttgtaaagtggaataatgctattctaataacttatttagcaaacatttactgagcaattaccctgggtcaggcctccttgcaaggttctggggacatagacatgagggaattctcacccttgaggccatcacagtcagctagggaagaaaagaagtaaacagatcattataaaaccctgagataagtgctactgtgaaggtatgtaactctgtcccctgggtgctttggaagtgtgagagcttgggacattgtagcaggatgttggtagctccatcagatctggagtcttttccaccttgaacttgagatcagcctaaagccaaacacttgacttttaaatgatttgattttaacagaatcaactttttattatgcaaactcaaaagatgtattctgtagagttttactgagccttttttccctttaaaataactaactatatgttttgacatgcttcaggggactttttttgtaaaatagcacaaataggacaatactggaatacatcagtgtgctgtgaagcctgaatgagtaatacacaagtgactgcactttcaaaaatgtaaagaaaagtaacatgctaaaaatcataaactacaaagaggcggcatagcttggtgagacaagcgttgacttgtgaacaggaaaaaaaggatccctgctggctattctgctgagtgaccccaggaggtccctgttcctcttgggacctcagtttcctggttggtggaatgggtattggatgagaatctcaatctgaagatctgcattccctttcaagtcgctaaaatcctggacttctacgataatgctgcatccttctgaggttccaaacaacaatatgcagtaggggccccttttgcttccttccttgcatgtatccaggcagtctcctgagagcatccagcattggggaggaatggggtgtattgaagggaaaagcaggtgccccattgggaatgggacactcccgccccccgccctacctccttctttcaacttgacttccttttttttttttttttgagacaaagtctcattctgttgcccaggctggagtgcagaggcgcgatctgggctcactgcaacctccacctcccaggttcaagcgattctcctgcctcagtctcttgagtagctgggattacaggcatgcactattatgcccagctaattttgtatttttttagtagagactggctttcaccatgttggccaggctggtcttgaactcctgacctcaggtgatccacctgcctcagcctcccaaagtgctgggattacaggcataagccaccgcacccggcctcaacttgactccctttcttgtcactgtttctagatggtcaactagatcaatactcagatcagctcttctttcagaggaacaaatgagaactttcctcttgttctccatctcctccttctcctaatgcacacacatgtgcatacacacactccactgccatcactagagagaaggaattaggtccaaacctctgttcgcactcagagtcttaaagtgacagctttacgtttacaagttaggcattaaatggaattccattctccctgtcaagtttcagacaggggaaagcccagaattccaatagtgatggtgttcttggcaagcgctttttacagggtggtaagctaatcagtctgcagttcggcagtctgaaggcttgagctttcatctgacttggaatatataaagggcttggcattgcagcttccaaccctatgacttagctttgagcttcgcatcttcccatcaacttcgtagctctctccatcaaccaagtacccactacaatcaaggagaaaggatatggcagattaattgaatctttgtgtctttttagcacctgtgggctatggacttcttgaaattggagttacttttattcctttgaattgagcccaataccccgcttcagtcagggtgcttttaccttcccagaatcctcttgctaaggacaagcaggcaggctaatcggggactactgaagttttctggctcaaagaacataatgcagtgtgtttacaaatccacctcttcgccttcaccctaaattttcctttcctttatatgattttagcactttgggtttacattaagctctcagttacttaaagtaggctgaagaaaataagaagtgtagtagtgcttcactccccagtgatgaaatagggggtaattggctccaaaaatcgttgcatgtcttgtccctttcagggactttaactgctctgttgcccttgctccatggattggggctgcatcagtagcctaatgtgaggggaatggttgaaagtaattgtcagagcccagagctccacttgccatggaaagcctattgactttaatagtgaccatctggctgggcacctctgaagatgtctcagttaaggcctatttggtgaatggacctttgcttatttgaaagctacactgctgttccaacctgatcattgcattttatgtgatgggcactggaagtccaaatgaaagtttcttagaaaacactcccattaaatttaccagtccatgtgtgattgccactttcagtgcagtcagagcacagtcattctctttttattgaaagcatatggtaggtacttagagcataccctaggccagactcagttatggtgccatcaagggcagcaagaattaaaaagaggaaaatggtatccaggtggcagtaggaattcggtaggttggatggaaaatattcatagttaacgagctttcataaggagaacagaaacaagttagatgtgatttgcagatccataggcaatcagtctctgctgagcagaggggaaacttggagaagattctcagaagtgtgcctcacccttgacccaaacctttccctgaacatgtgcaataaatattattaagctttgagaatttctttaaaataatatctgtcaatggtaagtgccacatgccaggccctatgctaccagcatcatctcatatcatcctcacatgtatcctgtgaggtggaggatactatcccaatgttacagatgagaaaactgagacttaaacattaagttgttcaaggtcatacagctaagaagtcacagagctgctttgattaaagttctgtctgaggctgggtgcggtagtgcatgcctgtaatccaagcactttgggaggccaaggtgggcggattgcttgagccctggagtttgagaccagcctgggcaacatggcaaaaccctgtccctaccaaaaaattacaaaagttagccaggcatagtggtgcacacctgtagtccaagctacttgggaggctgaggtgggagaattacctgagcctggggagcttgaggctgaagtgagccaagactataccactgcactccagcctgagggacacagtgaaactctgtttcataaaaaaaaaggtctctgtgacttcaaggcctttgttctctatactattaggaagtccagtaagtgaagaaaagtacatgtaaatttcactaaaggatcacagcttcttgtacggaagggctttgagcacgtcggctgtggctcctgtgcagccagccagatctgcctaagcagctctgggagtagggccacacaggaatctgtcacagggaggattccacattccttcagcccctatcagcacagtcaaagaatggtaagaagaatgcagagggtggctttgaaatactcacagccttccatggataaaccatggagacattacactcatttgatagaagccagacacaaaaggccatattattgtatgattccatttatatgaaatatcagaataggcaaatccatagaaacagaaagcagattcgtggttggtaggtgatgggggaaagacttcagcaccatccccttccctctcagtctcagtgaagtggaaggaaggagtagtctcagctagggaaaagaggggaaaagctgaagacgacagatttctatgtctcccagtttaattacctttccctttgctctcgcctatgaatgccactgcctgcaggttcttagggaatcaaactgggacttcagtctggaaatgtgctttcaggacaaagacccatgcatacgagacaaggtgacaatcctaaggtggcccccagtacttcggggcagtggaaaggaccttgcgatgggtgccagaaggactaacatcaaggccagctctaccatgtctgaggtgtatgactgtgggcaagtttcttcattacaacttctgcaactgcacagtgactagcataatcctttcccattaggcactgctggatcattgcaaagattaaatgagggccaggtgcagtggcttacgcctgtaatcccagaactgtgggaggccgaggtgggtggattgcttgagcccaggagttcgagaccagcctgggcaacatggcaaaacccagtctctacaaataataataataataataataataataatcatcatcatcatcatcatccaggagtggtgaaatgcacctgtagtcccagctaatcaggaaactgaggtgagaggatcgcttgagcctgggaggacagggctgcagtgagccatgatcatgccactacactccagcctgggcaacagagtaagaccctatttcaaaaataaataaataaataaggagacatatgtgaaagcatttccgaagtctaaagctccacatacacataagtgattataagaaatttaacaaagggtagtcacataattgacattgtcctttggaggagagaaaattggtgctatccccttggtggacaggttccctcatccttaaagcacatttccagagcagaaggaagccttcatctaagtccaagcgctacatttctgatatgagagctagtttgagatttaaatgaaccctgtctctcaagacacagctttgcatctattttgcattcaaatttatttatctagagacaaaattgtgcattctttaattctactcacagcgtatgcacgcagaccaaatgaggtgctgatccagcaaaacggcaagtagccttttgcttccctgaaattgctaattttacaaatggcagagtggtgaaacgtggcacggaatatctattttactagaatccggcaaaacgggcacatatggtcttgtcaagaatgaatcaaacacagtttcgggattataattaagtagttgaaattccaaaaggaagaagttaatatgaacaaagtgagatttcgattgcttttggttagcattctctcaggctccttcctttacacattatcaggaacatagctactttgatttcttgtcctgaaaaatgtttaattgtaaaatatcaaacgttttcaccccaactctaattgtacttgatttgacatctgtacaccatgctcagggtaccaaatattattaaatgtaataagtccaggcatagaagtcaagccaaatgttcctacgtaagtatttaggttgacaccttctgtcaacaaagctaaacctctgaccaattctgtagcaggccaataaagatacaggaggaagatgggaaccattagaagaaaacactctctcctcatctctctctctttcagtactgtttctacctgaaatcagggacatattccattctggtccacaagcccagcatctagcacaggggctggcatgtaaaaagagttgatttgggctgggcgcagtggctcatgctgtaatcccagtactttgggaggctgagatgggtggatcacctgaggtcaggagtttgagaccagtctgaccaacatggtgaaaccccatctctactaaaaatacaaaaattagccaggcgtggtggtgggtgcctataatcccagctactcaggaggctgaggagggaaaattgcctgaacccaggaggcggaggttgtggtgagctgagattgcgccactgcactccagcctgagtgacagagcaagactccatctcaaaaaaaaaaaaaaaaaaaaaaaaaaaaaaggagtttatttggagatttgcaacttgtcatgggaaacattcccagggtttcttctagagttgttgtggacctgattttgggtgctaagtggtaactcactatatcttaaaaacacatcagctaaaaggtggaagcaatctacatgcccatcaactgacgaaggggtaaacaacatgtggtatatccatataatggcacgctatttattcataaacaggactgatatatgctacaacatggataaactatggagacattacactaagtgatagaagccagacacaaaggccatttattgtatgattccatttatatgaaatattagaataagcaaatccatagagacagaaagcagattagtggtgggcaggtgatgggggaagagggagattggtagataatagttaaaggatatgaagtttctatttgaggtgttaaaaatgttcttaaattgattatggcaatggttgcatgactgataatatactaaaaacctcaaattttacactttaaatgggagaattgtatggtatgtgaattatatttcaataaagctgttatataaataaaagtttacttcagattattttgatgtgcacttgcagttcagaagcttgagctagattaacagttcctaaccttagttttggctcctaactcctgtctcctctcagatcttaggaccttcaggttccacacagcctaccttgctgctacctagtttttgaagttctaattcccgaaacaaagaactcccttgaagagcattgatgccatggcggaggagaggaaacaagaacttttggttttaagctgtgtctacacttaaccaccttgtgcccacttgggtaggtgctctatcattgaggatcaggacccaattattcccattctcatgtttttccaggacctgacaaatcctaattcagattgctattccctttgagagtgaaatagcttaggtacgtttcttctacaacaatgcagatattctattaatgaaaggagctgctacaaagtaatttttaatgtttatataggaaagtgtaactttttttttttctggagacaggctcttgctttgttgcccaggctgaagtgcagtggcacggttatggcttactgcagcctcaatttcctgggctcaagtgatcctcccacttcatcctctcaagtagctggaactacaagtatgtgccactacacccagctatttgtttgatttttttttttttttgtagaaatgggctctcactaggaaattgtaagaaaaaggagtagctttcttaaaaccctggtttaacatgacaaacccaaaacattgagctgtacacttcattggttaaatcttctttttgcttatttaaagaaaggacaagaaaaaagaaaagaaaaacttttttgctagttcacacctcaaggtacacccagtttctgactttaaagggaatcagtccaaagtaacaaaatattattttgacatctgaaaaagaaaatgctcgttttataaattggatagtgatttctaaccattgttgatggacatagatatcttttgttaaagcctcatcaataagctcatatttctaggagatcatattgcgatgagaattatgaagagggaactggaggtccatgctggaaagtcagtactcctttaattcaactaaaaatatttattcaatagttaaatattgactgtgatatcaagtattttgaatgttggtaaaaattaaaggttttggcaaaatagacaatggtatacttacaagttttctgagggtggttcccagaatatattacccaaaatactatacagtgagaagtgatagtcaccattccatgtctttgaccacaaacatatcttaagattttctttgaagagggttttttagctttttgagacagagtcttgctctatcacccaggctggaatgcagcggtgcagtcatgggtcactgcagcctcaaactcctgggctcaagcaatcctcctgcctcagcctcccaagtagccgggactacaagcacatgccaccacatttggctaattaaaaaaaaaaatgtagagacgggatctcaccatgttgaccagactaggctggtcttgaacttctggcctcaagtcattttcccaccccggcttcccaaagtgttgagattacaggcctgagccaccacacccagcctgaagagggtttacaaaattatttcaccaacatgtaagaaaatgtaataggcattttaaagtttaaccattgtcagtcactcttttaatgccttagtacccagaacagtgctacttttagagatacgtatgtatctattttctgaattcatttttggttgcaaagcatcattctacaaacattatgaaagagagccaaatactgtgacttcaaggattatccaatactctataattagtttcatgaccaaaatgctttgaataactgaaaagatgagtgaatgactggatacatgaatacatatcatccatttatatgaaaatacttttgaatacaggcatatcttagagatactgcgggtttcgttccagaccaccccacaataacatgaatattgcaaaacagtgagtcacatgaattttttggtttcctagtgcatatagaagttatatttacaacatactatgttctattaagtgtgaaataacattatgatgactaaaaaatgtacatgccttaatttaaaaagagtttactgctaaaaaaaagaggctatcatctaagctttcaatgagttgtcgttgttttgctggtgaagggtcttgcctcgatgtgcatggttgctgactaatcagggtggtcgttgctaaaggttggggtggctgtggcactttcttaaaataagacaacagtgaagtttgccacatcaattgactcttcctttcacaaaagatttctctgtagcatgtgatgctgtttgagaggattttacccacagtaaaacttctttcaaaattggagtccatcttctcaaactctgctgttgctttatcaactaagtttatgtaatattctaaatgttttcttgtcatttcaacacgattattcacagcatcttcaccaggagtagatcctatctcaagaaaccactttctttgctaatccttaagaagcagctactcattccttcaagtttgatcatgagattgtagcaatccagtcacatcttgctcctcctctaattctagttctcttgctgtttccaccacatctgcagtgacttcctccactgaagtcttgagcccccaaagtgattaatgagggttggaatcagcttcttccaaactcccgttaatgttgaaattttgacctcctccattgaattacaaatgttcttaatgacatctagagtggtagatcagttccagaaggtttttactttacttttcccagatccatcagaatcaatatggcagctatagccttacaaaatgtatttattaaatgataagacttgaaagttgaaattattccttgatccgtcaactgaagaatggatgttgtgttagcaggcatgaaaacaacattgatctctttgtagagctctgtgtagatctccatgagagctctcaggtgaccagatcagtgagcaacaatattttgaaaggaatcatttttctgagcagtaggtctcaatggtgggtttaaaatattcactaaatcatgctataaacagatgtgctttaatccaggttttgttgttccatttatagattactgactgagtagatttaacataattcttaatggccctaggagttttgaaatggtaaatgagcattagcttcaacttaaagtcatcagctacattagctcctaacgagagagtgatgctgttcgttgaagctttgaagccaaatatagatttctctctagctatgaaagccctagatggcatttacttccaatataagtctgattaatctacattgaaaatctgttgtttggcatagccaccttcataaatgatcttacctgtgtcttctggataactggctatagcttttaactcagtacttgctgtttcactttgaacttttatgttctggagacagcttatttccttaaacctcatgaaccaacctctgctagcttccaacttgtgttctgcagcttcctcagcactcttagcctttacagaattgaagagagttagagccttgctctggatcaggctttggcttaagggaattttgtggctgttttgatctatccagaccactaaaatgttctccatatccgcaataaggctgttttgctttcttatcatttgtgggttcaccagagtggcacttttaatttccttcaagaactcttcctgatcaatcacaacttgacaaactgtttggcacaagaggcctagcttttaccaagaggcctagttttcagactatcttggcttttaacgtgccttcctcactaagtttaatcatttccagcttttgatttaaagtgagagatgtgggactctttctttcacttgaacacttagagaccattgtagggtagttactggcctaatttcagtattgttgtgtctcaggaaatagcgaggcccaaggagagggagagagatgaaggaatggctagttagtggagcagtctgaacacgcacaacttctaccaattaagttcaccagtttatttgggtgcagtttatggtgcccgcaagtaattacaagagtaacatcaatgatcactgattacagatgaccataacagatatagtaataatgaaaaaatttgaaatattgtgaaaattaccaaaatgtaacacagagacatgaagtgagcacatgctgttggaaaaatggagccaatagacttactcaatgcagggttactacaaatcttcaatttgtaaaaatcccagtatctttgaggcacaatgaaatgaggtatgcttgtctctactttctgaatatgcttttggttgcaaagaatcattctgcaaacaacatgaaaaaagatccaaacactgagacttcaaaggttattcaataccctatcgttagtttcataaccaaacaaagagaaatgccttgaataaccaaagggatgaatgaatgaatgatggatagataaacacatgtcatcaattcatccaaaaatacctcttttttttttttgagatggagtctcgctctgtcacctaggctggagtgcagtggcttgaactctgctcactgcaatctctgcctcccgggttcaagtgattctccggcctcagcctcctgagcagctggcattacaggcatgtaccacaacgcccagctaagttttgtattcttagtagagatgggggtttcgccgtgctcaccaggctggtctcgaactcctgacctcaggtgatccacctgcctcggcctcccaaagtgcagggattacaggcgtgagcctctgtgttaaaaatactttggagtatataggccaggcacggtggctcacgcctgtaatcccagcactttgggaggccaagacaggtggatcatgaggtcaggagctcgagaccagcctggccaaaatggtgaaacccccatctctactaaaaatacaaaaattagctggacgtggtggtgggtgcctgtaatcccagctacttgggaggctgaggcaggagaatcgtttgaatctgggagatggaggttgcagtgagctgagatcgcaccactgcactccagcctgggcgacagagcaagactctgtattgaaaaaatatatatatatattatataaatataataatatattataaatatatacatatatatacatatatgtatatatatgtgtatatatatatgtgtatatatatatgtgtatatatatatgtatatatatatatatatatacatatatatatacacacacacactttggagtatatagttttaatggtggtaagtgctctaaaagaagaagcaagtgctatgagagcatatattagggacctttgacccagcttgggatttatgtttaatttgagacgtgaaaatgattaggagctaagaggggttaggctggagagagggtccaggtagagacaatatgtggatccaagaaggaagaacaaagggatcaacaaagtgatagaaataggccgggaggggtggctcacgtctgtaatcccagcactttgggaggctaaggcgagtggattgcctgaggtcaggagttcgagaccagcctgaccaacatggtgaaacctcgtctctactgaaaatacaaaaattagctgggcatggtggcaggcgcctgtaatcccagctacttgggaggctgaggtaggagagtcacttgaaaccgggagccggaggttgcagtgagctgagacagggccttggcactccatccagcctaggtaacaagagcgaaactctgtcaaaaaaaaaaaagtaatagaaacaaagacaggaagcaaagagaaagaagataatgacaaggattaaagatgcagctttgaggatggcaaaaccgcagagaggagaactattaggatggtgcaaaggtaattgccagtttcaccactaaaagtaatgacaaagctcaaggtggtggtaggagggacagctgagtgactcctgagaaaatgtaaagtgctgaacctttgtagtttggaagacttggttaaccagaatgattcattccccaattatgccacatcttcaagattttactgtaaaagcaagcaggctggccctggcattcctaccataagctggtgcttcaacttccacatctggcagaggctctagatgtcacataaattgaacatagtcatccagctcaaagggggcttggggtcattgagtccaattttcattttatagctacaaagtactgataactaaaatttacaaagtaatgcacacgtggcagccactgttctaagtgtttactgtgtattaccccatttaaccctcagaacaacccagtgaagtagaaactattatgattcccatttacagatgagggaactgagacacagagaagttaagtgacttgcctatggggtcacacagctcattagtggtgctgtagaccttgggtataatcacttgtctgtatctctcaaaaatcatacagctggatagcagcagatccaagaatggactcggctgtctcccagtgcagtgccctttctactatggtaaccagaactcgacggtgctccctcagttggttgtaaataacataatcccatagtaattgcaaggatgagaatgaacttttcagtctccctgtccccacgtttttggaatggttctacctctgagagcacatgaactcagcctagttttggggctggtctgcccccaattttaacttccatcatggcattgccatttgaacagtgagtgttttggagctggcagaaggtatttttgcgcttcaattcaattcagcgatcgtgttagaagccatcctccaagtgtccaatgatgttagtgtgtccctttgggagtgatttatagtcaaatgggctgcattatagggtgatgtgctgaacaggggaccaaagtatgaccagcaatgctagagattagatttcaaggtcgttgagtaaacctgttgtcaggatttccagggatgatttgattgggaagaaaatgcatctttgtttcatcatttcaaagcaattttatgctttggttctccccgtttctgtcttctgaacacttccaaggccacacttgagcctcagcatcagcctgaagtcttgtgtgatagagttgccatgcaaggtctctctgggggtatgttgaaagctaccagtaagacttgactttgataaaacgtttaattgttttcttttgcctcaattaagttgagaagactcaaatgtagcttttaaattgaaaagtgtaactgagtgagaaggtttatatcaaatattgaaaggctaaggagccttttaatacattgttagctgtcaatgtgtttcaacaaattgtttcagtcactgttgtgtttcagtcactattacaactggggcctgcaatctgaagtgactcaggggtccatatctctggacaaggatatccacttttctgaaccgaaccaaggacgaggtagagtgggacagaaaaggacagattctagagagctttcccaagggacacgtctggcacctggaagtggtcgagcctaatgtgtaaagatttcaaataccatctggtcatttctttaggacctcatttgacaatctgtgggattgttttttgatgtggtgccagcccgaccaaatgaagtttctttcaatggtgtggttggtgtctgctgagaaagcagaagagggggctcttgtttagctcacaaccattgtgtgttaggcattatgcttgagcattttacatgttctggaagtattctcaaccctggctgcgatttcagtcacccagggagcttttcagaaacactgaggctcacacctgtgatcccagcacgtttggaggccaaggcgggcagatcacttgaggccaggagtttgagaccagcctagctaacatagcaaaaccctgtctctactaaaaatacaaaaactagccaggcgtggtggcgtgtgcctgtaatcccagctacttgggaggctgaggcaggagaatcacttgaacctgggaggcgccggttgtggtgagccgagagtgcaccactgctctccagcctgggtgacggagcgagactgcctcaacaaacaaacaaacaaacaaacaagcaaaaagagacattgaggctcagttcccatatcctaagattctaattcattcagtcttaagtaagaatcggggcgtttgtaattttaaaggcttgtcagatgactcatgtgcaaccgaggtggagaacccctaacttagagtgtcttgttgaatttggggatatttttctgctctgctcatccatccgcttgcaacttagagggagagtcacattcttcatggtgacaagagtgagaagtgtatacgttggcctcaatactccgaatgcctgtgccaaattccttcggcaccttgctttgatggtttggattgcctccctctcctgcctgattccagctaatattgctagctttccaggcgaatatttttggcaacccttgccttctgcattcaaaagaattgcttgccttcattactttatgactctcccagtgtgcaaaagtctatggagaggagacttttaggaggccccaagcaaataaggcctcatcttccatttaaggcttcattcccaggaactttcccaatacaaacctcagtgctcctgggctggccttgctggagagggcttcctgaggcggagttattgggacctgagggaggggttcctagagtgcagcaattccagactgaaattcccaggcttggggtctccctgggaattccctcaggaggaccctgtgtgcatttgggtgaaagaaagctattgttgaggaaatttgccctgccagggaccccagggcctactttgggtgtgtgtgggtgggtagagatgaaggggaaagttccagctgcttcagatggtggcgaatgacttaaacaaacaaggactggggcttggaagaggagagactgcacgtgcctgggcaggtttcaggttcctgacaaagagacaaatctgagagagatttacagacaccctctccatctatcacacaaatctgtgtcaagattttgagtctgcaaaacagcaccagcattatttcattgtctctgtgatttaggaaatgagattgaacacttgtggaatacccactgtgtgccaagcaccaggcaccagggtattcattcacccatatgttaccctagcaaatgatttgattttcaaagtatgccctgaagtgcctatgattactatcccaattttatggatttagaaactgaggcccaggtcactgacatgatttactcaaggttacacaaactgtgtaagaacctgggttaacctgacatataattgaagttatgcttcttttacttcacctctcatgaccctcttcccctatgtctttttaaaaggatatacatattgttacttttcttctcctaaatgttgcctagatttgctttctccatagtttcacctttcattcttctttggttcctgaatctggcttctatcccagcatctccaatgaagcagtactcctgtaggtcatttgatgaccaaaccatcaaacccaaccctaatcagtccttatctaacctgccttcatagtatttagcatgaatggtctctctctctctcttgaattggactatctcattcattttcataggtgtaccagctctatgctgatcaatctcaaatctacctctgcagtcctgacctctctcctaagcttcaggcttatccatctactgcctactagacttattcatctgggatatcctacagaggctccacacactcccaaaaggaatccagcatttctcctaaccaccaccccattcaaccccctttgcaggatctatgaagccagcaacttgggtgtatcttttccctcacccactcatctaaatcagtccatcaagttctctccattctgttttgtgattatttcttaaagacgatctctctcttctctacgcccaagactccttctttaagtgaggattcttttcaagagccttctaaaaagtctctctgaatctgcttcactgcatgagtctgttttccatgccgctgacagagatcttttgaggtgctaattaaactgttccatggctctcagaacctctattttccaaagtacatttgcaacctatttttccaggatactctgtgaaaaataggaccactgtggtcaagtagctttggaaactttctgtgtactatactttttgtttccttttggagattcagatagcatattaaatgtcctgagaatcccttaagttaaaaacaggcttacatttacatacttcagcatcccaaatggatttcatcatggaatcacccctcctcccaaacactcatatttttaagcatgagtcctgctcacaaccttctgcagaacacatttgaaaccacaggatgaatgctgtgatccttggcctgccatacaaggctcttgttcatctgacctctgttcacctgttgatatggttaggctttgtgtccccacccaaatcacatcttgaattgtaatccccataatccccatgtttcaagggagagaccaggtggaggtgattgaatcatgggggcaattcccaccatgctattcttgtgatagtgagtgagttctcatgagatcggatggttttataagtagcagtttcccctgcctgtgctctgtctcctgccaccatgtaagacgtgccttgcttcccgttcaccttccacctcaattataggttccctgaggcctccccagccatgtggaactgtgagtcagttaaacctctttctttataaattgcccagtctcgggcagttctttatagcagtataaaaacggactaatacacttgtctagccacctctcccccttaaattctcactactctcaccattcttgagaatactcatcttcctcacatacctctgtgttgtggttttgtttttgttttttgcttgaaaagctattcccctcccctcaccatctcggcctgccttcaactcatcattgaagacccagctcaactgtcttcccctctatgaagctttctcttattttctgcaagggagaagtagacaccccttctttttacttagaatcttcctttataccttgaatattacacttaggacatacgaagttattctatgtctacctagccttttaacctttcaaaccaattgggttattgtcttatatcttttcatgttatgactacctttatctcctgtcagaagtttggactcatcactgacccaacagaaaacagtcttatcctttctagtttttggtaagacagtgtatgtgagaaaccttacagttaggtatgggtggaggacatgtcaatccagagtgtttgctaatgtgttcagctacagtccacaatagcatgtgccacagtatgctgtctcacctagatggtgtgtagattggcttgattgtaggtatatggtggataataacatcttggcacagaaacaaaacccaaaggcaccttatcccctgctcctaagacaggctcaaggctcagcttcagctagttagcctggatctgtattcagttttccagtcatcttgaggctgggggctcggagtagcagcccacctcatgaatcctgctcgtcagtaaggggaatattcattgtcaagggcttactctgttcaggcactgtgctaagtctttgcctgcattatctcatgtcattctcacaacaactccattaggtggaaactcttattttcatcatgtaacagatgagtgagcgcactgaggctgggcaagtaaaatgacctgtcaacgagccatagcttcaggccctaatccagcctgtggcactgccctgatgggttaccttgggcaaatcaattgatctaactgagactcaatgtcgtcatctgtaaaataggaacaatactagtgtctatctcatggaatagttatgagggttcaatgataggatgcatgcaaagtgcctggcatagtgcctgacacttggtaagtgctctataaatggtagctattatgcgctcacatcagagacgttgttttcagccaggatgaagggaggcatgagggcagttttatactgaaggagagggtaggtctaaaaattatttggatgatgaaaaggtcacaatcctttgggaggcaaaggaggaaaaatttatcttaaacacagggagggagatggcagccaggtaccagaactcttgatgtgtaaagggctggccatatggagactgaacaaagtcagtgaagcttggctcctgtgcaaatcagagatgggctcaacatgtattccatgtagctgatcttgcatgtgcacggtggtttctgatgcctcccccgtaagggcagcttcatccactcctgtgagaaatgcagctcacagatgtggaggaccatctggagaagggatgtgagtgaaggtgggtgactgacagtgggtggagctggagctagggactcaggcggcagacctactgggttagaattacgactgtgccacttgctagctgtgtgggtttgggctatccactatctctctgagtctcagtttccttatctgtaaactggcaatagtaagggtaccaaccttatagggttattgggaggaacaggggaatttattcctgtgaactacttagcacagaccaggcacatggtaaaggttcaagaaatgctgatttttcatcattattatgtgttctggacgtggcaggggagatggggccaatgtggaggatcatagggcttgctgaaacagtcccaaatgaatcttcttcaaattaacctctgcaaatattgcctctgcctccattaatttagagaagctttgcattcttttctcttaagtttattttgcagctcatgtcttaatgagctaaaaaaaaaactatagaggttttgatccaatttcagactaccctgtaagatatcagcatctgacagttctgctgtactctttcaggcattttacttgaaatgatagtaatgtgatatttgcatccagtgcaaattatgaattttcactaattcttagattagatggggcttaactgctaggatgcagcttgcacatttaatctacttcagagcagcttcacttactagatggtcctcatgggtctggggaaaggatgtaaaatatcatcaatgaggtatgaagcatgttttaaaagatggagtcttgttttcagagtggattgaactgctgctaaatcacagccattacccaagcacacatagcatgtattccagcctgagttgccaccagtttttccttgtgacttgatccagtcctccattccctgctggcagtttgtgcacccctttgcttttccctgtgctgctcaggcaggtggttgctgcctaattaaacacccacacagcaattctctctgttttcttcctccattccaggatactgtttattcttgtttttacatttttttggaaaaatgttttgaagcaccttttgaaaaaagaaacatagtgctgatgatcagctaaatgtttttatagcttttcaggaagtgtgaaatgttctgatagctggcagccaagtgtcaagaaggccttggagaaaaagaaaaggccaattccaactcctttaaggcaacttttagaaaagatttagggctttaaattcagcttcacatactacctcccaagtcctctctaattagtagaaggtaaaaacattttggccgggcctgtaatcctagcactttgggaggctgaggcgggcagatcacgagctcaggagtttgagaccagtctgaccaacatggtgaaaccccatctctactaaaaatacaaaaaaaaaaattagctgggtgtggtggcacgcacctgtaatcccagctactcaggaggctgagacaggagaatcacttgaacctgggaggcggaagttgcagtgagccaagattatgccactgcactccagcctgtgcaacagagtgagactccatctcaaaaacaaaaaacaaaaaaacaaaacaaaacaaaacaaaacaacgttttttgctcaatccagcatctgatatacattttaactactttattgagttgaatttatatttaatagagttgtattctgcatgttgaatacatacatcattgtatccagaggccattgtttatttaaagaacttatagaacaattgtctattttaatttattatagaagctacactataatttggttgtgattgcctttatgttacatgcatagtcgtatctgtgatatacttggagcctaatctctggtcaagattgcagcattattttcatgggaaaatgtatgccatgacagtgacatgacttctggcctgcagcaataaatgcatcataccaaaactggagaagtgagcatagcccggtgtctgctgcataatcggaattcattcaaagtctgctgaatgagtgaattaattgtctatattctgttcagacacaactacgtggaacatgaaagactgagaactgttctctcaagttccatcataatcgacaacttcagacaagcccctcaactactcgctgtccccatttccttagtaagggctatccatctcataaagatcttaagaagaaaggacatggagcattagtctaaaatgccattctttaaaagtgatatttaggccgggtgtggtggctcaggcctgtaatcccagcactttgggaggcctaggtgggtggatcacctgaggtcagaagtttgagaccagcctggccaacatggtgaaacctcgtctctactgaaaatccaaaaaaaaaaaaaaaaaaaattagccgggtgtggtggtggcatgcctgtaatctcagctactcgggaggctgaggcaggagaatcgcctgaatcctagaggcagaggttgcagtgagccaagatcgtgccactgcactccagcctgggcaacagagtgagactctgtctcaaaaaataaataaataaaataaaataaaagtgatatttaaacttcattaaaagtagaagaaagccaaatgcatcattttaacttattttttttctttttactcaaccagatagttggtgacatataatcaacacacatttatcgagggatgctattgtaggtactcagcaccgtgctagacacagggaatgccaatgttcctgctcagacagcttccaatcctgttgaagagacaacccttctcaacactggttctattgacattctgagctagataattctttgttgtagggggttgccctgtgcattgtaggaagtttagcagcatccctggcctggccctggcctactagatgccagttgtacccccttcctagttgtaacaatgagaaatgtctagacatttccacggccttccatttcctctgtgatgcaaaatcgcctcctactgcaaaccactggtgtaaaaagtgatctgtcatgcaaattagtatgagacagtcaaatgaggaagtaatagggagtggaattcactggcgtgaatgagctggagtaatcagagacttaaactggacctttaaaaaactgagtgggattttgataagtggcaagattattgcaggtatagaaaattgcatgtgctatggttctaagactgcggtgctgcaatttggtgggtttgtgggatggcctagtgactaactgactggcttgagtgaatggagaggaatgcagatagtggacaatgaggcgaataaggtaggctggttgccacaatgtcagtttaaaagagcggcaggatgcagggggggtttggatagtgactctgccagtagtgtgtaggatggtttggagtgaggatggatgggggaagggctgtaactccccttatccatgcttttacaaagagagaggggaaaacaagttgaaatagtgaacacagattcctaatgcagcaatagcatctcctaagctttgtgtgcactagacatcacatcgctcatgtcatagggtagattctgcagatttgtttttctttcttctttttgcctgtgatttggagatcagaagatgtagatgccacagatttgtctttgaaagtaattgtcttgttcttcacattaatatacttcattaggtcttttagattagctcctgggactaaaatccatattcttcagacagctctctttgcaactgtgtcttgcgacaattctcttttcaattatgttgtgccactttcatatttctttcaaaatgttctcaatcaattttgccggcactttctctcctccaataatatggcaatgtattatcttattcgccatccaccccatgatcatacaattgttgcaagcacctggaaaaaacttttttttcattttgtcaaacttcatagtatttacattgatgagtttaacaactacatggcatgtagaatgtccatgaagaactccacataatcagcatctaaatttgagtatttgaatgtttagggcaacaacatgatctcaggacttctttttttcaggacctaagacaaacaaaaatggctgcaaaacatgagccttgtactgtggctgatatcattgaagcacgagttagctgcaagaggaaaattcacttggtttagtagcggaaaggtgatagagaagatctctagcacaactaatctgaaaattattaaaatctaaaaattaaggtagaaaatggcatgagaacagttttaaaagtcccatagttctgttcagtgaatctgagctcaatcggcttgccatttggtaatacaatgatgtggccttggcagatggtgagtcagtggaaggctcagtattattcaagctcagtttatataggaaagaagcagaaacaacacccccgttttcttgcattatgtctcataaagaaatctttttagtaatttcacttagaaaaggaaatactcaatgtaccctttcacatatctgaggtaggataagctcgcagaatcagtactagccctgaagcttctacatgcctcttattgtgtgagaggaactggaggaagagcggcaaaccatatgatcgctgacctcaaggagctcacgactgagctgaggtaattgagtagctgtgtgtggcacacctaaggtcactatggtctggagaactgtagaaagtttcctggaggaggttgaatttatacttggttttgaaaagtaatgtagagagaaaggtatgggcattttgagtaacatgagaacagaactagcgtggtgtctatagggaaaagctaggtgctctgctcagctggtggagggaagcagagaagctgtatatttagggaaagagtggaagtaaggctgatggacaggatgcccctggctgtgatgagagtgttttggaaaacaggctacttagtgtcgtcagcagtggtaaccactgcagtccatggagcagagatggatcatgaagaaaacggtactttgggccgggcacagtggctcacgcttgtaatcccagcaattttggaggccgaggtgggaagatctcttgaggtcagaagctcgagaccagcctggccaacatggtgaaaccccatctctactaaaactacccaaattagctgggtgtggttgtgcacacctgtaatccccactactctggaggctgaggcaggagaatcacttgaactcagaaggcagaggttgcagtgagccaggaccacgggactgcactccagcctgggcgacagagcgagactccagatcaaaaaagaaaaaaaagctactttgaaggggaaactcctttaaaactggagcagtcctaaagtgttcaacaacccaagtttacataaaatgaattgtgatgattcctgtaaatctgtaaatataggtcatgctgatctgttccctgaaggtgcttaaaccaacctcaacttcagtcgtccatgcctttcatgactcactctggctttccccagatagataaggtctctctgcatgagaagctgggatttagcttcatagcagttttgagacacggtctgtaggagcaatttttcaagaagcaagactatttgcacttcgtcctaaaaataaatgtttggggtggagagcagaaaacagcaaatagcactgttttataaatgaacaaggaggttcaggagcttttctctcaaccccctaaaccttcttctgggagttcctccaaacctaaagtcacacccatctgccagattgtgtaaagctgagtcctcggaatgtgaaatttatgagggcagggactttgttatgtccattctttattcccagcccttaaaacagtgtctggaacacagtagatgttctacatttccccctttaaatcatatgctgtggaattcataaactttccatttttgacacagacattatttgaataatcatctttattttcagttcatccatttcatattgagtttttaaaatagcagctttattgaagtacaattcctaagatacacaattcacccttttaaggcatacagttgggtggtttttagtttattcagagttgtgccaccatcactactaattctggagcagttttcacacctccataggaaatcccataattgtcagcaggcactccacatttccttttccctccagcttttggtggtcacaaatctgcttactatctctatggatttacctatattgaacatttcatgtaaacagaatcacacactatgtgatcttttgtgtctggcttttttcatttagctaaatgttttcaaggtgcatccctgctctagcactatcagagcttcacttcttttttgtgaccaataacattcccttgtatgagttaatcacattttatttatctatttatccattgatggacatttgggttatttccatttctcagctattatgaatggagctgctatgagcattcatatagaggtttttgggtggacaggtgatttcagttctcttggatatatacctaggagtggaattgctgggtcatatgatgatttcaaatttaactttttgagggactgtcagactgtattgcaaaatggctgcaacattttgcacttctaccagtagtgcatgagggttccaatttctccacatctttgtcaacactggttattcctggtcttttttatataaccatcctataatgttaatgagttaatgttgacttttggattataaatatattatatgtatatattatattataaatatataatacatatttattatatattacatatttataatatgcattaatatatattatatagtatatataatcaatatattcacatgattaatatattaatatctttaatattatatatttataatctatttatagattgtaaatctataaatatgaaagtttatgttaatacattataatatataaacatatatataatctattatttttatatctttacataaatatataaatataaaagattacattaatatattatatattaatatataatctaaattatatattaatataattggattatataaaatatattatattttatattacataatatataatatatgttatattttatattatagactatattatatgttatattttatattatagaatatataatataatatatattatattttatattatatcatatataaaataatatatatattatatattatattaagtatatattatattaataatgtagttctatatttttatatattgtatattaatcattacagttaattatattgtatacaatataattatattgcatacaattatattgtgtacaatatcattatatagaatacaattatttatattgtgtacaatatcattatatagaatacaattatttttattgtgtacaatataattatattgcatacaattatttatattgtatgcaatatatacatatattaattatatatatattaacaagtgtgaaagtcttatactttgcctcagaaatggccttgccagcacaatatttcccttcttgcatctttagtttgatgtgttgttgttttatttcctcataaagcaaatgaaaaagagggattggggatctgctaaaccagatgttagcactttttaaatttagagtgtggtggtcacaagaaaacacaactgggccttgagacggcatggaaaattctagaaatgtgtcatttcacagcatctgtgcagaaactgcttctgtgccagcatgttacatttgaaaccacattttgtgtgtgttcaacttttacacagatctcgagaaaagtgaaattgaattttatgcatctgtaatttgatttcagtccatgaccaggccatttctttataataattataagaatgtatccaatatatgactttcatcttctggtaattacaacaatttaccatttatagaacacatagtttaagacaccataagtaacatttcatgctaattgcttttctgaaaataaagggctctgttgtacacatccaagaacaatggtaggagaaaagaaaattgattgatacatcacatcaaagaggagatcaaaatgaagtcatccaatatatgccaaaggctctcataaattacaaattttgaactcactccaaactttatttttaggcaaatacagtatcttcaagtctcattatgaaagttacttcaaagatgatttgatgtgacagtatttttcccaaggctttgcctgttttctattcctaaggcttcccatgcgagcagggattcctggggcccaagctcaagcaaccaacttatactttgaatttgaactcaaaggacaagaagcccatttttgtgatgtgcttccccatttccttcttttgagcctaattgaagaattaaaagttgtcttcatttctaaagttatatgccgaacacaaaggggggtttcaacagctgcttcttgtcatgctgtgggaaaaaaataacatctcatctgaaaaatacctccaggttctccagatagttcttgcttttctcactcacatttttctctttacatgaacagatttggctcctcttcttcttttgtaggtagtatccattcagtaagatatttttcagatattgagagtaatacattgttcattagaaaacaaagttaaacatccataaaatactaaaaagaaaataaagatcacctgcagtgtcacaacccaaagtgtatcattttgctttagtttcttacactgtttgtttgcttgcattcattctttctttcactcgttgcatatttactgagcacctactatgtgccttgcattgtggtaagatacaaattgtgatcctaattttctttataataattaggtttataattgttggcatagtccatgcctcctctcctagactttagtgtctgggaccatcttactcaccatacatcgtattatgaccatttaccaggtcattaaatattatctgaaaataaaaagtttaatggctgcataagacttcactttcagcatctactagaatttactatttccttattgatcatttaagatattttctttttattctgctatttttgataattataattaattaattccattttgaacatcatttgtaagggtatacacatttttatggcttgtgttgtattagccacactgcccaccagaagagccctactaatttaagcatttaccgcagtaggtgaatatttctcaaatgaagttgaaggaagttccaaaatggcagacccaaggaactgaaagacttacccaatacatccctttgcctccaaggagagacagaatgaccactaccaccagaggggaagccagtttgtttaagagaattgaaaaacaccagggagagctctctcaatataatagtactgggatttgggggcaagaataagcagtggtgcaggttgtttatttacatacgtttataaattatctttacagggctaagagtgaactggatgaatggtgttggcataacctcagagaggcaatccaaattttattaattctctgttatgtgtcagagcttgagttaggtgctatgagtgatgcatggatgaactaaacacagttcttggcctcccagaatgttaaaatccagtagcagggaaaagtgtgtgcgagctggaatttgaatgacctgggttccaattctgattcttctacccattatagcagtgactttggagaggttacctgatgtctctgatcttctgttttctcatgtgtaaaacagggtgaataacagagttcttgtaagaaggaaatgagataatgtgtataatgttcttaggagagtgtgtggcacataacactatagcagcactcaggagatgataactaccattgctttggtaatgatgtttcctatcttccaagggttttgtgatgattcaatgaagtaacaaatgcaaaacacttagtgctactacagtctcaaattaagatgacgatctgatgataatgacaacctttttggtgaagaacatatcacaagcgagttgtaccaaacataaatgagtaacaaaagggtagcttgccccttgtctcagagaaagtgagtctcggcatgggttgctgcagaagacagtgttggctctccacatcctgtgacaccaagacttattaaaaccagacattcaaagcaattgcaagttctgatctacacaactgttggtcacttccgcttttgcgcctacctcatttgaggcacctggagtgtgttttttcttggtagaaccgtgacaacatgcctattgctggcctggaattgtctaccaagcccaaagctttttagcagtgggtgatatttgtttcttgtgccatcgctgaataatgacttttgtagtctgaaattaaacaagcattcaagggctctaagtgtctggcaaaaaaagttagtggctggaaaagctgcagaggatgtctatgaaatgcaattgatgaacacacttttccccctgagctgctttcctgttaggtggtggaaactggtctatttcggtgatgtgtgctgacttcttcccttctggagcccatgcattgggtgcctccaggtttcaaaagaatgaggacaaattaactgttcttctaaagtactaatgctgcaggcccttctgaaataaaacctttgcagaatggaaaatattattgtcttcttgctttcaaaagttacttgtttacctgttgctcataaaatgcaggataatttgtggttgggaaaaggtattctttgcctgatgggtttaatttcagcaccgtagacttccctgaagattacaaagctattctattgctacacatttatagagctcaccccgaggaaagggaattagtgtctggcattaccttcctgcctgccaattttacctcactgattcaacctttgaaactgatttaatcaatggatcagcacattattcaaaggtggaaatgttattacagagaagctttcaggagggtggatgattcgtacaggcactacacaggacttttaatcacaccacataaaagaagcaaatttgaatgttgcttatgcccagaattttgatgaaaagtaaaattttgatgaaacgtgaaaaggagtactaggagaagcccatggcttggatttatgttggcagacatttcttctgagaaagaaaactcagtatgttctaatgtaaagatccacaaaatccaaaaaccacaccaatgggtaagcctattgaaagtaagagagatgagaggttgaacatgataaggaagctgaaaagccaagcctgttcccaatagtcactacactccagtggaagaattctcagtttttgtgcagagtcctgcattttgcatagctcagttgctggacaagtgaatgatcattttcctcatctgtcaaatgggaatagtaatacttctcaaggtgtttgtgaggatcatcagatactaaggattttacaggtttttattttccttatatgatgtacacgttctttacattgaaaaaattatttctccaaactagaatcttaagttccatgggtatgatgggtctgataaagtatttggcatctcttttactaggtagatcccactcaccctgagttttttttttttttttttttgagacagagtctcactctgtcacccaggctggagtacaatggcatgatcttggctcactgcagcctccacctctggggttcaagtgattctcccaccctagcccccgagtagctgggactaaaggtgtccaccaccacacctggctaatttttgtatttttagtagagatggggtttcaccatgttggccaggctggtctcaaactcctgaccccaagtgatctgcctgcctcagcctcccaaagtgctgccaccctgagatttgacttaatggagcccatgggagatatagataccttgggtcattagcaaaaccttcaacgtaaagatgtatcaactctgagagaccctggctaggtctactaagttaagtggaagcaccacaacatcatggttaaaaggaaagcctttgtgttgagccaggtgttgttttgaatctcagccctcctgcttaggaattatgatcttgggcaagttacttaacctctctgtggttcaggttcatcattcaaaaagtaacaagcatcatactacccacctcaaaggggagcagaaattaaatgagattaagcatgcaaagcataggagcaccatgccgagcatagaggcacaataaagggcagttgagaggagtggcggcctggcagggtggctcatgcctgcaatctcagcattttgggaggccgaggtgggaggatcacttggttactttatcaaacccaccatacccatggaacttagattctagtttggagaaataattttttttcaatgtaaacaatgtgtacatcatataaggaaaataaaaacaagtaaaatccttagtatctgatgatcctcgcaaacaccttggaaattattactattcccatttgacagtgatcacttgatcacttcaagaccagcttgggcaaaacagcgagacctcttcactactaaaaatttaaaaaatcactgggcatggtgatgtgcgcctgtagtcccagctactcaggatgctgaggtgggaggattgcttgagcactggaagtcgaggctacagtgagctgtgattacgccactgcactccagcctgggtgacagagcgagaccttgtctcaaaaagagaaaagggagaggagtagcaggattgacagcagcggtggcgttgccccttgaggatggaaggtctcagtcatcttgaagtctgctggagcattagttccattgaacctctctttgagggagactatgttctttgtccttggccttttttgcctacctagaactggctgatcttgcatggactgctatagaagtcctttgtaatcaggtcgttgaggtcagataatcgagttccaatccaagctctgtcatttgccagctgtgtgacactgggcaagttgagttactcaacctcgcagagccccttgttctcagctgcaaaatgataatacaataattatttgctgcatagggttattgagagaatgaaataggataatccatgtaaaagtacctcaaccattcactggaacatggtaagtgcctaataaagatatcttctgagtatggaagcaagacttcattacatgtggtattgatttacaattgagtgcatttcatgatattaaaattaggtgagaattggtggtatgaaaatgcaaccacatcaccacaggcctcacacccatgcttcctgtgcagtctgtggaactgtgcatcaattaaacctctcttcttcataaattacccagtctcacgtatgtctttatagcagtgtgagtacagactaatatacctggaaaagttgagtgctctaggtcaactggcctgtttagtggcagggctaggattagactgtcaggaccccaagattccactttgtgacattgtcctccagagccattgccttcgcatactgattcaccttcctttctatagtttctgccctccatttaaccacttcttttgttcccctcaaatcccagatggccagccttttaggcctgcctttcttagatatgatatcaatcatatcatttcaaaatataaaatgaatttgttattttagttagttaaattaatggtgaaagattcatttaccaataattttgactgctcttcatttgttctgggatccctgtagtaatattctagctttctccatgcaagtgaatgctgtactacagtgattttcaaacattagttgaattagtttcaccttggggtctggttgaaaatacaaattcctgtgccccatataacaggattctggttcctgagtctgggccgaggctcagaatctgcacttttaacaggctttgccacgtgagtctaaggctagtggtatatgcagcccacacctttagaaaactgcttggctttgagtcagactgcctggcttgaaatccaggctctgccattgactagctggaagtccttgggccttggtttcctaaacttaaaaaggagaataatacatactagtccatgtaaggttgctatgatgattacatgagataataaatgtggagcacttagtattgtgctgaacctacagttggcactcaagaaatgttaagtaatattattttaaaatctagggccgggtgcagtggctcatgcctctaatcccagcactttgggaggccaaggcgggaggattgcttgagcccaggagttgaagaccagcctgggcaacaatatgagaccgtgtctttacaaaaaacattagctgggcatggtggtgcatgcccgtggtgccagctactcgggagactgaggtgggaggatcacttgagcccaggaggttgaggcttcagcaagatatgttcataccactgcactccagtctgggagacagtgcaagaccatgtgtcaaaaaaataaaaataaaaaatagaaataaatctattgaaacacacacacacacacatgcacacacacaaagtctacaatgtgtttttctggttattaaatggtaattagtgttaacagaagattctccttgcattaacacacgtgtgtctccacacgcattctttaaagcttagtgctaatgttctcttgtccttgaggtgtttgtgatcttcctcttcactggaataattgttcattttatatctctcccacttgtgcctcccatagaaggcattttgttctgcaacaaattctagtgagaattttgcatctctctcttccaggcttgcaagctgctgaaggacaggggagcagttgtagccatcctgcaccccaactcatacaccgtggcccaggtcttacccagtgcttagcactctgtagtacttaaaaccacacttgctatattcacctgaagttctggaagtgagaagcctcaaatgaaatactcaagaccagaatctctttactctttctggtctgagcaagtgggaggtgagagaataaaactgggaagtgttggatcttctctggcttgtttgttctgcagtacgattgggagaaaatgtccaaaaatgtagaattgagaagaacacccccaaaaccaccccagcaattactgttgttttaaaaaatcgtaaccagatggaagacatttcctgaaatcacacctttgtttcttggagaaagaaaaagcccattcctgtgagtgggtgttcattaacttggtaagtagggaagattgagcttggcctggaaggaggtggatttttgcaggggcactcaacagacaattaaataaggaggggcatttcccatcagaacacatgaaacaagaggctggttgaattttctgcaactgtctgcttgaaggtttatattcaatgggtgtcaccacaacttacacctcatagaacagggatttggtccccaagagatgtaatgcaaatgtcacatcataaactcccagactgccaatactgaagggattttaggaatcgtctagaataagaagtacagaccacccaccattgttttgttagtgttaccaaaatgtcaatggttgttcaaatgcctttagttgctgttttactgcatattttctgattccaaaatgattagtatttcttggatttatactctggctctgccactgactggctgtgtgaccttgggcatgtcagttgcccttttgggacttcatttccttttataaaaggagcaaactaggttgaaagatcttaaggttctttttagctctaaatatgggagagtctcccagaaatagaaatgcaccactcctttttttggaaaattcattctttcctaatgttgaaatgctggcagtccagtgagtcaggtaaccatgttacaagaattgtctcacaaattctgtaaggaggtagggaacaaagatacattctgatgtatgtttcttctattaaatctattttggtattccaagtgacatttgttcttgcacagcttatgcttcacaccaacatgctatctgtcagggcacacactgattaagacctattctgagaaaacatattctctgtgattgaaatccaaacgtattgattgttttatttccatcaggagagattgctttctatttggtgatggatgacaactcttcacacctctctgtctgccagctggacagaggatgacacaagcagcctctaagtcttgtgtgggctgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcccagctcggtgcagagagaacatctcgagtctgcactgtctgctgtttctccgtaccacggtgtgctagcaggaaagccttcaaaggattaaaacccaagtatttatgagctaaacataatgtttccctctctctgggaatgcccagtgagaataccacttacatctgcacagaatgattgcatttcgcaaagtactttcacatgcgttagctcattaaattcttaaaacttttactcgtgggaaatagatagacactacatttttaccatgttacaaatgagtaactaggtatgccctttaatctctgatccctgaccccacaagccactcttcaaggcttgaacccatggcttctagtccggtctttccatcatcctgaggtgctcagttattcgagcctgtagctaatgactgcaggacacataatcatagcaactcacatttattgaactcttactatgtcccagacacttcacataattttaatttaatcttcacaacaacctagtgaggatcatatcattattgtcatcggcattttacagaggaggaaaatgacattcagagaggttaagaaacttacccagggtcacatgatagtaagtgacagagttaagactgaagctgagtcaattgaaaagtagaaaaattcttaaccatgatgctctgttgctggcaactccctgtcccttaccctttccaaaaacattaagaataggaaaaaaaagaagagtgagttttccctcttgggctatgctagcaacagaggcccaaggggaaatgctgttttaagccaacctcttggaaagggtcattagcagctgacatgatgccaatatggaccaatatgtctgaaagcttgtttctgggtcttttgtggtctctgccattcttgtccctgtccctggcctccacattcctttccctctggatcctcagtaacattgtcatcctactttggacatgcaccactctccattttaggtgagatatgtagggttattgtaaataaatatttcagaatcagtattatttattccccacctatttctgaaaaggatctgaataaaatctgtctattaagtaatttgaagtttacaaaaagatctgaaaccttgtggaagaaagtcaagggagaagaagacatgaacaatggttctatcaagaacttggggtggaagtcatctcacacatttcataagcactgtgaacctggccctgggattgccactaaaaatacagagctgagtaaaacatggctcctgccctcaaagagctcaatatctagtagcattagaattactgaatttgaacattcaatttgactttgagttcaaaccaagacaataagtgaaacatgatggattatctagtactcatctgataaatggagtagtgtctgttcttcagaagacacaagctgcttataatgctgaataataatgatgaattatttcatatcagtaatagctaatattctttgagagctcatcatgcgccagctattgcactaagcaatagctgcattatcccatttgcatgcattatcccatttaatcctcacaaatgtcttcatgatgtatgcatataattacccccattgtacagatgaagtaattagggtaaggaggaattaccttgtggatccataagtaatacaaggggtgaaaacttcaatggagtttttacagaagattcagacccgtatttcataaggccagtgcacacatttctcggccatttctgtcttccctgtcactctacgggaagtggctatgaatatactgtctccaaaggctgtgactgtagccattgtgcttcggtattgccatttgggacctaacggttcagaagatgtaataactctccttgcatggaccaattacagaaaaactccctttgtaaagcaacagcatgagccagaacaggcacttcattatctgcctctgcccacagggaagtagagacgctggcgagaggatgattgacctgggaaatggcagggcttgggatccatgctttcagggtcaaaggccttcgtgcccacttccaggattggcttctcaggatgccctggtgctggctcgccccctgctggggtgggctcctggggtttctctctcagtgggatcccattggcagtctctcccctcccacagcagcaggcccattgacttctgggcactcacttcccaggacccttttcagtccctgagaatcagaagttcttttcactctgagagtttgcagacggtgttgcaccaagaatggatgtactttgcctgtagagggctttaatctagtgaattgtgctcagacagataaagggtaattttgcttcattttctgtacctttctgaaagtttccagggtcagttagccaggtctctgcaggcttctcagctccaaagcagaggcaaaagtctttttccaccatttattccttgcatatatggaagattcttaggcaaaaagtgattttttttcacccatatcttatcccagaaaacaatgccctctttttagttaaactgaatgactacaaatcatatcaccccaaattgagtaattgcaagtcttgttagttatcaaggttttattgagccttatttcagttgcttacatatgtttttgtttttaaagaaaaaaaaagtgtaacgcctttggcccgggcctcaaattcctttttttccctcaggcaagcacgcttacaagtgagggattcccagcctacaagggtgagttatgtgtgttgagagcagagtggaaaggtgggcatttactcgccctgccccctccactgaactcgaagtgctcattctctcccatgcctgtgtcctctctctcttcacacatggtcatgtatacacacagttgtacatgcacactttctccttgctaaaacttttctttgctctgagtagatgcagtccgttctcacactgctacaaagaaatagccgagactggataatctataaagggaagaagtttaattgactcacagtttcgcagggctgaagaggcctcaggaaacttacaattatggtggaaggggaagcaaatatgtccttcttcacatggtggcaggaaggagaagaatgagcaaaaggggaaaagttccttataaaaacatcagatgtcgtgagaactcactgtcacaagaacagcatgggggtaaccgcctccatgattcaattacctcccaccaagtccctcccatgacacatggggattataggaactgcaactcaagatgagattttggtggggacacagccaaaccatatcatctactctctccctggcctcaccccacattactgctctggtggccaatgctgtagtcacgaattctgccttttctcatgtctgccatttcaaggagctcaccccactcacctcaaaaaccgagcttttatagacgcagaaaactcttcctcctatatgcacactgattgatcacctacacatgccatcaagagcatgtactctggaattagatagtagtgagttggagccatgtctttacttattagccatgtgaccttgaggatactacttaacttctctgagcctctacttcctcagtgaatcataaatagaacctacctcataggattgttgtgtggggattcagtgaaatagggcatgtaatttagtacagtgcctggcccatgtgatcaataaatgtttgctattatcattaagcgtggtgatcttagctgattgtattgttgttgttgttgttgctgttgaagattttgcatcttctaggttatgtttctttgctgctcaggaggcagaacaagtttctccattgccaaattgtttgcttttttttattggggtgaaattcacataacataacattcactatttaaaattatactattcagtggcatttagtgacactcattatgttgtgaaattatcaccactatctagtttcaaaacattttcagcaccccaaaatgagacccgtatgcattaaacaatcactccccatcacccccacctaccaaatctttttttaatgttgctttcagatcatatgccattccataaatctgagaagttcaggaaggctagatagtgagcttttttccaaaaatcaatcagaaacatattcctaaataaaagaaatatactctgatattctgggactgccttatcagagagtgaagtgaaaaatcagaagtgatatagtctcattcaggccaacacagaaattactcctttaatacttattgcccatatttcacattattttctttgcctggtagctgagagagaaaaggagcttgaaactttgagtaaggggagggaaagattttctaaaccccctataaacaaatgatggtaaagcctaggaagaggttagcaggtcagcctctttgcatttaatttccatcttgccacattccaaggaaggaattttagtcttgggaggcaccaaataaccctcaggggaaatgtgaccctttgaagctcctggttgtctatttctgcagctgcccatctactcacaccacccaggttggaggggcccagctcttcagcactcaaatacagtggagctggccacttctttgcacggggatggtttataggctttctatatcaggctgtgtgcagacgagacaggcttgatgagtcagctgaaaaggggaaaggaggggaactccagttggcttgatgctcaagtgagaagtgggaagaaggaccaacagttaagaggactcggtgaaaatactacgggatttggcaaatgtatgtgaaggcttttgtaggtcagccagtttgcccttggagctgtgggcctgcctgagaaggcttttgttggccttgggagctgaaagggagaccctttctttaggctctgcaggctacttggcaatcaatgttgaggcaggttttctgcttctgtggggtgcaaagctttggtcaatgtcatcaagagcatcctcttcttaggaaaccatgaccttgccttgggcaacttttctgtagcctttaagaccagaaaagtgagtagagaagactaacgtaattggacaaaccttgctttgatgggtggtgattgggactctcatatgaattccagaaggaaatatatgaagagtgtctgtaacttgaatgtgcttcctctgttgggtcttgcattaaatcactgatctgcacactttagcctgcagcagaatcacctggcgaggaggtgcctgttgaaaaagataagaagtttcattcagaaaagatgaccctgaagtaagtcttctcactcatttctatttattcacagttcctactttactaagaaagtttttaattattggccattatccgtgactgaaaatacattaagtaaagttgcaggatgagttttaacatttatgagttaacttcatccacatcagtaaatttgacaagtatttttgaagacccatctttgggttttattaaatagaaatttctgaaagttgtatgcccaagggtattttgtttttctcatgtgtgttcaaatttgggaagaatgaattttgcctcctattcactcggtaggagatttagtgtctccttctgaattagccctttctgttcctgaaggaaagtatttatgaaaaatcagactccattctggaaactgaatgatttttgtattttgctgcagttagatggagtcctataaatgagcccaaaacatgctggctaaatctctcataaaaggcaaatatcacaaagaggaatggcccaagtcttattttggcccctggcctgtgtttgtctaaaaagacttttagaagtgtcacaaaacactaaagcactgcctaaatcatcccttcctaactttttgcttatgggggtgcaagggaagttgcacgtggtgggtgggggtgctgagagagagagagagagaacacaaagggccagctcccacttggagctcccctcgtttctctccattttgctcttcaggatgtccccaccccactctgcattctcaccacacccacacatgaacccagcatctgcccaggtgccacgaatcatattacaactttgctccctggcagagagtggccagagagaagtttctggaggtgaggaagtgagcctgcctgactgctttggtggcagaaaccaggggcttaaccagtgactctgtgctcgaggcttgtttgtgaaatcctttagcaactcttcagaagcctctcctctctgacttctcagagatgctggctcttctactttgggaagttcctttgctagtaacacatttgaggtgagttaaatgtcttcctccttcagcctcagcttcctgtgcctaagggtgagttaagcaattagtcctaaatagccccagctgttagggtttctccagaggatgctccttgtgactttgattgcttctaatgaggctattggctttatctgtaatagacaatgttagattacacatctatgtcttttacagcaccttttacccccagggctttacgttttctgagaccactcttgagaaccttggatccagtggcatttttcttcttgtgaataaaaaattattatctttcctgttctccctgtgagatcagccttgttcttgttctgctctggggtactctgtatttagggaaattactcatgactctcgggtactgaaaagacacacacacacacacacacacacacacacacacaccatgcacaggggaatgggagagcaagaacgtgtgagagagagccacttgaagagagacagggagaaagaaagagagtaggagaaagcaataaagaaagcgagatcacagtcaggcctgagaaggtgacagcaagccagtgttttagaggtagggaaagagcccaagatggatggagaaagctcatgcaggagcaagagagcacacatgggagtgccagcaaccttgaaaaaaagcaccagtgacagcaaagggaatctatgaggccaggaggctgggcgagcaaaagcaagagagtgcaagagatcaagaaagggggaaaggaggtgggagagggagagcgagccttcagggcaaaggagtcaatgagagagatcagcacattatttgtgggcagatgaagagaaagtctaaatgaggagctgctttcccctcatcttgttgagttggtggaagaggaagagaagatgcacagggcacagactccagctttcattaatccaaaatggaatttctgggacatacatgctcaggatcaatgtcatctttaaagacccagattccaattagaaccacaagtacacctccccatccttcagtattatttgaaattttagaacaactgccattattctacacaaagtaaaggatgatcattttggagtatgtttttatcaaaccacctccctatccacagacctgtgttagacagcttaccttagtggttgccaaacaccagaagtagatcattgtcatgattttggagggctgggccgaggcctggaattctatggctttaatacgtggctccattgggagattccattgcccaggaagacactggccttaagctacaccctttttcagaaagcagtaacaaattcagttggaccactgacctgaagccagattgctttccaacaaggcccaaactaaagggggtaccaaaaaatcagtaatcaacataaataacattttaatgatatgattttttaaaagagaagtttctacttatgttgcccaggctggagtgcagtgtctattcataggcgcgatcatggaactcttgagctcaagtgatcctcctgccttggtttcctgagtagctgtaatgatatgttttaaagacttaaaattaatgtagacaaatccaaaatgaacaaatatcaaaattttaaatacagtttccaactctgcccttgcacacccctgcctctcttgacccaccctaacaccatccttggttccagttaaactttatatacagaatcaggcagccatcctgtgggccatattttcttgacttaaaaaaaaaaaaccattgccttaaatatcatttattcaagtagaatccaaatcttgtttgttttctaatactgtttttcaataaaagcaaccagggctccttggagaaatgaccgattccaggactgaggcagaaaatacacaagataagcctggaacatcttgtattgccagaaagtaaggaagtgttaacaaatacacaaacaaaaacaaaaagcagaacatcacaggagccaactaaaagagctaccaacagccaaaggtataaaaacttgagaaaatatactagtattattggactataacccaaagtataaaataaacatccaagagtccatactgatataattaaatggttaaataaatggatgatagacacatcttttgtgcagggtaattccaaataatttgtgtagattctctgccctcaaggaggtggagtgtaactcctcactccttaagtatgaactgcgaatagtgacttccttgtaaaagagtatagtatgggccaggcatggtgccgcatgccggaaatcccagcactttaggaggttgaggcaggaggattgcttgagaccaggagtttgagaccagcctgggcaacatagtgagactccctctctacaaaaaaattaaaaattagccaggcatggtggcatgtgcctgtagtcccagctactcttgaggctgacatgggaggatcacttgggcctgggaggttgaggctgcagtgagtcctgatcatgccactgcactccagcctgggcagcagagcaagatcctgtcaaaaaaaaagggtgcaggccgggtgtggtggctcacatctgtaatcccagcactttgggaggccgaggtgggcagatcatgaggtcagagatcaagaccatcctggctaacatggtgaaacccagtctctactaaaaatataaaaaaattagatgggcgtggtggcaggcacctgtagtcccagctactcaggaggctgaggcaggagaatggcgtgaaccaggggggcggaggttgcagtgagtcaagattgctccactgcactccaacctgggcgacagagcaagactccgtttcaaaaaaaaaaaaaaaagtgcagtatggaaagggaaagacaagtatccttaccatggattaacctgacaaatactgcctcagccaggtgatcaatgtgaacatcaccaatcataaatcatgctgattgtatgtgtctttggatatgatgagatgcgaatggcactttatctctgtggtcttcttccctataatccataaccacagcctacttatgagaaaaacatcagaaaaattccaatagaatgggattctacaaaatagttgaccagtactcctcaaaattatcaagtcatcaaaatccagaaaagtctgagaaattgtcacagccaagaggagctcaaggatatgtgacaactagatgtaatgtgggatcctgcaaccgaaaaaagtaaaaactaaggaaatctaaataaagcatagactttagttaataacaaattgatattagctcattaattgtgacaaaggtaccttattaatcaagagatgtttatgtgggaaactgggtgtggggcttatgggaactcattgtactatttcacaatttttctagaaatccaaaactattctaaaatacaaaacattctttgaaaaagtatcttgatggctgaatgttttggtgcccccttaaattttacacacaaggtgagcaccttgcttgcctcaccttcatcctggccctgctgtctgagtgcaaaatacatttgtagcactggatttcctaggagacacctgttgtattagtctgttctcatgctgctaataaagacatacccgaaactgggtaatttataaagtaaagtggtttaatgaactcacagttccacatggctagggaggtctcacagtcgtggcagaaggcaaaggagaagcaaagtcacaccttacatggtggcaggcaagagagcttgtgcaggggaactcccatttataaaaccatcagatctcatgagacttattcactaccacgagaacagtatggggggaacggcccccatgagtcaattatctccacctctccccatgttgacatgggggattattacaatcaaggtgagatttgggtggggacacagccaaaccctatcacctgtacacactgcattctctttatttgtatataaataaatccatagtattctttcctccacaaccttctccttagcataagctgaattacattccttggcttctgacaaggaatgaatttagatgaagctcagtgtgcacttcccaaagttgcagttgtacagccctgtgaagagaagaggcagtggttggaagcctaagccacagaaacagagtatagtccaagaaaggttataatgctgtgcccagcagccagagcttctcctgcagctgctttattcctgccaagcaaagccatgagcttctcctgcagctgatttattcctgccaagcaaagccatcctcgcaaagagcattggcccctctgctgcctgggcctgcctctcagatagagctctggaagcctggacctttgtcctagaaaatgacatgactaaagtgggttttgtctttcctgttgctctctttcctcctttccctcttttcacatcaataccaattagagaggacaagtgttcaatcaagacataatgtcataggcacggacttctcctcactgtcttcctcagggcgaagaagctgccagcctggagcagaaagctgggtagagacactgctttaactttattccctcagggaaaactgcagccatgaaagtacaacattgagctgacttgacttggcagaaagatgtgttttgcgaggaattgggatctgggagaaggtgattctgatactaactcacagagcataccatcccatttctgatcagcgtctgcgtgagaagatcgttcaaagctaggcagtctgagtctcattggaagaagtggctaaatctaaatctggtgtcagttctttttttttttttttttttgagacggagtctcactatgtcacccaggctggagtgcagtgatgcaatcttggctcattgcaacctccgcctcccagattcaagcaattctcctgcttcagtcacccaagtagttgtgaccacagatgtgcgccaccacacccggctaaattttgtgtttttagtagagatggggattcaccatgttggccaggctggtctcgaactcctgacctcaggcgatctgcccacctcggccttccaaagtgctgggattacaggcatgagccaccatgccaggcctggtgtcagttctttaacagttccaccacatgggatttagcaggggaaatgctgcagagtgaatgccagagactttgtccagtttcatgtatatgaccattggctctggtttcagagagacttgggtttgggtcccagaatttcttaattgtgtgacctgggcaagtcatgtagcccccacagagccacagtgtctttatctataaaatgaggatgctggtagagttgctgtgagattaaaggagctaattcaaacactcatcccattgcctggtgcaggaaaggtgcctactggatgatagctctcatcgttgaaactctgaagcttgggactggggtaggggacacttccactagagtacagacccaggaataactctggagacatgttgcaggaggcctgccagctttgttggagtgtgtccttcgtgctggttaatacatgggaaatggctcaggaacaatagcttgctcttgggagaatcccggaagtgacagtgtgaaaaatgatggttttccaaggtggtattccctagggctgagatttcttgtccttccttttccatgctcacaggaagaaggggaggtatttggtcaagaaagggtttccagaagaaagtggctcagagtcttgctcctccttcctcccctgtctgtaaattctttgcatttggaatgtgtgatgacccctgtctgggctttgcactcagatccctgggagctaggagcagccctgagaatgggcagcatcctgcatctgccttcccaggtgcagtcctgagaatgtgctgatggagtttagttttaatgacaatcataactccagaggcctgctctttactgtttttgattgtgcagctgaagactagatgacctcattgaaaagtgggagacagaagcagctgttgccacaggaaataagcccccccgccccgccccacctcaggagacacactgcttctaagagttctttggagtgggggtggatccagaatggcagctgtcctctacccagatctttctttgtgtacccagaggttgggctgagctgtgggtgactagactgtggattaagaaaccatgaatagcgtttccagaacaaattcttggcctgtgaaatctccatttagcttgctctaccaggaccacatgtgtctatgatttgcctcctttctctttttggattagagtctgtgccctgcacctcatcccctggttaagctaccatccctcccactgtcggcttggagctggtttgctatgctgtcaaagatctgagtagcaacagatcacgcagcctggtgtttgtggcttattacatactccccaccttggctgagtaaaacatcaagagagatgtactaagcttccaagcacaggggtgaatactgaagccgaaggcttggtgtactaatggtgtaatttgaggtcccagctacaggttagaggtggtggggatttagagacaggggaatttcctgggtatttgttaaattgcagtatcctgagagctcctttatcttctgtagacaacattatgcctgtttggggaacttcacacatatatatccacgtgattctacccagttcccatacccttggcccatcacaccacaaaataaagtgctggagccaaagaaactctaaacagatgtctttagatgaaaacaaagctagcagcactactgtacagcccacatattgttgtagttttaaaagtagattgttgtggcttttggtttacttgctcactccttaccccatttcctgttggtgtgatactgaccagcaaagtcgcctttgcagcgtttccttggatctcttttttttttttttttttttcttgatgggcatctttcacttctaggaaaaccaaacaaaaatttcctccaaaaattcaagtcagtcaacatttattgagcacctaacaggttcatggtgttgtaccaggcactgcaattggagaagaatgttacaagtacacatgcccaaactcgactgtgtccagtctggagagaaggctggatctggccccacagattgtggtgggagactggctggggatgaggctgttggctcttggtgttttgcaggaaacttcaagaaggaagctggggggtgtgtcctccctaggccccccaccccggttaatttgctttgtttctgaaacacactgaccagtagctaaatgggcctagctcatgttcagggctgcgtgctgaaacttcattagctcttttcaaagccctttcctattggtatagaggttcctcttaacactgccagcttccttgaaaggtttttcagctgctccttatagaatcacttcgaattaaaatgcttcattccaggggagattttatttacagccaagcaactgtaactagtagcactccccccaccaggctgcagtgactatagatctttgatactgctgaatgactctgtcaagggttccaatttgcttttatacaagtgcatcacccaattcaaaataaatgcatccagactcccttgtcctctcccaacccccacacactattccatttcccataagcacgtggcctgcggctcaggggtgtcagtcacttagccagctgtctgttgcctgacacagacatatcaagttggttcaccttaactaagtgattgagcttgattgccaaccatctggtgagtttagttaagggaattgtgatttctagaccagtctaacacggccaaatatgtacctccccaagcccccaaaacaagtgtgtctgtgggaccacattttatttgtacagttacagaattttatggctggggaggactgctttccaacttcattgctgaagtctgaatttaccccttcaattcaagctctgaaaattttatgggctgagcccaaggctaattgttccaatattagatgaagcccctgtcctcaagaagctcacagtcactcagaggtaaaaggcagtcaccacttggctctaatgtaatgtaataagtgccatggtagcggcaagaacaaagtgtgctgtgagaatccgaaggaaggatggattactctgcctgtgaggggagagggtcaggaaaggctgctcagaggaggtgatatttgagctgggtcaggtgggaaggctattccaagcgaggagaactgtgtgagcaatggcatgcatgcatttgccatatttggggaatctcggtttagagatgagaggcctcccatgggcacaggttttccagagaataaatgaaatcaagagtgtctgaggctgggaacagtggcccacgcttgtaaccccagcactttgggaggcttgcctgtgttatatgcctttggcaggtggattgcttgagcccaggagttcaagaccagcctgagtaacactgcaaagccctgtctctacaaataatagtaataataataaatcatctgcatgtggtggcacacacctgtggtcctagattcttgggcagctgaggtaggaggattgtttgagcccaggagatcaaggctgcagtgagccatgattgcaccactgcactccagcctgggtgacagagtgagaccccgtctcaaaaaaagagcatctggctgtagaaaggtttttcccaagtatgatccaagcgttaggactcagctccatcctggtcagcattcgtagatggccaagtgtgtgtcattgtggatggctcctccctgggcaccaaaggttggtatgtagccaccttcctttaaattgtggcaacagtggtggcagccaaggacagctgctttgtgggagagaggagttaaatgtgagaagatttattttggttctattaccagcggtccttttctgagtgaggcttaacaagaggcaaacgcctaatgacctcctgagtatcaccaaagtgttcaagataggcttgaaaagccaaagaagatgaaaagaaagaaagaaatcaaagggtccttcaaaagaaaagaagtagacagtaacggctataggatttgggatcactttttccctgcttggcaggttggaattgcagcttaggtatgttgaagggtagttcccctctaatggtattattgatactagactctctgttcccacagagagagctatgttggggaagaaagaaaatatttgatgtctgattcatgaacacgctaactggcccatgcattgtggcagagaagtaacagctttattttgaaaaatgtcaaccttttaaaaaaaaatcaaagaaaataacataggatttttgtcactcatggcatgccttccacatggctttgttttccaaacctggccagcctgcagtttccttcccatagtggggaggagaatgagcctcccacctggagagtgtggagccccaagaagcagcatcctctggtggtcccaacatctgcaaatagatgagacagctgactcctctctggctggacttttgtttttgccctgtgcctgtctaaccttgggcaagcaaaagatctgagagcattagggctggaaggggccttggagaacattgagcccaacctccctcccccttgtacaaatgggaaaactgaggcccacagagagggagggacttgctcatggtcacacagccatggagatagagccaagatttgaactcagggttctttcttctagtctttgcaactatgggctgcagtctctctcagcagtcccaagcagcagattagtctcctggagaggcaggggcatgctttaattgctgccaatagggaaagttatagaaaagagggacagacctacttgctgctctcctcccttaggtaaacagccttgtctatttctagtcacatttcccttccagcgagctttcctatgttatatgccttgtaagtagagaatcaatgaagttcctcagttacagaggagattcaggtggacaaagccatgttatagacctaagtccccttgtggcacaggttttgtcctcaaaccatcatactgaggcacagttcatgcatcacctcctccagggagcatttcctgatttccaagactgagttgcacaacccctcctcaccttagcctttatcaactgtctgtcatggttgactcatctgtctctttctctgggctttgaacttcttgaggacagggaccttgtcttctccatgtcccaagtggatagcacggggtccagcccaaagtagacaatcagtgttttttaaatgaccgaggactcagattcccatggtaacaaaagtttgactcttgtttcctcggtgaattgaaaaaccaaccactgtaggtagggaaatgggaaatccaaacgagttgtttgttattcactgggcaggatacttcatgggactctgctagctcaagtcctgaagagccctgctctgtggtggtatgtctgccataggcccacctgtgcaatccctggtgggtccatgggattgtttcgcttggatgtctgtgactgtagacttcaggaacaggatacaggttgttcaatagatttcagttagactgaaaggccatggctgaattctgttgtccttcacctaaacattattggagggaggcatcttcctaggcagagggagtgaggtggggattggctgattatgaggaggccagagcttcaggtcagaatgttttttctcatctaaatgtattaggttggtgcaaaagtaattgtggtttttgcccttaccttttttttttgagacggagtctcgctctgttgctggagtgcagtggcgcgattttggctcactgcaagctctgcctcctgggttcacgccattctcctgcctcagcctcccaagtagctgggactacaggcgcccgccaccacgcccggctaatttttttgtatttttagtagagacgggttttcaccgtgttagccaggatggtctcgatctcctgacctcatgatccgcctgcctcagcctcccaaagtgctgggattacaccgtgcccggccgcccttacttttaatggcaaaaaccacattaacttttgcaccaatctatagcttggttttcattctctggccttggagtaagccctacaggtttacatgcaaagatattcccattcctaaaagccgtgtaccgtaggatcctgggtcattggaggcagtatcttttacttagactcatttgctccaggaaagtgagcaaaacatctctttttttgtactgtagccaaggctgttgtaggaagcgttgtctgtcattctcaatgctgactgcacattcaaacctttttatgtaaagttgaaaattcacctaagattttaagtaagaaaaaaacagaaactgataccagagttaataagaaaaacaattgttgctcaggccctactcataccaattgcgtcagaatctcatgggtcagccttggaaacactctctagatgttttttaatatgcagccagaattgagaaccactgatctaagtagaaggtgataatgtgttctcttcttgttctcagttactttctaagggattctaaagccagtgacccttgaaaccagaactctcaggattttccccaactctgtgaaggtttgagacacaacagattttgagagaaatactcattctgctctcacctagagctttgcttcagtctaagttgtgtctgggtccacatcaagcacatgggtaagggtacaaagtatttggggaaggcaattctcttcccactatgctttataaggccccagacactcataattttgacttcgatttcattgcttgggcagagtatctagtcctttctcacagattacagaatttcaggtcttaaaaaaaaaactatcggggctgggcgcggtggctcacgcctgtaatcccagcacttcgggaggctaaggcaggcagatcctttgaggtcagaagttggagacagcctggccaatatggtgaaaccctgtttccaccaaaaatacgaaaattagctgggcacagtgatgtgctcctgtagtcccagctattcaggaggctgaggcaggaggattgcttgaacctgggaggcagaggttacagtgagccaagattgtgccactgcactccagcctgggtgacacagcaagactctgtctcaaaaaaataataataaaaaaacctgtggatattttgctcagtacctgggtgatgggatcattcttaccccaaacctcagcaattacacaatatacccaggtaacaaacctgtacatgtaacgcctgaatctaaactaaaagttaaaacaaacaaacaaaaaaacccaaatcataaaaaagttacctccaaagtacattcataatagtatagccagagcagttctaagtaattttaaacggtgagtgagagaatgtttgatacctggcttccattcattcattttctttggtctgaatgtgtagtgggcacatggtggaaacagatctttgactttggggcttttgaggtttgaggcttacagagagagccctcagtaggaggaggggtgtgtttacataaccctggggcaccctgtcaatgtattctgtgcagccaaacagatcaatagagtgaaaaaaacaattcagctgagtgaactgataggctgataggttatttgattgactgggctggtggagccactcaagaagaaactacagtgctataacttgggaggccagataaacagctgatgccaaaagcatctgcttagcaatcactggagcccagttgacacaagctattggaaccacatttgagtaaaaaagatataaagtgcactggggtaccatgactatgggtgaatcttcttcctcatcatactgtagtccttcagatctcaggggccgtgtagcttattacctccaagtttcttcttaaggagagaagagagcacagctctgtagtgactctaaagcttctcagctgtgtggacttgagcaagtgatttgacctctctgagcctcagttgcttcctccagccataggagtaaatatattatgtacttcatagggttgatgggagagttcagtgaggttagacacagaaaatgcttagaaaaatgcttgatgcatatacataggaagcatctaataaatggtagcattgatgattcttataaaatagaatgctgcaggccaggcatggtggctcatgcctgtaatccaagcactttgggaggccaaggcaggagatcacttgaggccaggagtttgagatcaacctgggcaacatggcaagacccgtttctccacacacacacacacacagacaaaattagccaagcatggcagcacacctttgctcagtacctgggtgtcacagctactcaggagggtgaggtgagagaattctttaagcccaggagattgaggctgcagtaagccatgttcacatcattgcattccagcctgggcaacagagtgagaccttgtctcaaaaaacaaacaaacaaacaaacaaaaaacgctgcaattggtgcagtggataggacacagactttggtgtcagatgatctgggttcaaattctggctctaccacttcctagctgggtgcctagggcaagtcagtataaaatctcttggtaggtcccacttccctcgccctctctcatagctgaagggtgaggtgaggtaagcctttagcaatgggcttggtatgtaagtggtcaataaatgctggtttttatgattatcaatcgccatcaatatgatagttactgggaaattgccctagttcttcagtcactcctcagtaggacgcaatttccttagtgctagtcattgcagtcccctttttttggttgtgttttggtttgccatttactcccatgtggagtgtgggatacaaaatgaaccctagatccatgccctggggcctagccttttcataaccctgccccactcattcctgtttgcttatgcagagcttcccgtcaatgaaagccccaaggtcctattgtaaggcctgctgtgaaaccaggtctcccccagcttctagctaattgatattctaaaaccttggattgcagcttgacctttatccttgtcaaatatctcttgggttttggcccatgattccagccagtcattggctctttgtatcccactttcttgattattttggttgcgttttttaattaggcgttgtgtgttgcagagacacatgatggtgcttaatcatgccaccatctccctcattgctctttgtggttttgtgagtcttgaattgacatgtgtgctcctcatttagccttcctgaaaaccctacctgctgcacctatactttcaaacatgcactgctggtcatctggaggcatttacctgaaatgttaccatggtgcctagacaggactctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaagatttggctggttacaataaggctagatgggctagatgaggatacacaacaatggctcaccccaatttggggaagtcctttttggcctttatgcaatgggctctctaaaggactagccatgtggtagcctgtctaggggtggggtacacagtgggaggagcccttattgatggtcttggggtctggaacccatttcctgctaggcaactgactcatcctgtgacttagggaagcaagccattgcccatctctgggtttcagtttccagagggtgttagattggaaggtttcttccagatttgaactttgactattttagtgacttaagagaaacagctgaatccaagtgcaaacgtctgtcttgcacctttaaaaagaaccaaaaccacattgtaggcaaacgatccccagtttgaaatagcagcttccgtctttggattgtgtcctgctgcccattctttctcagacctgcctggttccacacactggctgaccatacaagaccttttcatctcagcactagatgtgcacgtcttttttcttgactgtgctctcagaatactgggagagattttttacaatactgttactactgccatgaatagcacctaccaatgactgtgtcttgtgtgacaggcactgtgctgtatgctttgtgtacattttctcttttgatccttataatatcctatggagttggcattgttattaatcccttttacagatagagaggagggatgactcatggaagtgacacacagctagtaagttgcagacttagtactgccagatcccagggtcttaatgagtattataagtatgctttttgcatccctgggtggaacttggatgtattaataataacaacagtggcagtatctcttatacgcagtgaggtaggtgctgttatcctccattttatagaggaagacagcaaggctgagagagatgtggtaacttgcccaaaactgcataactataagaatccaagctgaaacgaatctgaggctaattgccctcaaacccatgctgttggccaggcatggtggctcatgcctgtaatcccagcactttgggatactgaggtgggcggatcacttgaggtcaggagttcgagaccagcctgaccaacatggtgaaatccaatctctactaaaaatacacaagttagccaggcatggtggcgtgcttgggatgctgaggcaggagaattgcttggacctgggaggcagaggcttcagtgagccaagatcacaccactgtactccagcttgggcaacagagcaagactctgtctcaaaaaaaaaaaaaaacaaaaccaaaaacaaaacccgtgctgtttcttctacaccatgctgcctttagggctagaacaagtcttaaagaggctgtgggtttgctttctattctctgctcccaggaactgtggcactgcttttctgaatggctttgccggcgcagctggccaggcttgggcaattcagggttcccatagtgcaagagcagcatccacccgactccatctcccagaagcatgcagtacttactgacaattgtatgcccaaagtaggtaattttgccttttcaagcacaaaaaggtaaatcaaattatacccaatatagagcagaggaaaagaaggaacaaatgaagtaggaagaaatgcattcccttctgtgactctcctcagccactgtctgtgtcactgtctataatatatactccttgcttttcatttccttgcatatcagtgatccatgttcccagtggtgtctaaaggccacctgtattcaactgttagctgccttgcatgtgcctatctctcagtttcagcagctgcttcctcagtttccctagtcttggcaggtaggagctttttacctaaccaatagaggattgccatccagtggtacatattgggaactgcatggctgaaaaaaaaaaagtcctgaatttttttccccctttctaaaggcaaacaccacccattcctcaatcctacttaagggattaactatgccctttcttctcttttttcttagtcttttgtcagctttgctgctcattagctcttatacaagaagcagagcaggagaagtaaatgcagggaaatacaaatcactgccggatttcagcacccccacacccccgctattgtgaatggtttgctgggagagaagctctaggaactgatggggttcagctcattcagaaaatcctgttctcctttggtattgatggctgaaaactctgattacatctgcagagcagtgtgaatagtaggttctaaaaggggctgatacaaaggacaattcacaacagattacgtacaagtaggtaataaacaaaaggcaaaaaatcaacttcacttgtaatcaatgaactgtaaattaaaactaacaagagaaattatttttgcatataaaattggctgagaaatgttaaaatcaaaattcccagggttgacgaagatttcgtgaaatggttgtttttctacactactgctgggagtcataaattactcagcctttatggagaacatgttgacaatgtaatcaagagaattaaaaatgtctatgcgctttgaccccatagctttgttactagatttcacataaagaattcatcagacactactgtttatgtctacaaatcttaactttccctattataatagaaaaaaacaagactctgaatgtctaaaaagtgtttcttaaactaaggcataatcataggctagaatattacatagcaatttatccaaaatcatgttcttagcaaatatttaaggatttaaggttttaggaaaacgcttatggcataatattttttaaaaaattctctcagggtacaaaactaatcatatctcctctttgtacgatataccttttttttttttttttgaaatggagtcttgctctgtcacccaggctggagtgcagtgatgtgatcttggctcactgcaacctctgccccctgggttcaagcaattatcgtgcctcagcctcaggagtagctgagattacaggcacccagcaccacacctgactaatttttgtatttttagtagaaacggagtttaaccatgttggccaggctggtctcgatctcctgacctcaagtgatccgtctgcctcggcctcccaaagtgctgcgattacaggcatgagccacaatttatagaataaaaaatgaggctaagggaatgatagtccagcttaaacacacagtcactactaagaaaatgattaaaagcctgtacattctggactcatggagttagaacttaaaaggaccttggagtacatctagtgtcagccccaccaatgccactgaaatcccctcggtgactacctgacacactggttcaggcagtctctctttaaatactgtggttaaggaacttgctcaccgcctctggcaaccgcttcttcaaagtaaatgatagtgataatcccatccctggtgcgcgtctagtgatttatagtctgtgaagcttctaaaggcacattttcctctcacgaaccctgggaggcagggagaacaagtacatttatctgcattttccagatgaggatcctgagttgaagtgactcccagtggtaaagtgacttgtgtagctggtggataagataggactgcagtccaggtttcctgactcccactctgaggcttgttccagccctccacaaaatccagggtctagtttcattcaagtatctccttttattgagtttatgttggtcttgctatagctgtgacccctcccatgatacctcatacatcgtctcttagaccttgaaagatgtgcttggatgtggggccacatgctagctagctaaggtccagagtagggtgaacatggaaagagctcagggggagaatgaagaaaccaatgagtccaccttgctgcaaattctagcagtctccacacaggaatctgcaaccatatttatgaaacgttgttttcataaactgctgcttgttcaataaggcataaaatagccagtataagatagttatttgctctacaatatcgtttctgcaacacagcttcaatgtcatagcagttactgcattttgtttagtttcttaagagatgtgacacagtagattaaccattgacatcaaaatgcagaggttcccttagagctgtcagcaatcttgttccattcttttcccacaactctgcatcccgccttgggaaagcatttgtacacttccactgcaaggtctagtcacagacccactcggatttgtcaatgtcatgggaaagcaacaggcaggaagacaactttctatgaccttgggatgctatctgtgagttaggcaaaggaagctgagattcagtccattactggttatccctgtacacggatggtccacatcccattccagggactatgaagaagggcaaggaagacacagtagagttttccttctcacagaggtggcaagagaaatacacaggaaaggaagaacaagccagaaaagacaggataggctgactcttccaagtgcagtgagagctctaagagggaggtgactcactgagggctgccggttcaggtcaggactaggtcagaaacctgctctggcctagacccaagggttggcagagaacagaaacagctcagtgggtttgagaacaggatgggcactggccacgggagccaacaccatgaggtcctgatcaaaccctgcaggcgtcttctctggtgcagaggcacctacttccaggaactcagtctcagaactcagcaggaagtcacaccagccctcccacgcctaatctgccagctgctgcagcgggcacttgcctgccctggctttggagccttcattcttgccctagtgggggcagggtatgttctaactagagaaatgccaaacacctatgcttgccccttccgctggtttgactgttttcccggaatggacctgagaaattcagtgaaatgattcaaagaaacaattagttgattccattagaaagttagtcaaactggtatttaagctgaatttattctggcagatgggcttgcaggggtagactcctgccatagttcctgaccatctctccccaccgtgttgctaaaggtgggaggaactagaagataaagggagggccccagtgggaacgaatggaaataccaaaagctttgtgcgtgtctgcttccatccagctgctaactgttgtcccactccattagcccaatcttgcccagtaagttctcatgacagcagtgcacatcccttcccaagagcaccagaaactgttgtctagcagatgttaggatacgtaaggggccaagtgagttaccacgaagggactctcaggtccatacattgatatgaagactaggtttgaagccatttttcactatgttcttcagtttgtccaggttcccaaagcccaggttattctcagtctaagatttttttgctcgactccccacagggtcgagctatgtgatctatgtcaagtggtacctcccttctgagcctcagggtctccatgtgtaaaatgagatcgttaagtcagatgagctcagtggtaccttacagctcaagcattcattctgtgaattcaggtttgtcctcttttggtccaaactgaaattgccttcatgggatgacccaagtgtcttgttcctaccaatattcttataaactcaattcttttctatctttttaattccctaccaatgtgggcatatgggtccactttgttcctttcacaaagaaaatggtctgcattgaggtttcttttcaagaggggcaaggaggaatctcgtatttatataagatactcaggcccatcacctgataccacccttccatcttaggtgtgtttgatcattcattcatgtatatatttattcattctctcattcagcaatatcaacggtgtgactacctcatgcatagtatcatggtgggcaatgcatatgcataagaatatacagcatgatcacttttgtaagatgggaggtgattcacaatgaaccctgctgccatcctgagctgtcaccctactggagtcactctgcgctactacataccacccctggcagagaccctgaaacttacaccatatcattagaaagacaagctacctgtgtttaagagtattgcaaatgatcaattcataggctaagcaatctagaatagagagtacttaaaagacgttaaacctaaaagaaaagaggaaaaattgtgcaaactaacagaagctatatgtgtgtgttttcattcctttgatgggacactcaggagactttgagtatcagacctagtgttaagagggctattcttaagacctttgattaaatcagtcaaacttggagtcagatgctttcaatgatactcttgtataattcttacccctttacctgttttacagaaagggaaactgaggccctatgtggccttcactataatgtctggttgcttagaacacagttgcagttgtccgggcacggtagctcacacctgtaatcccagcactttgggaggccgaggcgggtggatcacttgaggtcaggagttcgagaccagcctggacaacatggtgaaaccccgtctctactaaaaatacaaaaattagccgggcctggtggtgcacgcatggcatgtaatcccagctactcaggaggctgaggcaggacaatcacttgaacccaggaggtggagtttgtagtgagccaggatcgcattactgcactccactctgggtaacagagtgaaactccaactcaaaaaaataaataaataaataaataaaagcacacagttgcagtgctgcaaaattcctctttctttaagggagaagatgaatagtgctcaatcctgatatcaggaaaagtcacaaggccctgggtctccagctccaacagttctttctctgtggcgtcctcgggccaaagcccagctatatcccagctccatgtgggcatccagagaaagcagaactggagaaagccttgagaccagccttcctgtttaagctgtagtgattgacaccaggaactttcctcacacacctttatttcagattactggcctactcagacctttgcaaccttcctgaccccacaggcatgattaactgcctgaattttttgtcacgggtcggttttcccacctggtgtcttgcgtgcttttttccttggaatttcttggaatctttacacgtttttgacacctgctttgaccttctagatcctggagcttttgcccaaaaggctctgaaacatgcatcttgcctatggagcccgcatcctagcctgccttacttgggctgccttgataccatcccccatcagtgtgacaatgatgattctgggcacgtacaagcctctttcccaggaagctggagcaccaaatgacagctgtgtttgagggatggctccgttgacaactgattcagaatattgacaagacttcattatgtttttgctcttgtgtttacatctttcaagtgtgtttgaaaaatcaagaaaacaatacaatttggtttcccaaattgaaatgacaatgaaactgcctttttatttatttaatttttgttattctcatatttctctaggcctcttctcacacacaccaccagccaccaccccccatccccatctccccaccaactttctttctggaaaagacacatcccattgtagctgtactgatctctagtcacatactgtatctttgcagatctctctgtcattgctctttctgttctcattcatagatgacacagctaaagacggtatccaggcctatgcaggtttggctgaaagggccaacatggcattttcttttcctaaagatggtgctttggtttgtagctgtttgctcctgcctttctgtttttcgggaagcctgttggctttgcttgtaaagagacagcctgtaaggctatggtgattgaaaccagtcagcccagtgcaattcaattcggtggaagaacactgagtgcctattacaaccaggaatctaaaggaagggggagattcacccttaccttgggagcccatgtggggaaatgcatatcttcagagaggggaaaaggctgtgagagttcacaagtgggagtgacttggctctctcacctagttttcaccaactctgaccactttatttcacctcccattttaaaatgctatcttgtcttggcttgattgatatgttatttctgtgattttttttcctgcttttcttcgttgctaggtcttctttctccctctctctaactgggatttcttagatttcttaaagacctcatggacattcctataagtatgtgttgccaaccttctagacccaccaatcagaaaccaaactcatcatcatgccttcccgttttgttaatgaagtgccacttttttgtccaagatagaaacatcactgtcatcttgagctattccgtcaccatcctttctctgccgtctgcatattaattgcaagttttcttgattctattaagaataaagaaatttgagagctgccagtaacctaagaggtgatctagtatggagttttcattgtctcagggagtcagaggattagtagttaagctgagactagaactcaagtctaagattcctagactgttgcttttttttttacttcacatgaccctaaaatataggtaaagttcatagactttagaaagaaatgactaagttcaagtctccactcatctctaccatttgctagctttgatcgtgggtaagtagcttaatctctgtgcttcatctgtaaaatgaaatgaaaataccttatgtaaaggaatggttgttagaatcacatgagaaaatagcataaaacacttagcatcagatggactctacatgagatcacctcagttccagatctactgctaacactcttctagacctttccatgcttactgttaaatcttatctttctaatatggaacatttagactctaaagctttttgctgttctgaatcctatggtcttaactatgtaaggaattcaaattgaagtagagtttcaacatcttttgaaaaagagagtttctgcaaatgttaatacctcagattagctcaaagaaagataaaacagagagctcattagtaagtacttgtgaggtacttccaaaattctgctttgttaactttgagaggcaagcaaaagagacccgtagctagtctagacttaagccatgtccagaaagagtggctgattggtttacttgtgaggtttgggtagggggaatagtatcatactagatatcctgtttaatagcctgttcttattttcacttaacaatatatcttggtcatgtattgtcaatgagcaaataactccttatgagccctagtgtacatgcacatttagtaggggaaccctaagagattggaaaatgcatgagaggaagagatttctggaactgcagggctgtctaaaggagtgggaatatccttggagccattgagaaagggacagagacagctgacatctttctgagagtagaggacaaagggaggaaaggtagaggaagaaggttgcctaagaactcatggctctaatgtccttggtgattgcttggcctaaaacacttcaagccttacaaactgctttttaagacaaaccagtgtcatttaaaatcactgctagggatagcctttctatgtctagttaccttagattatcagagctgaaagaacttcagagatctctttaaatgtaatatgaggaaactgaggcccagagagcagaggaatagttcaaagccctcccaatggtttgatccttggtagcataatgagcagcatattagctcattttcatgctgctaataaagacatagccgagactgggtaatttataaaggaaagacatttaatggactcacagttccacatggctggggagccctcacaatcatggcagaaggtaaaggagaagcaaagtcacatattacatggcagcaggtaagagagcttgtgcagaggaactcccatttataaaaccatcaaatctagtgagacttaccaccacaacaacagcataggggaaaccagccccatgattcaattatctccacctggcctcgcctttgacaagtggggattattacaattcaaggtgagatttggatgggaacacggccaaacggtatcaagcagtatttaactggttttgtgtgtgtggagagggaacagatgaatcatttgtattattattcctatgcctaacgaaactaagtcatatgtgtacttaagacagagaaccaaaaccttgatttttctcttgtagggggtggctaaactggagttagaagcctactttgcctgacctttttagctttgataaaggcaaccttgattcatgatgcatgagcctgggtctttgaaaccaataagaaatggtttgttcattgaacgtgcaaacaaattactttccaaagactaaaatttaaactgacattaagctccaagagcatctatatttaattatacgtaaaggccagaaaacaatttgtaaccttaacatagtaaaattaaaagagaaatcccacctatgcaaataatttatttcagtgcaacactaccctttaggattgccatcgtttgcctgtattagcagtgctggctttaccaatatttccagggcggccctgaaatatgagtttagattggaaaaaaagcagtcagagtagctcccagggcaggctgatgctatagaaccacggagtgtgctggcttccccaatttccttttttttttccttttcttctgagacggagtctcactctgtcacccaggctggagtgcagtggcgcgatctccactcactgcaagctccgcctcccaggttcacaccattctcctgcctcagcctcccgagtagctgggactacaggtgcccgccaccacactcagctaattttttgtatttttagtagagacggggtttcaccgtgttagccaggatggtctcgatctcctgacctcgtgatccgcccaccttggcttcccaaagtgctgggattataggcgtgagccactgcgcctggcctgagtgtgctggcttctaacaagatttgcctcttggtaggaggaataataatgaaataccgtctatgataatatatttctctcgggatgtatcttaggggtcaaaatgtagtagaaggaacacaggcaagaaagcacagagatctgggtcctaaattggatccagagcaactcccatctccactctggccctcaggctcttcatctataaactatgaggcttggacccagtcagtgattacattggaagaaaagggagagaatgtgaaatgaagaggatgaatcaaataaaagtggcttcgttatttctgaatgctccctcaccttcctccactccttgacatacacacatgcatgcatacactagttttcccctcagttgagcatgagagtcagttcccctcagttgagcatgggagcatgagagtcaggatatctgggttctcatcccagctgtttcttgaactctctgtgtatcctaaagtaaatctcttgccctctatctctgttccccatctgtaggatgaggagagggtgttgggttttcattggtacccaccaggagtgtgtatatatgtacacacacacacagagtccatccccagctaactaaagcagggcttcccctggggcagggctctgcaggtctgtgtgtttcaatggcttcccaggtcactctgatgtgtacttctagcttagttccctggctggccagtctctgtgggccttcccagctctgccattctggaagacgaatgggcaattttaggggccttttcaggaactgtgtgtcctgctgctgtattctggtggcacagggattagctcaactgcattttcagctcaccccttccgagcagagtgatttcacaggatgggagctgtgcagagggcaggaggcacaaagaaacactctgtggagtcacaatgtggcaagccgccatgacgctgctcttaacctcccagttgttgcccacgtgggcttttcttgaactatgcaggaacctgattaaattaattgattcctggcttttcgaaaatccctctctggtgggttgcatgctgcttatcaagatgttctcgggaagctgatgccaggttaaattccttgcactgagaaggccagagccggcttgattcagacatggatatggtagaggagggagggcagcctgttgcctgcttttctttccttgtcgctttagcaaacatggagcattacaggccaaatgtgcttgctgagtggaaaccaggaggcactgagcgggtggctcagtctggaacgcacagggcgtagtgcttcttagcacagcttctgagcacagaggagactgcaacaaatgatagctgctgtgttattgtagtggcagcgcagtgtaagggaagagaagctccctgaagaagacttggatgtaaccccagctcttctgctcttcttgacttgcagatccaaaattctcagcttccttaagtttcttggtctctaaaatgaggaggctggactcaatcaattattttcaaacttggactctcagggttctgaggaggcaccctgagggctgcctcaggggtatggaaggtggaagaggaggctgagcaggcagaacccagaccctctaactgaccacctagagcctcaagaacaaactgccattcacatcatagtctatgtcaccagttctcaaacttttccatctcaggactcctttatactcttaaaaatgactgaggacctcaaagagctttggttcatgtgggatttatctattgatattgactgcattagaatttaaaactgagaaattttcaaaaatatgtattaatccatttaaaagaacaatagtacctattgcatattaacatatttttattaaaaataacctatttccaaagtaaaaaaaaataactgagtggcattgttttatattttgcaaatgtctttgatatctggctccatagatgatacatggattctcatatcagcttctacatttgatctgttgtgatatgttgtttcggttgaagtatatgaagaaaatccagcctcacacagacatatatttggaaaagagaggcccttacggactccctgaatgattctggggaccaccagtgtctttataccacactttgagaactgcttctctacctgaattgcactccctggagatgtacagtgcccatcctgctgggcaatgaatggcagctcttctctcactccctcccccttcactgtatcccctctttatttaaagcagctcagtttttctattttatataatggagatcctggaagattttatttgaaaaaaggagtctgcttctaaaagtgtttgaaattcacccaccttaatcttaggttactgaagatataaggatttggaagctgattgagatcctatcactcggatttttctcccctaaggatgcaaactcttgggctttgaggagggtcctttggcattgtgcctcagctcttcctggacagtgactggcatgtcatcttgacagtgacagtcttagcacatgaaaatgccactgaatgacttgaaagatttaatgccacttcacaatgggactgacctgcccagggagtgatacaggctgaaggtggaggggattcaatatttgttgagctgtctgatcactgaagcagagagatgggccataagggcaagtttcagtgatatacttctatgtcgtcatctttagagctagacattcatcatcattatttatttcctagatttatgtcgaactttcattccaagggacaggagccagtgttgaataccatgggatctaagtgccttcacaacccattgaagcttcctccaatttcttgtttaataaagaaggccgtgctcttctttcccttattgccagagtcattattgatttcatgttattccttttataaaatcacctcctgggttttcctaggcttggctcttatagccgagaatgttctctcctcagccttctgctgggcctgatgctgtgaatcccatctatgtgggtcaggggacaattccacagccatcttgccaacatgcccgcgttaggctgtgagcatgcgcagaagtactctcagagctgtggaggaggggaggctcccacacccgctgccttgtccttatttgttttgtttctcccaccagcctaggcattaattaagaggcccagactcaaaagcccaccgttagggtcaatcatttgggctaattgagtgtttccaatttagtggaactcttctctgaaagtaagaaataaaactgaatccctgggagaaaccggaacccttgtccattgctggtgggaatgtaaaatgttgcagctgctatggaaaacactttggcagtttctcagaaagttagagtattatatgatccggcaattctactcttaggtatatatctaagagaaatgaaaacacatgttcacatagaaacttgtacattaacattcatagcagcattaatcatgatagtgaaaaaatgaaaacaaccccaatgcccatcagtggatgaatggataaacaaaacgtgctgtgttcatacaatggaatattgtttagctgtaaaaaagactgacatgatgattggtacatgctacaacatgcatgaacctcagaaacttgatgccctaagtgaaagaagccagacaaaaaagaccacatactgtatgattccatttatatgaataatccacaatagacaaatccatagagacagaaaacagatgattgccaggagctgaggggagggtggaagggagagtgactactttacttaatgggtacaaggttttcttctagggtgatgaactagatagaggtgacagctgcacaacatgtactaaattccactgaattacacactttaaaatggttcattttgtgttacatgaatttctcctcaataaaaaattcaaaacaaatgaacaacaaaacaaaacaaaacacctgaatccgtggctgctaccctctttcgagctagtttctcttatgaatgtgtgtggaataaggaacccaagcctgggccgtgaactcttccagagtgggaaatgggcttccaataactcgtagacactcaatagttatatactattgagtatataactattatcatgtatggagatatcatatatggtttcccatattgctgtcttcactgtaggctcatggaaagcagggaccatgtcttattcacccttgaattccaagcgcctaagcaccattcccagcacataggagacaatagatgtttgctgaatgaatgaatgaatatgtttgtgactcctctttattcatctctatgcccccccccccaataatgctagtaatagttctaccacagctggtgctcagaacagatctatggatttgtcaagtgagtggggatgagattgttttagttttagtttttttttaaggttatttatttcaaatgaaccttaaagtaaacttaagttccataaagagtcatattggggttttgattagcgtttcattactattcactaaaaacacttttttcaaaaatgagatataaaaattggacaggatgtagaaaaataggagatttggcctatggagattcaaaaagagtaagagagagatctcagctttaataaggggatgagactgattagatgcattttactttaaaaaaaaattgtggatatctataaaatggaacattatccaggccatgaaatggaatgaagtactgataaatgctacaatatggatgaaccttgaaaacattatgtgagtgaaaaaaaagccagatacaaaaggtcactgttatatgattacatttatttgaaatgtccagaataggaaaatccactgagatggaaagtagatgactggtagtaggggctggaaggaatagccagataggccagggacagctaaagggtacagggtttctttggaggtgactgaagatgttcagaaatggactggtggtgatggttgcacatgtctgtgaatatactaaaacccattgtatactttaattggatgaattgcatggtatgtgagttataccttcataaagctgttagaaatttagataaatgtcagaaaagtaaagaatacaatttgaatcaaaaacaagtgtgactgtgttttgggagagatcttcatctaaaatataaaataactgcctggctagattcaaagggtttctctaggaaaagattcctttactttttattttttattattttttcatttttaattttaattttttgtgggtacatagtaggtgtatatatttctggggtacttgagatgttttggcataggcatgcaatgcataataatcacatcatggaaaatggggtatccatcccctcaagtatttatcctttgtgttacaaacagcctgattacacacctagttattttaaagggtacaattaaattattattgactatagtcaccgtgttgttgagatatcaaatactaggtcttattcattctttctatttttgtattcattaaccatccccaccttccccctacccccctccactacccttcccatcctctggtaactatccctccactttctatctttatgagttcaattgttttgatttttagatcccacaaataagtgagaacatgtgatgtttgttcttctatgcctggcttatttcccttagcataatggcccagttccacccatttgttgcaatgacacggtctcattcttttttatggctgaatagtactccattgtatataagtaccacattttctttatccatccatctgttgatggacaccttaggttgcttccagattttagctattgtgaacagtgctgcaacaaacatgggagtgcagatatcttttccatatactgatttcctttctcttgcatatatactcagcagtggaattgctggatcatatggtagctctatttttagtttttgaggaacctccaaactgttctccatggcagtcatactaatttacattcccatcggcagtgtatgagggttctcttttctccacattcttgccagcatttgttattgcctgtcttttagatataagccattttaactggggtgagatgagatcttattgtagtttttatttctctgataatcagtgatgttgagcaccttttcatatacctgtttgccatttgcatgtcttcttttgagaaatgtctgtttaaatcttttgcccattgcttaatcagattattagatttttctgtaaacttgtttgagctccttatgtattatgtttattaatcacttgtaatgtcagtagtttaaaaatattttcccttcactttattatattattatattatattatttctctcttcactttatttattatatcctttgctctgcagaagctttttaacttgatgtgagcccatttgtccattttgctttggttgcctgtgcgtgtagggtattgctcaagaaatctttgcccaaacaaatgtcctggaaactttccctaatgttttcttgtagtagttttagagtttgatgtcttagatttaagtctttaatctattttgatttgattttcatatggcaagaaataggggtctagtttcattcttttgcatatggatattcaggttttccagcaccacttattgaaaggactgtcttttccccagtgtatgttcttggcaattttatcaaaaatcagttcaatgtccatgtatggatttgtgttggggtcctctattctgttccattgacctgtctgtttttatgccagtgccatgctgttttggttgctatagctctgtagtataacttgaaatcaagtagtgtgattcctccagttttgttctttttgcttaggatagttttggctattctgggtcttttgtggttccgtagaaattttaggatgatttttttgctatttctgtgaaggatatcactgttattttgatagggattgcatcaaatctgtagattgctttggtagtatggacgttttaacaatactgattcttccaatccagggacatggaatatctttccattttttggtgtcctcttcaatttccttcatcagtgtttcatagtttttttatagagatctttttctttgactaagttgattcctagatatttgattatatttgtggctattgtaaatgggattactttttaaatttcttttttagattgttcgctgttggcatatagaaatgctactgatttttgtatgttgattttgtaattgcaattttactgaatttgtttaccagttctaatagttttttggtggagtctttaggttttaccaatataagatcatatcatctgcaaacaaggccaatttgatttcttctttttcaatttggatgccatcatttgtttctttcttttcttttcttttcttttcttttcttttctttttgaaatggagtcttgctttgtcaccaggctggagtgcagtggcacgatctcagccgcagccacgcgtgatcccaggttcacgccattctcctgcctcagcctcccaagtagctggggctacaggcgcccgccaccacacctggctaattttttttttgtatttttagtagagatggggtttcactgtgttaaccaggatggtctcaatctcctgaccttgtgatccgcctgcctcggcctcccaaagtgctgggattacaggcatgagccactgtgcttggccaaaactacaagtttcattctcttgtctgattatgctagctaggactttcagtactatattggttaacagtggtgacagcaggcatccttgtcatgttccagatcttaggggaaagactttcaatttttcctcatttagtatgatactagctgtggctctgtcatacatagcttttattatgttgagctatgttccttgtatacccagttttttgagggtttttatcatggagagattgaattttatgagatgtgttttcagcgttaattgaaatgatcatatagtttttgtccttcattctgctgatacgatgtatcacattggttgatttgtgtatgttgaaccattctagcatccacaggatatttctcacttggtcatgatgaatgatctttttaatatattgttgaattcagtttgctagtgttttgttgaggatttctgcatcaatattcattagcgatattggcctgtagttttctttttttgatgtgtctttggttttggtatcagggtaatactggcctggtagaatgagtttggaagtattccctcttcctctatttcccagaatagtttgagtaggattggtattagctcttctttaaatgtttggtagaattcagcagtgaggccatgaggtccagggcttttctttactaggagtcttttattacagctttgatctcatgacttgctattggtctgttcaggtttaggatttcctcatggttcagtcttggtaggttgtatgtgtctaggaatttgtccatttcttctggattttccaattttttggcatatacttgctcatactggccactaatgatcctttgaatttttccactatcagttggaatgtctcctttttcatttctgattttttatttatttggatcttttctcttttcccttagtaagaaaaaccaactttttggtttttttgtttgctttttgtttttttttttttgtttttttatttttaacataattttattttaatacacctatatgtttgaatatttgaaatctcaatcaccttcacagcacaatgattctacaaagcattctttcctttagcctcactgtatattttatcaaatgacatgactgttcctaattcataattgggacctaaacctaatggaaaatactatttcatgtattcaaaaatatttgtggtctttttctactatgtatatctggcattgttctcaggactggactctattagttttattatgaaaatgttaacatttctccatagagttgttttacaaaaacacctgtttttcaaaaacattctggggaacaacctgaaaacttttaaataacatttagagcatggatttattttaaaaattacctgatcccttttttaatgcatattgtgactttctttaatcatgaaaagttttcaacattattttggcatacctgaaagcttttaactgtccttaaaaaccccaactttgcaatagtaaattatttcatgcatcacaaaatagtcttataaaccaactttttgtttcactgatcttttgtattgttttcttcatttacattgcatttatttctgctctgatcttcgttatttcttttcttctactgttttgggtttggtttgctcttgtttctctggttcttttttttttttttttttttttgagacggagtctcgctgtgtctcccaggttggagtgcagtggcgcgatctccactcattgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgtttctctggttctttaagatgcattgttaggttgcttatttgaagtttttcctcttttttgcaagaagggtaataagccatatttattttaaaacataaatttaaaagtacctacatcaattattattaaattgaaccagcaatatataaaataaataatgcattgagtccaatttcagttgggttcacactagaaaacctaattagtataattcaaccacttcagcaaaaggaaagaaataaatatttcaatggatgggggaaatgaatttttattattccaaaataattcatgattttgaagaactcttagcaaataaaaattaaaatgaactttcttaacctgataagcagaatctaatgaaagcttacaacagtcaccccaaatggcaagaagttagatcattccctttgaagacaggtttttcctcttttttgatgtaggcacttatagctataaacttatctcttagtactgcttttactgtatcccataggctttgggatgttgtgcttctactatcatttgtttcaagacgtttttcaattccttcttaatttcttcattatccactcttcattcatgagcatattgtttagtttttatatatttttgtagttccccaaattcttctcattttttatttctagctttattccattgcagacagaaaagatgcttgatactatttcaggcttttaaaatgttttatggctggttttctgacctaacatatggtctatccttgagaatgatccatgtgctgaggaaaataaagtgtattctgcagccattggatgaaatgttctgtaagtatctattagatccatttagtctatagtgcagattaagtctggtgtctctttcttggttttctgtctggaagatagatccaatgctgaaagtgggtgttggaatctctgattattatcgtattgggacctatctctctctttcactctaatggtatttgctttatatatctaggtgctccagtgttgggtgcatatatatttaaaattattatatcctctttctgaattgacccctttatcattatatagtgaccttctttttctcttcttattgtttttgtcttgaaatctattttgtctgatacaagtatagctagtcctactcttttttttttttggtttccattggcatggaatatctttttccatccctttattttcagtctatttgtgtctttataagtgcaatgtgtttcttgtaggcaacaaatcattgggtcattttttttttaaataaactcagccactctatgtcttttgattgaagagtttagtccatttatattcaatgttattattgatgagtaaggacttactccttccattttgttatttattttctggttgttttggaaagatccctttaaattgggctttcctttcagcagcaattcatgtgagtttccagatcattacctacttgatgaggggctaggggcagagtagcttaaaggcagagtatgaagggcaactgccaactgttgggcagttggagattgatcagaatgtatgtcagtgggaaactaggattcgatttacacaaacccagctgcctgatgatttctgcactgcctgtaggatatatggggtgtccacattttcatgaggaggaatgagcaagcagtctaatgatgtgccacttatacaattagcaattcagcaagttcaacttcaaataagcagttctgaattcttcttcctactccaggggccgtccccactacttcagtgtctatcagcttttctgaaagaagagacaccatggctacagggaaaccatggtggggctgtgtgtggaggcaagtactgcctagtgttggatgcagactgcagctgtatcctttgcccttaggcaggaagaaactcccacagcatcatcccagctagagagtagcttggatgtcacagtcagacaggcagccccagcaaccttaggtggtacagcagtttctgtggggagattataaagccctctgtggttacgaaggagttgacaagctattctgatggctttctgcctgttttccttggatcctgaagacaagagcagtccaaagttattcctgggaagtgagaatcaggcatcagccaaggctttgtcagatctgggtttgcagatgagggctcattcaatgttccttacaattgcaaaaaaatggacatgtgaaaactcacttgtaacttgaaggggcatcatttctaattgggagatagccacagagaaacgaaggggccaaaacattgctagtgtgaaaagcacataggctttggagtcagatcaacctgcaagtcccattctttatgtcttagatgcatgaccttgtccaaggccttcacctctgagccttgatttcctcacgtgtaaaaggagataggaaagagcatcctacaggggctattcttctaattaaacaatgtccagtcctcatgcctggatctccgccactggctctcaactcacctttttcctcctatctctctagcatagattgctgcgttcattttattgtagagggaccttggtacttttaagattcctgaactggaattcacaaggtctgagagatggttttgaccctgttatgactgtgtgaccttggttgagtccctttctctctcaggacctataaaatgcagagtttgggcttgatggtctttaagggtaccttccaactttgataggtttctaaacgatgtcaaggtcaaattctgaatggcctggttcactgtgctagaggatggccctgatcatttggcaagcacaactctttcccaaggcgacattgcccttcttaccattgtagttacatgggccctgctggaatgagtcacatactctagcttcttccagtttcttcccccccttggttaacttggcttggacattttggattctgtctatatgtaatttgattgcattttcctatagataagaaatataggtataatagcaaggagcacctcaccccccactgcttcaaagagagagagagagagagagagacctgatctgtctgccaacttctctttccctgtgggtccctggcctatccactgctacctgatttatgtcctaggggagcagcatagctatggtgaagatttataccaggttttcatcttcaaatgagctactacctctgttccttgtgtattcaagtgcttggcactcatagccaagcacttgaattctggaattcaaaatgaaaaatagtcccatgagaggcctaaagagaggcaaacaggaagcacttcagagtgtgctgcagccttgtacagtaagtaggatgcagtccccagctctcagtggaggtgtgatatgcccagagagattatatacagtgatccctctccacattagtgccttgtgtaggcatggtacacaatgcattagaattagacaaggcgtaggatttggagacaggaaatattgaatattcccatctcagcgccttcacttattaactgtatgaccttgagcaaatttctctttgagcctctctgacttccctgtaaagtgagaagaatgccgcctacctcacagggttgctgtgaaggcaaaatgaaatacagttagtacagctgagtggctcatgagcttggtcccagcaccctacaactctggatttgaatccagactctaccacttatcatgcaagtccgtctgagcctcagttttctcatttaggcaatgagtatagacttttgttcaggatgaaatgagataattcctatagtgtgtggcatctggcatatagtaagcactcattaaatgttagctaatggtatgattgttattgtttgtcatttaggtaaaatttccaataattctagaaaagatattttgtgtactgtgccagatggtttggcaaacttggtccatattttatatgcttggggaaaaagcactgggtatttttttggtcctggttttgaaactacaggtaagacatgaaactgagactcttccaataaaaggatacctgtttcctcatggaaagcaagtttgcgctcacaatggtgctacaccttcatgtagacagttgtctgcagcccacaaaactgttgaagtggtcatgatatttcaaaagtagcacctccatcgggagcagcagtgttaatccagttatgaatattacacctgccaaacagaaagaatcctttagccacgggtctcaagcacagccctggatgtgtggatttgccacagtgacaaagactactagcaaggtgcatggggacaagaacagcaatggcttaaagcctttttcatggatttttgacaatgaagttaattatccagatgtttcatgtacttgaccccggacactcagatctttggaaacatctggacaatgtgggggtagttttcatatctttcatcaaaaccgttggttgtattaaattcagcaggtttcattaatcacctggtttgtgccctgttaggtattattgatcacaaggaagtcacagttttattgagaaaaattagactaacaggtttgaagtgaccaatgaaaagtaggagagctgggatatgaacatagttccatcaactcctatgcttgtgctcacttcactctagcacatggcctcttttcatttggggctggctgaaaggaagtttcagaccaaatccagtggttcccaccatgccttgacttcagcagcgacctaagctcctttgctgaaagcaggtgacatatatccaaatggaccatttcatgtgtctccattgtctgatccttttagtgacttggtggaatattccctgagaattatcttgatccttattttagcactagccaaatcattacttgttagggagtttttcgttctctgtgttttaaatgtgtaaaaatgtgaatgaagcagttatatcttgtgttggcagcttgccatccttggtctgtgtcagcataaaatattttggattccatagagtagcagccccttgcgaagctgtgtaaaagatacaatgaaaaccttccttctgatttgaaacagtgctgaaatagcatcatttgtggaccttccagacccaacgatctgaaacatggaaatgaaatgggataaaataactcccagtacacatatatatacttaccttgtaaatgaaacttttcggcctttattaacagaaagcaggccctgttatacccagaaaatttctaagagattccttattcgttctttctttcctttaagtcaaaaatactgtatgtatatgatcaaactgaaatgcatcactggaacctaccatacaaatacaggtgcttgcgtttggagaattccaaaacacatatgaaaatcattgtcaagtttcagttgaagaagtcagcctgtacctatgcacattttttttataactcaactagctcccccacatcatgagtggaaaggcttctcagaagggaaaacaagccaggttttattttatggccttcaattttgttttatttcgttttactttgtttgttcaatggcaaaacatccttttcactgctttctgaaagactaaattgtcaaataggtgctgtggtaatgttttcagaaacaatgtatcctgccatagccaaggacaagttatagacaaacccgttttccacggaaacaagaatccttcagtgtctagattgttaattagatcagcactagagggcactcttatgatgccaaaatgggaaatttttactaaaatctgctgggcaggggtgtgagagaggagatgaggagggggcagtttctgtaaggactgcagaccacagacaaacagcttagacaagacatgtgcaactgagaattgactggatcgccaacagataaaacactatttgaaaagggctgtttggcagtgttccctatcagatccacttggtttccaaaatgcagtcggtgctttggcaatacacgatccaggtataaggcattatttctcaaaatgaaagagatataagaagctctgattgttaccatgtgatgtagtaaaagcacatttaggcagaaaacaaaatgtggagagaagcataggagaatgtgtttacaacttaacagctactgagaaagaagaatttcaaatccttggggtcttttatggttgttttccccatcttttgcagcccttgctctgtgaattgttctgaagggttgtgtgattgagtctgggagagcaggtgcttgcttgtctgctgcccctaggcaggctctgatggacacagggtggatgatgtgctgtcaagtaaagggacaaatggacttggttttgtctctggcattgatgtgctctgtgatctgtggcaagtccctgccctctcaaagtctcagggtcagggaagagttgggtgacactagaggtctctaaaagatcactagaagacatatccccgagtttgtgatttatgattgcggaaataacttttgttttgttttggttttagagacagtgttactctgttgcccaagctggagtgcagtgacatgatcatggctcactgcagccttgaactcctgggctcaagccgctcctcctgcctcagcctccagagtagctgggaccacaggcacatgacaacatgcccagctatttttcgtattttttgtagagatggggtgtcactatgttatccaggttggtcttgaactcctgggctcaagagttcctcccaccttggcttcccaaagtgttgggaatacagacatgagccactgtgttctgccagaacttcccatatcagtcatttatagcagccacttgagttctgaatcgaacaagatatggtaggcaccctggggtagaaggtgactctatgctgtcagtaggatggtaccgaaatgatttgccagcacagaggggcttatttgcctgtattagtcattgctttaggtttatggctcagtccaaatataacctcagagagtgaccacactaagccgtcagtaggtcccctcaaattcgctcattatgtccaagttaagcctgatccctcacttgtgtgctaggcaccagccagaatctcaggcatgcccatgtgtccttccctgaggagccagtgtggggcaggggctctgggcacttgatgggaagagtggcacactgaagacagacttatctactctgactttggccccagtgtttgctagagaaatgcatgagtgtttttgtttaagtctctgcttgtaagaacccaggctatccttcataggaatgttcctgattgagtcaaattcattataaagtcttagaatgttattggccgggcacggtggcttatgcctgtaatcccaacactttgggaggctgaggcaggtggataacttgaggtcaggagtttgagaccagaccagcctggccaatatggcaaaaccttatctctactaaaaatacaaaaaattagccgggtgtggtggcaggcacctgtagtcccagctactcaggaggctgaggcaggagaatcgcttgatcctgggaggcagaggttgcagtgagctgagatcatgccgctgcacagcctgggcaacagagggagactccctctaaaaaaaaaatgttatcatgaacagggacctttgggaaatcagctagtccaacaccatcactgtagagatagggaaacggggagccatcttcatttgggaatggggttgcctagggtttcacagccagttaatggcagagctggcattggggtatcagttttttatttctattccaggcctctttctgttaccttgtgctatatttttctctctcctgcaatgtccattctagggaataagtgaccaatggctctgaacctaagggtttttgacatagctagaatagctccgtgtttatggattgtgtcatttaaggtagtacaagtggaaagatatgaggacacatccctatcaaaaatatgtcctgtttaaatgtcataggactggagatcaaaccaatataggatcattcctctggatctagaaggctctgaagtcttgagatgctcttgcccaaaagcaaggatcaggttggaatccttgtcagctggcagggaacgaaaggatgggagggtaggtctggaaaccaggtttagtatctcgggggagggcagacactgtgaaaagagcagtcaagacaacctcagggaacttcacagttgtgccaaaggctattccttgggaggttaaaacaaatactcaaagaatacatatttgaaagaatattctgggttccagtattctcatgccaaacataaggagctccctctcatgaggtatgcatgatttccagtggacttggcatggaacaaggaggaattaagagcggtcaaacagtagaacacagatgcaggggacaaccctctcccatatcagtgatgtggttactttccgcatggcctttaactgcacgtgtctttgagctctgcttttgaaaagctggttcctttcccagggcaacaagatggctcaggtacagggggctgcgagctgtgtggcaggcctgccgcagactcactatgcctctagacaattctctgattggtcttcctccctaggtgacagtaataatgcctaaaacgtattgtatgatgactgtggacctgacattctgctacatgatttacaggcatgatcacatctaatcctcccaagtactttaggaactacccttctagactgaaacacatgggcctacctacccatgtcgtttgctgttggtttctcctctgatagggctgtcttttcttctgattggtcagttccgataccatatctgttgttaaagatggtgatcatcaccagtgtaggcattatacttgtccccactttgttttttgctgttttttttgttttgttttgctttgttgagacagagtctcaccctgtcacctaggctgcagtgcagtggcataatctcggcttactgcaacctcctcctcccgggttcaagtgattctcctgcctcagcctcctttgtagctgggaatacaggcgcctgccaccacgccaggctaatttttgtatttttagtagagacgaggtttctccatgttggccaggctgatctcgaactcctgacctcaggtgatccatctgctccgcctcccaaagtgctgggattacaggcgtgagctaccatgccccaccttgtccccattttctaggtgaggaaatcagggctgagagattaagttgccttttcagtgtcatgcagttggtaagtgaaagagctttaggaccagattccagtctgtgtgactaatggacttatttcatggtcccacaccacctctcaggactgtgcataagcaaaaggctgaggtcaagcattttaacactttgcaagtaaaaaagaccagcagcttgttttgcatagggccttaagaaacacccaggccctttgcctggctcctccattcacctccaccagtttgagcaacagtccttagcctgggactttgggggcaccacacccctttccatttagggaaataaaatttagcatgtattaacataaggcattttttgctaggatatactactgtatttggccttcagagatcaaatgaggaaggtggcttgagatacaaaaggaagtggtgggtttctgagcagcaatagagtaggtgaagaccagaatgatggtggaagggcattctacatgggagaacgtggaaattctaaaacacgtcagctcttggtgtggcagttaaagggagggtgagcacaccagttcagtgtcagaaagcagagaggttgaatggaccatttgcttggcagctctggaacagtggtaggcagttatttatcatagagtgtactatctgctgcagatttgcaatctgacccaaacagtgttggtgtgggtttcttaacaacttccttctctctagctgttatatggaagtgtgtggctgtggaggtctctgctgttgaacagccatcaccaatatcccaggctcctggcagatgaagaacctgcatgaacagaaagagaaatgtggagggtggtggcggtgcaagagggtcaattgttcatcaattcgatttttcttgtttttctcaattaagtttccttctataatttttccatcataaagaatctgccactctatgtttcaaattaacaaagctgtttctctggacagaatgatgttcagctgcatttaaatttggccattatgattttggacatactctcatttactcataaactcttcgaaggctgtgctctgggctctgtgaactactaatagcatgttgtactgagaaaatgactagggattggtatacttctaagtaacatcaagggaaagctattagagaatgaaagaatattggaactgggggaattttagaaaccatcttgtcaagctcgttcatgtcatacagcccactgggagagtggagaagagaatttgcccaagatcaaatgagtcattggtaaaacctggattaaaaaccagggatcctgattctcagtcaagggctcttggatttttacctcatcctgggttttccaagtcttaatttggatccttcatacaaaagtgaatcgtttcactttcatttctcaagccctaagcacccaccctgagaatgtaaatgccaagcataagtgtcatggtctgaggttcctgattaggatgaatccacatctggagcttttggattcccaagtctcccgctattcccattactccagtgctatatatgtgttctcttcattttcatcttttgccttccctgcttattggatgcttagtcagttgcctaagtaccatttgagtgacatttagtcacatcttctggaacctggctcagaggaaggttattcctatggctttttctccagccagtgtctgggtcatgggcatggtaaccacagctccttttgtccttccagtgctgctgctttcccaggatgtggcttgctgagggctgatgaatcccatcttagagtgtcagccaggccagctgttaaagaacatgacagcaacaaatgagaaagactctgttgggatgtgggactacagtattatgaaactgccacttagaggcttcctgtttttacagtatttcaaggtgcaagcaagtggcattctctgggcagcaaatggcccagctgaaaagaaacctgatttacagcctgttgggagggctttccacaaggagaaattatgaatttgtaacgtcccttccaatccaaaagagaattctttctaatgcaaatgtttaatctgatgccatcgagtatgttctccatacataaacaaaggcataaataaaacagggagaaactctttcctagaattgataatatacagtatatttctgtagaactcttttccaagcagatggcctaaaaatattccacaagattgtaaactctgtagagtcagggatttttgtctgttttattcactactcagtacctctaacctcagtacctctaacaatggctagcacataatagataataaatattttttaataaaacatcatgattaaagggcctttttaaaggatttcattaaacaaccttcccaaagagagtgtgtgtgtgtatgcataaaatgggttcttaaaattaattcattctcttctaattagtatgtatcttttgttttaccttttccctatgaactttggctcacttctgatgactggccacccttttgattgatgcacctgtaacgtcttcatggatcgtcactcaatactccacctcttcccacctgggctcccaggtaaggcaatgagcttccaaaagtcttctcagtgcaatcaccaggcaaattttataaggcagtcaagaagtttacctagaaataaaaaaactcaagagacaataatagtgattaaagttaaatttgatcccgttcccatataaatcaattatttatacacttaacatcatttgagaatttctgttagtacagtgaaataaaaattatggctttggaaactgctgcatacttaactttggaattttctgatcctaggaatcaatatatggctttatgttttccttctaaaaatattttcttgtgtgtgtgtgtgtgtgtgtgtgtgtgttttgtcttttcacccaaagttgtgttgtttttgttcacaaggccaaattttgtggaagggatcatagcctctcttcactgtgtagggactctaaatcatggggtaggtcagtacattgtagattacttatttcttgcggctggagtagaagacgagcacattgggctctggatggtaagtccactaataggagtgtcttgtctaacagatttgatgttaggcctcaccaagtatatcgcttttgtttctcatgacatttgcttccccagcagtcttaacagctcagaaacagggaaagggggcttaaccgcaccagagactgataataaaagagccatgtattgcttctcaaatgatgattcaaaggctctgctgctagccatgctattaaaaaaggctctcttaactcacttctaaggcctgcaaagcgtatttgctgtaaagaaacatttctcccaagaaaatgcacaggctatatagcccacttcgggcataaaagaagtgttgctacattgtaaaattccttgttctggcataataaaaaacaaaaggctaactgagcccatttgaaccctcaaattagcaactgacctgtgtataacttcacagtctccgcctgctaataatatcagtaattcacacagtggaatgagtgttttgtgacccttaagacatacattataaaaacagctgagcatgttttttgaatggggagacattgcttactttgatggatgtcttgtgtttgggtggaagggactagagagatgatttatatatcaccttatgtgtgctttgaattttcatctttttaaagagcatcagtaaagtttaattgttctttattttccttttgttatttgtgtttcgtatattcctgataatatgaaaaatccctgccaattcctcctaggacctttcaatcagtcatttccatttcagtgatgccacagggttgggtttggtttgggttttgttttattggcttttgtttttttacctagattcccattgctctctgtgaaggggaatggaattagcatgagtgagtggtagatccatcattcccagaccacagcactccagggatctggctctcagtgcagccttgccccttttagccttctgattgggaatctccccattacttgagaggagccagtggggaacaaagtggagaagccatctatgagctgtttccctaaggtttgggaagctggagaaatatgctcttaaagcacaatggaaaacttttattattttatctcctctcctaccaagctcttgctagcgactggttttactgttcctttaacaggtggaggatttttcagattctagatgcagcaaggtaagtaacaatgtatttttagtttgactgaacccaagtaagctagaaaaaagagactctgcagttgcctgtccgtttaatttcagtacaacaaatagttaagtttttggcttggacaaattctttccagggctttttttttttttttttttttttttttttagtttaaaacagctgaaactacccaggcttggagtctcagttctgaaggctgacttagttcagaagggggatgaatgttcagggcgaccaccccagacaggtgtgcagtaggtcattagctctttttcctctttttgctgaaataggatgacacagtagagtgtgttgttgagaagaccccaaccgttggcaaagtgttctttacagtgcttcaggcacgtctgcctgtccctaggctggattgtgatttagagaacaagtaggtcagcatttccttgaagggaaatcaattatttgaaaatatcagggcttttaacgtatgtaaatacgtagacttgcatatttacaagtaatcccataggccagaggcctttttgacatgaagcctgcaggagagcaaatctaatcaaatacaagaaagttcctctctgtggggaagacggacgctgagaatgctcccagatgatgcccctgcaggcaacaactgttgctaagagctgtaccatcatattgccaccagaaccggagagtctagcaagaaccataagtcattttggaaatgtgtgctctagtcgcttggcacattgttttctaaggtcatgatgctcaccagtactgtctttggctttttgtaggcttattggctccagaaatatttactagtgcctctgttttttcttaatacccacctacaatccaccctgtgctccctggccaaataggttagcaagagcaaagactgtagctctggcatttctccacaaggacagactcccattaaaatagactacttgagccattttggggatgcccagtttagctttctgtagctgggcttccatactcccattagagcctcaatggatttacttgacagctgagaatagtaaatttagtgtttaattttgtagtcagattataatttattgagctaaatggcacagacacacatagacacctaatcacacagtattagtatgggagaacatttaaatatcatagattgggtgtgtcatggaggcaaagtaccaagttctgttactaatgaggtgacttttgtcaagcactagctccactctgagccttaatttcctcgcctgtaaaataaaatggagcggatgaccattaagacaatggtcaataacataggtaccactatccctataatagcttttatggggaagtcttgagaattttgttttctttttgctttaaaattgctagatgataggaccatctctttaaaacagttttgctgtataacaaagcaaatcctgacacactctttatttttactatggtgttgattagttggaccagattattgccagagcaactaatacctggtcttaatgagagaaaacaagaggagtacagatggtgagatgggaaagaaacggttttggtaaatatcaatggggccctttttgaattttggtgagctgaatgatgtatgaaaactatttgcaaggctagcatatttttcaaccactagtaaagcaataaaacaaataacatttttggtaatccccattgtatatgcagtttcataaatatacaagattatgattatcgctgcctcataattaacaatttgcataagtacttgctattttttagttgtctgaatagatttttgtaatccagagaaagaagggaacaatcagtggaagccatcccaaatgcctagtattattgctacacacttgcacaattaacagcgatactaattgcttcagaccagaacctcatttgtttttctaaggacagcaaaaacattaatagccagagtgcctgtcaatctctctctctttttcctatagccaactgtatcatagggtctgcagttgactgtaagcaaattattttgttggattttcagtgtatcatcttgtaatggagtttccaagtttcagttagcaatcaatgccttgaacagccagacttatttttataatattttaacaatagacctctataaagttaatgaataaaaggatgctgacatgccaatcagttctgctgctgcatttacattctactacatatttcatatctttaaaattattggcattagacctgcatataagaatcatagaaagtccaggctggaggggagctttaagatcatcccgtcacactccctcctttttcagatgagtatgattgtcagtaatttgaatcttgataacaaccaccaaatcaatgatgccacacttttttttttttgtacctttcaaacgttgggaactattatagtaagtttgaatgataactggttgtttgggaatcatatagtttcaacttattttcaaaacaactgaatcagaattttaaaaatatgccctcataaggcttacctaaacatagccataatgttgatggtatatgtgtgaaaggagatgttctatgcaaatcacctggcaatgagacactcaaccaatatcagctctctttccttcatgcatagattacctaattaacattactatagtggaaacattacatcagtgactgacagtctaggcgtttagagtcaaactgacctcgggtccaatcctggcgctgctactttccagctgtgtgacgttgggtaatttagttcatctctgttggcttcaggtagttttcttatatgtgaaatgtagccagtatataggcttgttttgaggattaaaatgagatcgtgcatatcaagtgcttagcactgttcctgtcacatagtaaacagtcgataatggtggttattaccatcgttttttggcatacccagcggcagcctcactcaatagtatatttaatcttacagtgatttggggtacttacacatacacctgtacacatgcatatttgggcacacaagttcataagatttgcatcagaaagactgctttcccaaaggttacctgtgaccaccatgtttcacaattcaatggcctcttccctggcctcagtcttcttgacctctttggagattctggcacttttgcacatattctcttgcttgaaagggttcataatctatcttgatgtcttctctacattccttaggtttcctttgttgggatctcttttccacacgtacacacacacacacacacacacacacacgcgtgcccacatcttctccctcccccactgcccctttaaatagagcaattcccaaggtcctgtcattgatctgcttctcttctgttgctatattttctccctgggtaacttcacctcctcacatagcttcacctttaacctctacactaatgattcccaaattgacctctccaacccttaattcattccggagccccaggctaactccaatttccaattgcctgctgagaatctccagggcaggatgtcctaggagactgaaagcgtagtctggcttttgtcatccttctcaggaatgcagatggaggaatctagcttcagaagtattaagggttgaaaacaaggcacaagtatggagcattagtctgagcagaagtaacagtggtctaagttagcaaagtgcttcaaactgagctttccaggggaggcataacagataaactgtgaatttctgttattatgcactggagatgtcaattggcagttggaactttaaaaggtttatattttctagggataagggaacagcttcctaagatgaaaattgagttcagtttttaggtgctggaagattggcatgtttggaagaagtgttaattaaaatcatctttcttttcttttctttttttttgagacgagtttttttcgctcttgttacccagactggagttcaatggcgcgatctcagttcactgcaacctccgcctcctgggttcaagcaattctcctgcctcagcctcccaagtagctgggatttcaggcatgtgccaccacacctggctaattttgtatttttagtagagacagagtttcactatgttggtcaggctggtcttggactcctgacctcaggtgatccacccaccttggcctcccaaagtactgggattaccggcgtgagccaccatgcctggccaaaatcgtctttctttggacacttattatcattaatcttgtttcagtgttttgtttaagaaacgcacgtgccaaggggaaagatgatgtactgaacttgaatgatgagcaggtgggaattttgtgagagcaaatgtgtgtgtagacacatacacatatgctgggtcaggtgtgcctgagattttgaatgtgtgcaaataattctatcagtgatagatttttttctttcattcattctgcagatatttacagaacatgccaagctctctgtggagcaacacagctgtgaatatagaacatatagggtctctgtccttaagtgtctaatacatttttttttgttatatgcaggtacattgacaatttaatttagtttagaaatatctgcaacatgtcacaaattgttcaatggccataatcttgctgacaatcttaatgaccaaagaggaacttaagggaaataagacagtgttaaagtgggaaaggaatgtacataaatctgaattagaaattgattacttcctttaaatttagtaaatattgaattgctttggggttttacatttcaagttggcttgccagtgttccaggccagggtaagaatgattatgtctaaccctaaaacttaattagagtaaaggaatagacaactcctggttaatgtgtgtactattgtcaggagaattagttgtaaatgagttatttctacagaaactgcaggctcagggctgatatctttagcacagaggacaatatccctttttgcagaagaatggtcccattctctaccttctcaaaatgcagtacagtcactcctgtttgagctactaccatatggcatatttgaagaccattttgtcctccaagtgggaatcatctacttgtgagttccttgacttcatggttgcatgccattctccccttcagaaatttggcatgggcctttgtctgtaagtctcaattccaagtgttcttggtcccagctgtcagtttcaaagtccccttcatggtccctctcaggtcccaaggatccctcattgcatcagtaaacctagagatctacttggatgcccagagctcctgtcagagctatgtagatggcagccaccctctgttccactatgctagcttctccttcagatctctcacggcacaaaacctctcattataatgatgtgcacattggccagtgcttctatttcctttgccttgcgtgagttagagacattctgttattctcactggaggtaagaatgattaaaaacatccttgaatttagagtctcaaatgcctttattctcatggttttcatcaatcataatataacttctctttcctttcttagatttattcattcaatatgtatctattgagcacttattatgatccaggcactgttctagacatgggggacaatacgacagacaaggtcccttctcttgtgtttcttaaagtgtgtgtgtgtgtgtgtgttggagggaaattgaaaacaaagtacacaagtaaatgaacaagattatcatagggagtggtaagtgccatgaagaaatcaaacacattggacagagaatggtcagacagttggagagtgatcagagaaggcctccctaaggaggtgaattttgctctttgcttttgttgattttgtacagacttcagttacactttgggtcctttggtttcctccatttcatgatatcctggactcggtatgcattctcattttgttgcttcttgccactgtactattaggacaacctcccttcagctagtcctgaagagtaaactaatgtagcctcctgtcaaatatgtgttccacacttttcttgtcgtagtcagtattagaattcagcatgttcacgctcttccctgttatagaatataaatggatgctaatcctttaaggatattttacttgattactcagtgcatttttgttactcaaggcaaactacctattgaaagaaaaacgcaagcattaagagttagtaagcatttggctttgcctatttctgtaaagggaaaagctattgttaaaattagtgttcaaagttaaatagatgatcctggaggttctctttagttcgaaagtagtacaattagttgttttcagagacggagccaaaatctcttttcaatatgctgtttaattttgtaaagtggatatgcaggaacattttccagtgtatcagaagtgcttagattaagcatacattttccgacaaaagctagctttacaattcttgtaaatgtcacaggaacttaaaacattgtgtcttgttttaacctctgccagctagagcagcaattcagcacagcagattcaattgtcagtttcttaaatgtgaatatctgaaagttcattgtcttttcagcttgaccacagggaatcttcaaaaaactaaaaagccaaacaccactaaaatgtttggtggtttcaaaatgctatggcataggtgttgcttgctagtgagttaggtgccaagaaaagcatgttaactcttagaaggccattcggattcttccagccatcattttgttgtcttcctcagcacctagttaaagccccaggtaggaactgaggtaggagttagaaagtttgccttccctaactcctctcacacctcccgtcctgtcccattgagctctgtgggagaagatggggaagcaggtggggtgggtttggagaaggtgcaccagaatgttgccaatatcccaagtacccttgcatctcccttctttaaaacttctgtgtcgtcacttactattccacttatcactcagatacttggctgtgttctaaatacaacaatcaactccatgactagattttgggaaagcagttttttaaaaatccagagaaaagctgagcatgattctgtggtaaaggaatcttcaggagaagaggaaccaagagagtttggaaactcctagaaatgcaactctgatttacagtcacagagattcttgacatagaaaaggagtggggtatagagaaagaagtgaggaaggcacacagcacagtgagtccttgtatgattttaattgaaaaggctgttattttctgcaggtgagaaaatagatgcacatcaaggcaatgacttatctaagtacgtgcagctaattagtggcagatgcaagagaagaacacaagtcaactgaatcctatccagtatcttgattggtaattaactaaactcgctgaatttttggcttgcttttgccgtttaattcttagcgctacgtttgttgccagcacttttaattcattatgctcaaaggactttatcaacaaaggtggacaaaatcccttagaaacaggtaaaaggaattttgttttggaggggttggggccagctgacagatagtacaggatcgcatagaggtgagagtggttggattggaaataaagcctaaaactcaagatttagcttaaaataaaatgaagaaagagaggattgcggctatagactggggatccatatttaaaggtacacatcatctctttaatgctcattcttaatgacagctgtagcccattctccatctgaagattgaaatgtcttttgtttagggttctcagtactttgagtctctttccaggcatatttgtggccttctccttgtctttctgtttttctattctgtatggtttttcatctctaatgttttccattagtttggtctcacggtcttgaccagggcactcatggcacaaccatatatatatatatatatatgatcttatgtgcacataaaatggagaacactatttaacaagttagaaactattagattatttctgttcctctttcggaactgaaagatttcctcttgacaaatggctcttctccaaaatcttaaaattgcacctcagaaaaaaatgacggtcactgtgctaccatgaagcttcctgtcccttcactttcattggcttactattcaatgagctccattgattttccagacctccattgattttctcaaccttgcctcatcagccagacactagaattacaagggagcttcatcaatatcttgtgtggtttcaaaacttttccacttttctaatttgggcaatgggtatggtacaaaccatccgtaaacggcatttggtggtgcattggtctttcttctcatggcttctacaattctaacttgatttctgctcaccacagggcacagtttgccttctcttccctgggagctcttgttcatttgtcaggagacctaaaagaaggctactatgtacagtggtggaatgtcagagtcatcctaaactggcataaataggtctttaatggcctttactgattgtttctatattgacatataaatccacatgaggctgtgtgaggagactgtgcatagtctttctcccgttttttcatatgaattgatttgacaatgtcatagatgatgcatgagacaaagtaaagtgtttcttaagctcactgctgcttgtttgcatgaaaaggaataaaagctacagggaagaaatggacattgtgtgatgctttaggcaggagccattttctgactcacaccttttagaccataatccactttctgaacctgtgcaggggaaagtggtcactgtgatattcttttgctggaaaacctcctaattaatagaggttttctgaaattcataagagatgaaatacagagtctcaaaaaacgaattagttgtaattataaatgcttgcatcttatatgagaaaatgaaatgggataagagctttttgaggaagagtctctgaaaataacacaatgttttattgttgaagagccatgtgatttaatactcagtgatcatgaaatcacatgtaaagcaatccaccaggagagtccagaaagcctcatttattcctctctatatgagcagattcagtgtctcctttacaatgctatcaaaatatgtataaataaaacaacactcttggggctgattttaaatttaacccacagtaactgtaatttaacatgagtacctgaatatttccctatttggagtcaaagtgggataactggggtaggggttggggagaggcccctagctttctgtcctacaacaatctcaagcacaggatctctgatttccccttctcatgcaggaggtattttatgtcttggcaatgggtacttttgttcactaattttcatggcctacaatcataggtcaattggctctgggtcattctggggctgagggaaaacaggtagtgtccttcaatagatttggagaaactggagggggcctcttaacttggtgattttccagtaatgtgattgaaaatgtactactacattaattaattcagtcattacagatacacttattgagcacctaccataattcagcacgattcttaatgctagagatatgacaattgaataagacaaatatagttccttctctcagggagcttatattctggtggcagatatagataatttggaggaagcaagtcaacaaaatgtgtccatattgtgatgaatgttatgaaagaattaagtggagtgctagataggggatatgtagcctttggaataacctcattgtggggcaaacttatcctttgtggatggatttgatttttggaaacatcaaaaatgatatggggccaggtcttataaatatataatggaagatcaaattgattgataaaagttttgcccccaaatgagggtatatatgtaattactgtaatatttttgagtgtcagtaaaaatatatactacactaactagtgataagcacgcccatgtttttaaaggcagtgaaagggctccagcaatgggtgttatcctttggcaagcatttaggcatctatagctaccaacagcactgtctccagttctctgcctctcctcaattctggtcaacccttgtcatcattggcaaatgtactttagctgttatattggtacataaaataaacattcagagacattccaaactatgtagtacagcagtaacatgtgaaatttgattctgtcacaattataatttagttctctcatttcattagtccaaataaagtggagtttcatttatgctattttgtatcaaataaatctgtagaatgctaatacaccacttcgatgagatacaatcaatttgagtctaggaaaggcaagaatgttataagctagaatgtcaagatgaagatgaacagacaaaggaagccatgataggagaattgaggaccccttgtgtgctccttcttgtactaacttaagtgatatctaccatgtccgtttagtgatcgttctagacatgtccccattaaaggatatctaatagagatggttttgtaaaatgagaagaagccaatgatagccatttaattacatctttagtgtgacgttagctccctgtcttgagaagcattgatattctccatgggtgtttacttgagcaactactctgccaggcactgggagtacagaggtgaattagagagagatcctgtctttatggagctcacattgaatttgggagatagaactaaccgttgtggtagaatatggttcatactaatatgtataaacgtagatacttggtacttcaaggagtctgctctaggttgagtcgttgggtcagaaactactaagggaactattctatggtttgctaaagctagtgatggggcaggtatgttcatttcttcacctcatataaatatctttggactcttggcatgattcacatgcatacactttcaatctatctgccagttttaaaggcaggtataatggtgaggtctagtttcaaaataagtagcttttataggtaatattctgtggtttcttcttgaatgtagaaccagaccgattcagaataactctcatgtgacctgttgtgaagagccggccttaatttttctttctctttttttctttttgcaacaccagctccatttctagtagcaaatctgagccaaaagcacagattcattgactgtttgcataagacactaaatagacactgaacagaggattaatgtagccctgtcttctgggagcttatagtctaaaacagacaacaaactggaaagaatatccaacacacctgatatgctcatttcccttctcatataaatccaaagaaaacagaaagtggcaagtcacattctacaggattgggaaaatcccctagagagtattttctttttgtgacttttcaagttaaaaggtattttgtatatgacatgtaatagattacagtgttatttgatgaaaatgcaagcaatgttcttcctttcttttttactatcaacaagttacattggaaggtgtggatcaaattaaaagtgaattcttgatttgccatggggaaatatgtgcagtattttaaatactctaaggtaagggtcaacttgtgggaagaagaggtatcataaaaattaatttaagaaactagccttgagatatttcctaataatcccacagggaaagcaacatctgtgtcataataaaggcgcttagtgtgacctttttgcaaaagggaatattaccgaaacatgaccaaagtttggagctgaggtactgcagtaaaataatgggagtctactaaatatttataaggatgtattcatttgtaagaaagtagtgaaacagtagaacatctgccaaaccaaggttaatttcccaaagctcatgtgtttgtgagagacacagagacaggcacaggaatagaaatgcagagataaagagacacagagagagaaagtagcaagaggctgagccagaggtggacagagaccaagaactgaaaatcagccaccctattgattaccttccaactctgtcatgaaatttactgagagaccttggtcaggtcactgctctctgggccttggtttcttcatgtgtaagatgaagggatggactagaatatgactctatagaacttaccaactccctggttctactcttagctgcaaggtaaatgaaaaggcaggcaggtgggtaggtaaagatatacacgggcaggcatggagacagacagactggccacatacatgcatacacaagtttcacaaaaatagaacaaagcccaaatcatggtagaccagtgaactgtgaatcacagagagcagcagccagatccacaaaatcgtctcatcgcttttgatactgccatggtgaaaacttggcagatttccttttacctagcacttgcccagcttcctggaggccagcattcagaccttttctgactggcttggccgaccctttcctccaccgactcagaggattagttatgtcaggatctgcaaatgacctctgatgcccaaatggaagaactcagcctactcttctaactcttaacacttgaggatgaaaaaactcacataacctaccatgcatattcttgtccaactttctgtctggatatctgtctggttgtaatgttctatggataattttaagcacgctgtgttcaccaggctttcaaaggtaaccacttttaaacttttgtgagtcttgtttgcaggggcatggaaatgaagagaataattagtacttgtcgagctcccagccagcgaatgactttagtaaggtgctaacaatgcactcaagtgagtgcagcaaaatgatgaggacttacagatggattttagtatctggtttatttcacttccattggtttttgcaagatgtaatatagtgtgatttttcttactttgactgcttataatttatcagccttccccaaaataatacccccatagtttaatctgagggcacatgagctgatagtaggtacccctttgggaaaatctgattaagcatttgtttctcaagaaactcctttggtatctgggacaccattttgaatacatctagagcttcacattttgatgctagtacattttataagaatctatgaaaagcaactccatcaaaattgtgtttccttagagaaagatagtgcattaggataacaatctgtattgcacccattaccatagtactttcttaagaggtttttgccatcactggaagccttactcttccaggacaagtgagccctgagaacacaggctagggtgggcatgatgtgtgaggatgaagaagccaggctggctgcagtcaagcttgctcttataccaagtggcggatgggtttggttgagtcattgtagctagcgagagaggatgctgaaagacacaagagaggcttggcttccacatatatctccagcgccacctcgtccctggggtccagactcctgcaactctcacaccactcctgtctctactgggaggtttagttgggatctcaaacttcacctgcccccagacaaactcctgacatttccccagaacgtggtcctctcccaatcttccccgcctcagtgagtggcatctctgtccttaccagttgctcaggggaaaatcttcaaggtatcttttgcatatctttttctcccccaggccatgtctaatccactagcaaattctgtctacttcacctgcataatatatctggaatttgaccgcctctcgccaccatcagctctgtcatcctagtccaagccgccatcatttcttacatgggcttctgtaaaagcctactagctggctcccctgcttcctttattggacccctacagtcttgtctaaccacagtgataacccttttaaaatgttaattgagatgttgtcattcctcttttcccagcccagcagtggctctccatctccttcaacaaccaaccctgcaaggttcctgcaagctccatctctgactttatattttattaccctgcctcaggcccatttttctctaatcacactggtctccttgctttaccttaaatataccaggcctcttgctgcctcagggcctttgtatttgctcctctttctacctggaatgctcttcccctagatatctgcagggctgggtccttatgttcattccagtctttcttgaaatgtcataggaataggattgccaaggagtccaattcttaaaaagaggtcactggtcttggccagcaggaagtcactgatgactttttagagggcagctgcagtcaagtggtagaagaggagccacattgtttttgaatcatctgtatcccttaccaggctgtgcaccgctcgagtctggtgctgttgtctcattcatttttgtctgtctagtaccctccacagtgcctggcaccagtaggcactcagtgtttgtgggatgagggcacgagtcttattttcaaacaattggttatgttaaaacacgttaaattgctgaatgtttgtgattgctttctcagtttttctcagggaatatgtttgaaaaacaaaatctgtgcatttattgtagacccattccctgagtattgacgggtgacatggtgctgtacatgtgatttagaggttttcagtgcacacaggttgtgggggaggctgagaccatcctcagtgtcttagggagataagaaagttcaatctctgcttgtgtatttactagctcacttcccttttaaaatcccctttctagactggaagggctatttaaattcaaaagctatccttgggttcaagcaaaatcttaatgactttagggacagatatttaacaggtggtttagatagttaacactcggctggtggtgaaaaaccacattgaaccacattgaacatggggttccctaataattttaactgagctcaaccttcatctcctttatcgcctctcctttatttaactatctactggagttcaaaacaccactgtaggaatggcttttcttcttgtatcttgccccccttccaggctctgccctctgagatctttccctagacaccagttagagaaggttggccttccctgaaactctttattcctagatccttttgacaccactagtaaatcctgctttctttgctgtctgagaattttatgaaggtcacttctgcagcatcggcctctacaccaatggctaggaagccgtggcaggactctgatcccatttctagtattgctcttaaaccagctctgcctgcaaatgtcagagttttagacctcaagccctctatctcctgaaagtaattgtgacttgtagcctatcacctgggtcagtccacagggtctgctctgcctgtcctgatatctaccatattcgtcatatgagacatttacctatgtgggagggaaaatggtatcacgagtgtggccaagaataggtagctatttctaccgggagtggaggaggtcatttcatacccctacaaaagaggatttttctgttaccccctctgctataaatcaaatacacacttaacagttatatgccatccaggctcattcaacaaacatttgccgagaaccacacagcctgggtgtaaaggagttgggggaaatagggacatgagacatggtccatatgccctcaaaaagcctgcaatccacagaaggtggaaatagtgagaaaggtacagacagagcctatgaatcagtgcaatataatcaggtctgagcaaagtggagccaagaggaagcaatttgttgttgcctgaggctgtagagaagactattcaacaggaaaggcagatgtgggttttcaaagagaagcaggattttgtggagaggagaagatggggaagtgctatcctgttagagaaagtggctttgtaaaggcccagaggcaaggaccagcatggaggatctgggaagggttgtggtgtggcatttagaaaatatgtaaggccaggttccatctcggagggtattgaaagccatgctgagacatagacctgattaagtaggcaataaggagctgcgtacggttgtcaagcaggggaaggagaaaacagctgtttcttccaaagataatagtagcttaactgtggagcaaagaagggagcgggttggcgctgtgatggataaataccatactctcaccatcactgcactgaccacactgagcaaacaactctcagtgtgaaagcggggaagtgatagtcctaagggctgtgtcacccgggcggaagaactgcagttgcatcacttgtcctgatcattgttaaactgagcgtgggctgggagctccttgttcctaggcaaaagtcctcagtaggagactgtaatcatgcctaaaattacttcattattggaaccagtgtttgatctgtgattaagagctggatgaagaaatcaagtaatcagccattgaaattgtaaccataaattgttctataaacaactaacttcccctgtctcccggactccaagcaacaaacttgaaaacagatacttttcctgttgtttcttcacccgatgggttttagccagtgcttttgagccttgcagaagtcagagggtaacacctgccagccacagtgcccctttgtccctcacatatggatcactcatgatgttgtaccttgtcagactaagacaagatacccaaggagtgtggagctgttaaaaatatgcaacttattaagatttgtctagtgagggtaaagagatttatttttaacagaactggggagaaactgcctggatttcaagataaagaatagagaaagccctcagcggttgttgccttttcaatgatgtgttagaagtagcttttgtcctgaagggttttattttgcccaaagcattcaaatactacagcccatagagacatttctgtaaaacaacattagggcttattgactttttcttgtttggggttgcgctgtgcttaaccttccagatatgtaataaatagtaacaaattttaagaaagatctaaactttgttttggggaagaccatggcagcaaccaggcaatcttgacacatgaagtaactgactgtggaaccacaacctgctttgctcctataatgcctagggacaaccagacaagagcggttaagggagttatttcatgtgatcatttttctgacgttaagaggtagcacctagtagttgctcagcaaggttcattttcctcctctgttgtcatttacagcccaaacccttagagatcataacatggaagagcccttaagggtctgcccaaacctttccattttgcaagataagtaggaaggctcacagaagttaatgacttaccctttgtcctcgactggtccttagcagaagcagagctagaatcgggtctacaatccagctgctttgccttcttcgatgggagcagtacttcatctgtctcttgggaataactccagtagcccagtgaaaacattgcctctttcacaaaaattcactttcacaagttagcatccttggcacttggcataataatgcgaccaacgataacatagataccactttatagtctgcatagtgcttttcaccataacatcttgtgttgaactcccattgttatccatggctctactggtggcattttaaaggacagtgtgttgtagactgggatcccttacccaaagaggagtttgaactccttttttaaaaagagggctgagaaaggtttcactttatgttcctgtaatttcttaaaggatttatagataaaaacattaaaatattctgggtgtaaaataaaattgtctcagaatgggaatagacttaaggtacagtgaggagatataggagacaaatcaatggaagatttaaagtcaggaataaatgctgataatggatttctagatacttctcttgaattccaaaaacacgaaaaataaactgttgttactggggtggagacaaaacagaagaagataaagagaacaggctaaggagaaaggaagaggttaagggagaaacctctgtatgaggaacaaaccaaagttgactcttttttcaaaattcctacattctctgggataaacagctaatgtttgaacataaaacagctgaatctcccagagcttcaactactttctgttttggaagttagtactttgggaaattgaagactctttccatttcctagggaagttgccaatttagggttttacatcagaggttggcaaattatgtccccaggccaaatccagtccattacatgtttgtttgtttgtttttggtatggccagtaagctaataatagtttttatattctcaaacaggtgaaaaaattaagaacaatgttttgtgacatttgaaaaatatatgcaattcgcatttcaatgtctgtaaataaagttttgttggaacacagccatgcattcatttacatgttgtgtatgactgcttttgtactgtaacagcagagtctgcaactctgaaaagatttactatctggccatttacataaagagtttgtcaaccgttgctttaagccaatcttttggtttccctgggtcacattggaagaaggataattgtcttgggctacacataaaacacacgaacacaaatgattgctgataagcttaaaaaaaaaagcgaaaaaaatctcataatgttttaagaaagcttacgaatttgtgttgggctgcattcaaagccattctgggctgcatgcagcctgcaggctgcggtttgtacaagcttgcttcaaactgaagtatcttcatgatctgaaagtgttaaataactttctctagagcccagctcttaaccagaggggagtttagacattgggataatctggttcaatataacttaattcaatgacttgtacttagaatcaagttacaaaagtggaatattatgcttcctgtctaactataaattgtattccatagaggtacgtcaaatatttcaattttctaaaatgtaatattaagcttcccagtaattcaaaatgagattaaggggaattttttttcatttgctctttgtaacaaccagcttcatataaccagcagcaaacaatggggtccccagactgtttgaggacacttttgtatcgattagctgtagttaaagcctgaatggttaagtcagcaatttgacttaaaaaaatgctgtagattctaatttataatacctctacagcaacagacttcctatcaggcagattgtggagacaagcagttgtttgtaccgatttctggctaattacttatctatttgatatggcatctcccaccaaaatgccataccaagctgtgctttccaagggcatttttgaataatgggattcaaacaggaatttaaatgttcacccgaaccttctctctcgatctgtgcactaggatgaaggagggttgattccagcttgggacagatgaccaggaggtatgggacagatgaccaggaggtaaatgaaggggttgaggatcagtattggaaggtcaggaaggacacattttacaagttgggacattcaacctatgaatcatttcttatgcagtttcaagatatattttgcattgattagctgtctttgaagcccatacagttaaggcagttttctgccttctgcctcttcactgagcacctgtattagctagagcttagatctaagaattctgtgacttgctgaaatttattctgctagctaagaggaccaagggcctttaagcttcagatttgcatcactgtctcttcaaactagattactttaatgagtacttgatatggtttggctgtgtccccacccaaatctcatcttgaattgtagtttccataatccccacttgttgtggaagggacctggtgggaggtaatttaatcatgggggtggttaaccccatgctgttctcatgatagggggtgagttctcaggaggtctgatggtttcataaggggcttttcccccttttgctcagcacttctccttgctgccaccatgcaaagaaggatgtgtttgcttccccttccaccatgcttgtaagtttcctgaggcctccccagtcatgctgaactgtgagtcaattgaacctctttcctttataaattacccagtcttgggtatgtctttattagcagcatgagaatggactaatgcagtactgtacttttgtaattttcataattgtttcttacattttgaatcaatagtttcataccattatgaccatatattttcaattacatgttattttggagaccatgtcatttttcatgggttttcatagctctcttacttttggctctgtggagcctaggagaaaggttcctgtcatccccatcccctggcttttctgctctgctaaaatcattataactagcttaaatttatatttcaggaaccttctgtaaaatcacaacagagttatcttctgatgagtctggttgctagactaaagatttgtatgaggattgtcagaaatgttggctgggcatggtggctcacgcctgtaatcccagtactttgggaggccgaggcgggtggatcacctgatgtcaggagttcgagagcagcctggcgaacatgatgaaaccccgtctctactaaaaatacaaaaattagctgggcgtggtggtgggcacctgtaatcccaactactggggaggctgaggcaggagaatcacttgcacctgggaggcagaggttgcagtgagccgagattgcgccattgcactcagcctgggggacaagagcaagactttgtctcaaaaaaaaaacaaatgttgactagtgtcttctgtttgggctggttatagacaacacagcttttgtcatgatttcttgtagggccactggtttaagttccaaatgttgcacctgaatactctagaaactatcgtttagctgataaccttgaataatttccagtcagcccttttttattccaaaggggtgtcacttaagatcaaattcattcagagaagtattgatccgccagctgccactctccattaactctcccctcccccagcggctgaaagagtgcccttcttggggccaataaatgtttatattgcccctaggtacgattgttcctccagcaagagccttcattaagcccagcaacatgataaggtaatgaggcttctgctttaacatagcagaacatatatatccaaatgagcatggttccctggctctccttttttattatcctgccttctcccaggagaaagtagtgcattgaggggaccatcaaaactcctcctcccttccccttctgctgagttccccaagacacctggtctcaactcctattccaaattgcccagagaaagagagatgataagtggacagaagacatacaggcggcatggcaaagaagctcaagactggcaaagaacgaaaagcgctgaatacaatggtcacaacagaggactcatattggtctagaagggatgcagaaagccagactggtgtggactaattatttctttatttcttctaaacattctatgactgagcttgaagggtcaaggaagatggctcattggagtgtcctagaattccatattacaattcagtagttttctttgaaagtatggaacacataatagatatatctttgtatcactagcattttgcccgtagcaggtggtaagtgggttgttattgcaacaacagtagatctgagctgtgaacttatacaataaggcctatactgccataatgagtatagcaccagaatcatcaccacattttaattataaaaaatattattgtactctgccatttcccacttataagcatcatgactctgtgaagtcaggtggcaagcttggattatttttatcctatttttcatttgtgtgaaccaaggcataccaatcacttggggggactggtgtgatggcttagaataagagctccaggttttcagctctgcatgtggcactcttctcaacaatctggatgaaatcaggagctagcatcacacactgttgctatttacaaaagcctaattaatacctctcattccctaatgagatactttttctgactccacagacaagcagagccaagcaagtgatgtcagaatgccagagtgaattattgggcttgtgtcaacccaagcagagatgaaaaatcacccctgtgaacttgctccaggagcaatcaaagggccaaagttttaattagtgagggttgtgatttacatttgcattcagcatcctaagaatctacattagtcttcaagctcctgcacttccctagttgttgtctgacactggttaggatagttaatatgcttttaaataacattatatttaatggacctttgaaagcactgacatatgaatccattttctcacctgtcagcagaactgttttcattaaagaagtcagtgaaagaccacatgctgagaggagctaaaagttggtggcagggaacatttcagcttggtatcttgtcctttcacctatatctactgtgaaaattaatgaacagttatctaggaatactaatattaggattgatttctaatcaaagggaaaatgatgtcaaagcactatagtgaataaaggaatgcaatggatttatttttaacaaacatagcagaactgacataatggaaaagggtgctgatttcttcaacatattcaacatttgcatgttgctgtattggttagtacatttgacagctgtagcatgttctcttgactctgcttggttgagagatatctttgtcctttgagagtggattgaattttgggaatcagtcaaatgtcctgagaaggtaatgatgatgtactaattggatgatcagactgggtcctatggttgggggccagaagtgaggtgtgactacacagtcatgagtgatatttctcatgtggctcataactgtctatgaagatagttcccagggaacagctctggaaatgtgaacgccagcagtatccttggaatctgtatacagcttctctgggtaacaactttgagaggaccagcatgcattgggtacaacacaggccctcgtgcgcttgctaaagatctgcttcaatactttgtcacaccgcctacactggctccacatttgccaagtaactatgagcatggttctccttccaacaatctggatggagctagcatccttcatgagtgtaaatttacaaaagtttaattaatatatcttgcttgctaatgagttattccttttgactccatagacatgcagggccaaatacatgatgtcagaattccctgagtgaattattgagcttgtgacaacctgggtcagaatgaaaaatcaccttagtatatttaatccagaagcaaataaagggccagagaattaattaatatgggttttaatttgttaaggtcttaagagggagcctctgtttgctctggtacctttttgtgtgtgtcctctttgattacaggtgaacatgcctttgggaaaagatatctacttctttactgtgctcctcggtaacctatagacaagaaagaaaaaagtgggttcttagtcttcagagagcatcaaatcattgaatttattgtttaggtgatgagccaatgccctgttcccaggaataggtttcatgaggaattgctaggaggcatagaaaaagaattgcacatagtggaagtagatgatgataaaagaaaacaagtgctagagctggacaacagagcaacaccccatgagtcctgaacaaagaactagaaagaaacccaaggaaaatcagagtgcttctttgcagcctttggctaagtctccctagctcccaaaaggatgtagacagcagataacactgctgatgagagggcaggatccagacaggtgagctgtgctagggaaggggctgccaaggaaagccccaaatgcaatggtacaaggtgatccagtgggagcaatccttcctattgtcccatgagcaggtgctttagggagccactggtccaaggcctgcattcaaattcatgcctcctggtttttcaccatctttccaggatcaggttagatcacagaaaggccgcccatttgccactttagcttagctgttactggcctaccttccaatgtggtatccccagctgctattaaaagaaatggacatgagtaaattttactgaatggaaagtatatcccaattaacttgactttttaaaatgtctctctatatacatacatatatatgtatatacatatatatacatatatgtgtgtgcgtgtatatatatatgtatatacatatatatacatatatatgtgtgtgtgtatatatatatatatatatgtatatatatgacactgtcctgtggagactgctcctacatatcctgtaaaaatcagtgcttcatagttttggcaccaggaataagtttgattctcctgacaaaatgataccttctctttaatcacaagttgagaatgctattatccagcgtgtttcttttaatgtttattgccttcgttgctgggaaactcagagctaaccccagcattcaatttcagtaatcttgctctttaagattttgagaattagtctcttatcccttctaaaatatttctactgatcttgttcttccccagggtcatattacaggtacgctttaggttaagctttctcaaaattggggtactggatgggttataaactataaaaaatagtgctctgaccctagtctgtgatggtccgaacacaccaacctgtgttcttcctggcccatgctacttgctctgacctggtgctccttgaaataaaatggatttctgttagttacagcccctatttttacactagagttgatgcttttttcctatgttagtcatgaattataatttctgtatgcccccaaatatcagaacaagtggggatggggaggcaaatagcggcatgcatttctctaatatttattcttatctctggagctggttgtataaagctgtcaagaagaaaatttccacttaaaccagaaccttccagcactaggagtgctgacctgtagcaattacgggtgctaggattgttttacttggtgtcttacttgactttcagtttgtgaccatcacttgacaggattaaaaattgcctctgttctatctgctaatttcttgaaggggacagcctattccagaagagacagtctgagcaggaaacaaaggctctgtactgtgctcagaaactaaaactagataggtcagggcccatgcctgaaagcagttggttctccacagcccattgttatccataggtcatggatacatcctggcaagcaggctgtaaaggacatgaccccttaattgaaataaaatgcccacctaggcatacaaaggatgagtagagaaagagtccttaagggaaatttttaattgtttacctcgattgattgattgattgattgattgagacagggtctcaccctgtcgcccaggctggagtgcagtggtgtggtcatagctcactgcagccttgacctacctggctcaagtgatcctctcatctcagcctctggagtagctgggcctacaggcaagtgccaccatgcccggatcattttaattattattattattatttagagacgagccctcactatgttgtccagacttgtcttgaacacctgagctcaagcgatcatcctgcatcagccacccaaagtgttgggattacaggtgtgagccaccgtgcctggcctgggaaatttttaaaaagaaacagcagaactttttgagagtaagaggggcatactccccttctggggttttatttcccccttgggcttctgaaactttaatgctgaactggcctctcacaagccacagacaaagctgagaatgtcaaaggtaactaataaactgctctgaaaaaaaaaaaaaaaagtaaacgtcattagagtggatggagtctaaaaatccataattctaagaatcccaggagaagcactgaacagctttttaaagccatttcttttgcccccaagccacaaaggattgtttatatccttttgaggcagctagctggatgcccctcttcccaattctgggattccctgagataaatactatcttgttcccttatatgccaactctactttctgctgttggaaacttctttgctacttgcagggccttctcctttcagatctgaaggtctggtctacttccccaaggcatgatgatagactgacgttcttgagccccagtgaaggttctagcctttcacagcttacattatcttcccatctcacatagaatcattctgtaaaatgtatatttctgaggtgtctggactcatacatcctccattgagagggggtctgaaaattgtttaatatagtttaacatttatggcatctcttccttgacagtgtcagtaacagagtgaagactgccattttctcaccaacgttaagggaagtcagggatagggcaggttcttcctacagtagcatctggtccaccagtactgagaacattctctgcaaggagtttgctctttatgtcatttagacattagacattttaaataataagcatgatttctacctttcatgtttttatcactggagttttctacctctccactcctccatctgctctaagccaagaagtgcctccagacagtgacatcttgcactgtgattaaagtgcttagtatagagaaatgagtggacaccaggtttgtataggtttaaagactttattaagtaagaagttgattgttttgtggctggagagaaccagaggaccattgtttgaaagctgacaacctatattacaaagaggtgacggagatgatatcatgactttcaggaagcacaggcttttggaagtgttcatcaagtgggtcgtggcataaggctgacttaaatttttttttaatgttttaatttgttgtagagacaggggtctccccatgttgctcaggctggtctcaaactcctggcctcaattgatcctcctgccttggcctcccgaattgctgggataataggcatgagccaccatgcccagcccttaaattctgattatatcagagccaagactttcttgacgttttgaagccaagttgagagcaaaacgacccatttctgattttctacataataaaggaaacaaaccaggaacaataatcaaaggtggattttttgtttctttgggaagttataaccatatttgcataaactttaaaacagttatgacatctagttgaggtactaaaacagtttctttttttaattaacttttgttgcaataaataaggccagactaacaaaaatatatccaaagccaataattctatatttgtttggcacatgttgcttccttcagcatacttcaggtcatctttgccaggaattgagaacaggttgcatgtaattacaaaggctccttggtgggatgaaggacaggatgactgacgaaataccacagctaatcagataagtgcaccagggaaaaagcaacatgtaatggctggaaacccaaaacacaagactttttttttttttttaagacagagttttgctcttgttgcccaggctggaatgcaatggcgcgatctgatcttggctcactgcaacctctgcctcccaggtttaagtgattatcctgcctcagccttcccaagtagctgggaatacaggcacccaccaccatgcccagctaatttttttatatttttagtagagacagggttttcaccatgttggccaggctggtcttgaactcctgacctcaggtgatccaccgactcagcctcccaaagtgctaggattacaggtgtgagccaccatgcccagccatcagcaaatgagtctattatgatgggaatactcatgcccccagactagatctagtttctcctttgatcccaagccttctggtgttgttctcctttgagcccactgtcccttctctggcctgtcctccttaatcttcttccaaggctattctcttctcatgctacacactctcctcatgtaatctcttctaaaggtttgaactaccatagactcccaaatctctaaagaccattcttcagctgagatctctatatccagctaagttctgcatccgtctatccaattgccaactaaacatcttacctagaggtaccaacaggcacacaaaactcaacatagctcaaaactgaacatgtcatcttcttccacatactctccccaacaaaaaaagaaggctgtgttgcgggaagtcagggaccccaaacagagggaccggctgaagccatggcagaagaacgtggattgtgaagatttcttggacatttattagttccccaaattaatacttttataatttcttatgcctgtctttactgcaatctctaaacataaattgtgaagatttcatggacacttatcacttccccaatcaatacacttgtgatttcctatgcctgtctttactttaatctcttaatcgtcatctcgtaagccgaggaggatgtatgtcacctcaggaccctgtgataattgcgttaactgcacaaattgtagagcatgtgtgtttgaacaatatgaaatctggccaccttgaaaaaagaacaggataacagcaatgtttaggaaacaagagagataaccttaaactctgaccgctggtgagccaggtggaacagagccatatttctcgtctttcaaaagcaaatgggagaaatatcgctgaattctttttctcagtaaggaacatccctgggaaagagaatacgcgcctgggggtgggtctctgaactggcccccccccaggcgtggttgtcttctatggtcgaggctgtaggggtgaaatagaccccagtctcccatagcgctcccaggcttaataggaagaggaaattcccacctaataaattttggtcagactggttgctctcaaaaccctgtctcctgataagatgttatcaatgacaatggtgcctgaaacttcattagcaattttaatttcgccccagtcctgtggtcctgtgatctcgccctgcctccatttgtcttgtgatattctattaccttgtgaagtatgtgatctttgtgaccaacaccctattcgtacactgcctccccttttgaaactccctaataaaaacttgctggttttgcggcttgtggggcatcacggaacctactgacatgtgatgtctcccccagatgcccagccttaaaatgtctctcttttgtactctgtccctttatttctcaaactggctgacgcttagggaaaatagaaaagaacctacgtgactataggggcaggttccctgataagactgccaacccttcttgtatggctgatattggcaaatggagccacaattaattcatgttacagcatctttgatcccacaccttctggccttgttctgtactccgtggtggctatggccctgtctgctatatgctagctaagttctgtcaagtcagtactgcatccttggatacttaccttgaatacatcccttctctctggaccttacttttctatttctaaggattcctctaactctatatttctaggcgtctttcccttgtctggggaggggtcaataaagagcctcactctttggctcagttaagcatcttgggtttaaccagactgtgattaaaaactcatgtgcatgaagcgaagtagattggtttaagttatacaaggtttagcgtttaacagtgattagtggatgatataaaaaagatgtgctttgtttccataaattgtcagaattttagtcttctgttttcatgcacactaaaataatgctcaattttccaaattgtaacacaatacaaagaggctgacaattgggtttcacttggaaaggaaaattaaaagtggtcaatacagatcacagaatagataatatttgcaaaggagaccctacttagaaataacacgcattcaaacaaaggtatgatgcctgaatgtgtgataactaagtagtttaaaaattgaaatagtttcatctgtccctgtaaataaacgtgaagagaaaagtacaaagtcctttggtttaaagggtcagtgtttttaacagacacatgaacgcatagtttaggggaactttcctttctaccccagaaggcattttcaatatcttgttggcatggcccttctacttgatttctaaggagccagatgcactgtttgcttttaagacaaggtctcgctctgttgcccagcctggagtgcagtggtgcaatcacagctcactgcagccttgacttcccaggctccagccattttcccaactcagcctctcaagtagctaggatgacaggcatgtgccaccacactcagctaattttgtttttgtttttgtagagacagggtattgctatgttgcccaagctggtcttggactcctgagcgcaaacaatcctcctgcctcagccacccaaagtgctgggattacaaacatgagccaccacacctagcccagatgcacttttaggtatagatgcatttggccccctagaaagtactcaagatgccaagttcagcaacaaggaaatatttgaatactcttggctttgggcacaacatggagctagagaatgggtaccccatgccccaatgtcaaaatcagcagtcttggttaagtaggaccaaccctgcctcaatgacccaacttgttcaagttctagctataaagacagaatatgacctcagctcttcctaatttcagtgcccaagctttttccacaacaccagggctgcttccagttagtatggcaacaccattctccagagttgctaattttcactggttttactctacttgagtttcctatctgtgggcactagagctaagaaatacttctgcaataggctgtcactttttagtcataaagtgtgagttaacatataatttgaacaaaaagccaaagccacatgactcctttagtaaacctctaacctagtttgcgtcagtcagtcaattcaattcagtaaacatgttagaagcccaatttaccaggtatggttttcagtcagcaggtgctgaaaaccttgtatatggcaagtgtgatcagagatattgtgaacagatgtgaatacaatttgcccttgtccttaaagaagttaatatgtaatgtgcaggcagagtggacattcttgaaaatcccataagaacatattaagtagaaagtgaaacaaagtggtaattcaccagggaggaggaaatgagcctctccaccaacacttagttcgtatcattctgtagtgtaaaatcagaatctcacctccaaatgaataggctgactgacttctctttgttctccgtgtgctaattcttgccattgcagttggctcctttggcttttcctaaaaagttcactgagaattttctggcctactctggggactccctaatgtgtaatgttcaccaactaggctccagttgtgaatttttaattatgccggatcattttcagtaaatagaacttcgggctcaactaatgctgtcagatctaatctttgtctcacctgctatggagctccactctgtggtgtttgcagtaattgccacttccccaggaaagaggagcttttgcagagatggatgtcagcagccctttgcattctcatctgccctcctcagaagccctacagcggggcactttatccagcagatttgaattttgatgtttggaaagtagagacaatggatacagctgattgttctctttcaattttcaccaagtgtgattgtctcatgcttcctgtgaggcagtagttctcaaagtgtgggccatagacaggaaacattaccgtcatctgggaacctgatagaattgtaaattctcaggtcccatcttagacctgctgaatcagaaactctgggggtccctgccacctgcatttaaaaaatactctaggttatctgatgtatgattaagtctatgagcccactattgagagagaactgtttcaaactaaggataagcataatttcgttctattttgtgaaaattctcataactcatttttctgatttacaattcttcaaaaacaaaaatcctaattttcataatggaaactcacatttacctttgctttccctaactttcccaagcataggcagttgtttcctgttttatttccctagcattttttcacacttgtttattccacttggtacattacattgttatgtagctgttaacatgcttgccttctccactagccttggggccacctgccggcgggaaccttgtcacactcatcatagtatccccaaggctacatagtaaacacacattaaagggcacagagtaaacacattcaatattttctgagtggataaattggttaacattgtataattttcaaaactaggtaatggccttaagaagtacgactggcagaataggaaactgagacccagagacattaaaggattcagttggtaagaagttgcagaggcagggctaacaacaaaagcttacctcagtatgggaaaggtgatggccacaggtccctcaaaactggcctaatacactaaactccactcaggaagcttgggatactttggctcttcaagggcaaagcccttgatttactcccagacaggttgctttctgccccaaaaccaaggatgctaagagagggtagctgaggttgccagttagtgagacacgtgcagagactgagaatcaagagggaagggaatcatgtaaaaaaaaaaaaggagattttagtactattggaggtataaattctagtactcggttaggccgtggtaaagagaaaagatgtgaactgcaagtgaagccaaggtagaaagctcaattttgctcatttgccagagtgtccttcttacaccaaggtgaaaacagcataggatgtactctgtgaggtatttgttataggaatgggctgccaatgattgccaccaatctcttggtacccagcttgccttgtcatctgtaagcaatctgggtgggctgggagaatggggagaagcagactatgggcatgggatgaagaaagccactggcctgcaccaggaacgaggccttcactttccctcattaaccttagcattaatctctacataactaagttacctgatttagatgcttttacttggacctctggcatacaagtctttgtaacgcagttgtaaatcctcatagagtggggtgggagtaaacagattctggcataggatgcttcttgaaacactccttaatcatagtggatcactgtctcatcaggcctcactgtttatctcatggctttgagtcccactttggagcaatgaccgcacatctgccttgtctttcttcttgagctccagttccatttctctaattgcctactgggacactgtccatcaataccccaactcgataggccccaaactgaatccgtcatcttctcctctagtccagatctccctcccaactactctctctttcactggcagagtaaatttgttctcagtcatccaacttgcaaaccttctcagtgactttcatttagggtttattctcattccccaaacatagtcaatccccaagttctgtcatattttcttttgccatgccaggcatagttattttccacccctataactgccattccagcccagcctctcattatatttcagatctcaattaccccaaaccatccaattccataactatggtttctgctcctcaatccctgatgtgatggagaagcccagagttagatgcgaacgcaacagttttataataccacttacaattgttagataccgttctattggcctctgatagtttgtaactacggtccatactgttggtaaagacacatgggattagtcagcttaaatgagaaaataatataatttagaaactgactcatgttctttcttgatcccaatgaggcattcagggacgtgactgtcactctctgggcaaaaacaacatgtaccaagaggtgaagagagcaaaatagcaacaaaaataaatgagcccattgctgcagtccctgatgccctgtggtgagctgctagagtgaaaagttaatggaatgggagagggcaagataatgtgagcgccctggttgccttttccaagagcttttcaattccagagtaactgtgagcttcattgtgaatggtttacctgatcagtataattccctctcctttgtagataagaagactaagacagcaagaagttaaatgccttgctggcagccaggattagaacctgggattcctgaataaatgctttgaacttatgaggctgcttctgagagatcatagttacactgggcttcatagcaataaaaatgagcttttcccttccctcagaaatcctgttattatccatagttaggcaaagggaaactagaagaggatgctaaataaaagcacatctcaatgaactgaactatctttgccaggtgattatcagaaatatagataatgagcgtaagatacttaaaggggcaaggactctaatttagacacctcgggcaaaagaagtgaaaaagtttggaacaaagaaaaccactcaggacataacctaacaagatagaaaaaaatgaaatgcgaaagtattatcagctttaattaaaggaaatcaatatttgaagaggtgtcttgctcaacaatagaacaagggcaaacatacttcagaaatgtgagtctcttagaaaagagaaaagcaagttttcatggggaaacaaccacgattgaaaaacctttcaaaagatgacgacttggtgtatctgttggagaggggcctgaagcacctgttggggaggccgactagatgagcttttatccctgggagagtctgttttaagtgcattttttcagtcagggagtgttcaggagcctagaggcatctctagggagtaaagaatagccagtatttccctcagagagacttgaaacaaaccctcaacaataaagtgggtttcatctcagttatcacttacaagaacacacattggaaaacattaaggactatacaaatgcaacagatgtgttatttcagaggcactctgcaaccatccaagcaagcttgcttgagaatcctttctaagctcacgttttttgtgatgcacatgatgaccaaccttcagtgactggagtccaattctcccagaccattcctcttcagggatggaagatatgtgacatgtgtcaccacttccttctctcaaactggtgcaagacattaatactcaatcatgacacttctttccattgagcccaaatgcagctttttcatttatttgttcaatgaatacctcttgactgcccatttaaaagtgagttggagagacagataaataataaaatataagcaacactacgagcaccacatgctaagtgcctagtaaaagatatgtagacaataaatatcatagccaaacctgttctcttgaaatacaatttcaatttcctgggaccctgaaaattaattcttaaaatttcagtactattgtagttgtatcagcacaactatttttcagggatctgagatgaattaattccgaaaagagcttacaaaggagatgcagaagtttctatatgccacccatcaaaaaagtgagtcaggtgtgttttaagccacagggttcttctcccacaattagctttgaccaaacagcaaaactcagattggagtgggtctgattgccattttggtttaagtacactggataccatttcagcatcaaatcattcaatcagaaacactgaaaatgctgaagagttgggttagttgcaattttcccacctgaatagaatgtgcataatactgcaaattgttttttcacttttgtagtgctggagacatttatggaacctgtgggaaagggttttcttgacagatggagatggacagccaaccagacagaaggagagctagcactcattaacttttcccaacagaaactcacctgtaattgttttcacaggcctttaatgaggcttggttgtgaggcactagagagaggaaagcagcttatccatagaaaaggatagctactcaggtgaggtagaggaagcctggatccatagccttggaaattgtaggacataaggtttgagattacaattcaaagacaagatgaaagtgatgagggctgacaagtagtctagagatgggcaaatcaaaagaataactactggggtagatctgtttcggttatgtaagttaggaactctaaatcaaggagcacccacccccccccaccaatctcatatatccaaaattatatctatgtgtctttgaaacaggttggatttattcttgtaaatccctgggattgcgggatgtttcagtgaccagagttcttggcaggatcttaatctttaggtctttgccccaaagatctttgaagttcccagacagtctgcagctgcagtattttctctttatttttcatgggacccttctagaaactgcagtgtccttgatatcactgctttagatctccttctctctcaaagtttcagaattatggcatcttgcccaggcttatctaactgacctggattttggtggaggaatgaagactttttctgtcaatgttaggtaaacttttctataccacagtcattagtacatctacaaaattaagctccgaggatccaagccagccacaagttcttcttgatccccctttcagatacatttcatcactgttaatggatctgttatttgcacagaacaaacatttccagttacttgattaattttacccctattcttggtgcaatgccttccctgtgtgatttattcctgagaatgtttttgttttcatttccccaatatctgtacttgggggatttggcagtaggttagaggggcccttattcctatcttttaaaggattactgctccaggaccacctcccgctagagcaccagttgacaataatgaggctgccgctgccagctgatagctttccctgatgtcctactgtgtcctgcattgagcttaaacagggtcaattataatgtaaactatagaggaccctagtgcccaaggcgcagacatgggaatttagcagtgggggattttgctttatcaaaaaaaaaaaaaaaaaaagtgaatgaatgaacttagtgactcagcacttagtgatttagtgatgacttaaatgaccacctactctgagcccagtagtgtgcatgagacacatcaaaaacatcccttgtatctgaatgcttccagccaagtttcccactgcctactgcttaagtgaggggctaggaggaggaaggctcagtggccagtgaccagggtgcaagagtgacacagagcatattagcatattgcattctttgcatcaggctatgccaaacttctggaagagacaattttgaatttgtgaggaggatagccaggatggtccctggtctcaggtccctaaggaatcctttgccaggaagtcatcgaggacggatagaggcagcaccaaatgaattcttcagtccccactcagaatgtggccacattctggtgagtctgtgagtggtacggggtaatggtccctgcactgtgcaggaatcccagcacttcattccagtggatttctgccccctcctctgggatagaatgtgtgtccactctctccagagccatccactccagcagcagagccagagctcacatgggtatctcccacttctaagagctgcttttcataccccctagacgttttttgttttgttttattcttgagacggagtctcgcactgttgcccgggctggagtgcaatcgcacaattttggctcactgcaacctccacctcccgggttcaagctattctcctgcctcagcctcccaagtagctgggattacagacgcccgccaccatgccctgggtaattttttattttttatttttgtatttttagtagagatggggttttgctatgttggccaggctggtctcgaactcctgacctcgtgatccgcctgacttggcctcccaaagtgctgggattacaggcatgagccaccgcgcccagcctagacactgactcttaagtgcttggacagttgctatctctctgacttttcctgatcagcctttttccatgcccacacacatctttattacctttgcaatcaccaggaacccatcattatctcttgttccaatcatatccatgaagtcatttgaagctgatgggtgcatggcagaatatcttttgtgacccccagcccaccccacatataaatacagctacttgcagacatctattttggagatacttaaaaggttcataaatatctgaaaagatgtttgacattttctgagacaatattctttgccactggaaggttctattatacacattaaaagcaaagatacatatttttctttcttaccttcactttttataaaaggttatgctgacgtagaacttactaacaaaaaaaaaaaaatcttcctgatgaaatcaggataaataattccacacatcttcaagtggagagaaaggctttgaattggtttccatggaaatctgaagatgaagtaaaggaataatttcaaggcagagcagctgaactgaagataatggtaaaatagtttgataaaggaaatagaataaagtaatcaagaagactccaatcaattattcctttttgtttacctttaggtgattaattcgtctgcgtttattaacctgatgagattaagcaggccttccttgtgatttatttcgtaattgtttccaaggtttgacataagctgtggagttattgaaggtggagatttaaattcaattactatgaagcaggtggtgattctcctgaaagaatatctgaattcacggacttcccatgtaacattatgagtgaaaattattaattcatctgatagtatctcccaaagacttttagaagtcatttggcatccacatacttcaccaaaagtcagcagcttcagaactgaacatgtaatgaagagaattcagtgcctggaaagaaaggattttattttaaagactagttatttttatacttttttttttaaaactagaggcccccttggggcctgggctgtggtgctatcattgatggaatccatgagctcaagctttgaatgccaaaaggatagctttctttgaacttgaccagtggttcccactctctacctttaaagggcacaactggataagatcatactttgacaggagagagagagagagagagagattggccagggggtggtggggggatatgcaggctggccttgagagtctttaaatgaagtgactaattgctttttgtctctgtggtccttgttgtgtatatgttttctattctttctgtgggtatagtaaggataaacggggttctccaaacactaacgcaggcgccaactctccgtcatccacaaagacccggaacacatctaagagtgggaagtaagtgaaaaagtgctcctgtacatctgacatagctgtcaaaaagtcaagtgctgtcctccttttgtcatttattcatattcattcaacaaagatttgtggaatgtcttctgtgtgcctcccactgggctcgtcactggggaattgaaacgagcaaggcatgtgtcagtaatattgggtgcatgaagaactagggaagagggaggagagggatggaaaagtcaggagatgactctggaaagatagcttagggctgactgtgaagggcaaggacataagtccataagggcaatgtaagagttggattacaagttttaagaattaaagcagcagcagcagcagcactgatttatgacttacaaagtccatgaaaacctgtcctgatccatacactgagtttaggcttgagttagaagaatctggtaagcttttccataaatttcctggtttaagtacatttatgttttaaccatatcactgatttatatgatatgtatattcttttcctagtaactaatatgcaccaagtcctacatgaagctgtttttttggtattaccaaaacttgtatgggctgaatatttgcgatattagattgaccttttctgggcttattccagaagacaacaccagccgatctctccctttggcttcagcaaagtgtggcaaactcaggcagtgtgatcccacgcagatgacatacctctaattagacacttccccttggaagttgcttcaaccctgtggtgaatggctcgagttctccgtaagctctctctccagggtgtggggcattgtgacacgcagaaactcagtccagaaagagcacccagcctgcatctaggagaaaatgaaagataccttcatcatgctaaaagctctaatctagcaataagatatgtcactacaagagcacagctttgcaatgaaaggtgaatttgtaatggtcatatattttatgtattcagcattggaccgtaaatgctgcactttgaatatgatcttatattcaattcccaaagtgaaagatctactggctgcctttttttccttcttttcctctgaataccatttcaggtttgcatataaagttgaatgcgggttatcttgcaaaatataaaaaacggtgttaaagacataaaactaaatctccaagcagttagaactcatttcagttatttattgctgagcaccataatcaaaatgctgtataaattatgaaggaagggaattgatgcacacattcccaggcagctgaatgttttcaaattagtcccaattcattgttaacacgcactcttagttaacagggatggcattgcagaacttcttttaactccatgcttacaacaatggcagaccctacctgggcaccctgtacctacctgtcacaccaaaaaccacagggcacaatctccatttattagtccctgatgtataattatggatgtttgtgatttgctgttgcctttccaaaggggccttcccttgtttcttttggctttgcaggagttcactgtcttactttttgagtgaagaatctccatttgagctacaaaaggagcaattggtagaatctgagttaagatgacatagagaatgcatacctaataccatacccaggttttcaacagtgggagggctgaataaatacattcttaaggagataaaaaatgatctatatctcacttgccatacttggtcacatcccaagcttctgccatggtgaagggtctctctctttgcacattttgagataggtaacttttacttgacatgtatagtgactcatagactgagctagttctgaattcttcattgtttttattggttgttagtgaaaaattacaagttctccgacatcctcttcctagatatgtgtgccagggtttcttgcactgttctcctcctcttagtcctctcccatcagttttcaggagatttttctttttttccattagtgtacattttctccttcttgggatatcattttcaacaggagcagtactgaccttctgtgcatatggtgagactatgaagggcatttttcacactttatagaacagtgcctatggatgtttaggcactgtgttctagttcagagagagttgtgattgccagttcctgctgcactgtctatgcatttccttagctttggtgtgtgtggtggtgaggaggggataggtagatgtctccaccccaaggcttttccccatggtgtattttctttcacaacaaccagcccagaggatgccatgttctgatgttatttgacctaatgacaataggatatagagcagtttttaagaatttccctatgttattttgaggccagacacaggctgggagatagaaggagggttctttccttctctgaaaagaaattcagtcttctctgtttttgaagaaaacaaaaaagcaaaagtcaagctgccccaaatatgcatcatggctaaaaataaggaatatgtgttgactgagtgttacgggccaacctgtgtcccaagcacttggtacattttgtctcattaatccttgcctaccaaaagctcatgaaacaggcactattatttctattgcacacatgaggaaattgaggctccaagaggataatgatatgcccacctgaggtatccaaatgaacaattttggtaaaaaaccttctttggcaccaatgataataatagtagtagtaattaaaatatattaagcatttactttgtgccattgcactagactctggggccatataaatataaaatactataggtgcccccaagcagttcacagtcttagtagggaggacagaggatgacaacgtggtatttaagtgctacaatccctagctgatgccagggttggggtgggaaataggtcatatggggatatcaataaaggctcctgagaagcaatccctgagctctttaattttatccatttacccttcatgtagcaaggttaggtcagagaaagaaaatgcaagtcggtcactccagaggggcagaatcctctgtgtcttggtcagaacacgttggagttgtggattaggtcaaagctaaaatgaaatgtctaattccacctttttccaactttcaatccatttggagcctactgagattcagtgtagcatgctgagtcgcttaggaaacctacagcttgaatgttgcgtcagttctggttgctctatttcattgcctggatgtgaagctgggtagccagccctctgtttcagggaggaacagatggaatgggatatgtctgagcagcagagccagactaccctggaaatgactttcagggaggtgcaagcagtttcttctatgccaacagtgagccaaattgacaagacagaaaaaaaaaaaacttcagtgcagaactgtgtcactgagatcaggaagcataggttttgcagaggttgacccatgaccaatcaggccagaccactgcatttagcctcacatatggttccctttggtaatgtgaacctgttattctggccaacacagcagaacacagtcaatccatttgctgacccattggattatccccagaaagcaagtaactgtcaaagctgggcatgtgtagtagccaccaagagcctttataatgttcatttggtattggaacattttcatactttacatgagaccaattattttgctgaacacaaggacactgagactcaagaaaggtaagtcactttccatgaggcacacacctagctactagcagagggcagcctagacacctggtcttctcatacttgtcccatgatctttccactgcaatgtatgctacagttcttctcccagagagcaagatacttcagctaattgcaccaagggaggccaggagccagatctcaggatgtccagccaggtgctcttccctctttttgtgtgggctctgccagctactgtgaaaatggagactttttggaaaaattagaatcatcctacttttaaaaaaatgtagcagtagcggtgatgaaaggaaaaagcatgtacttctcaactgcttcattttttcttctaaaataatggtatctctggttctatttggacagctacctttcctcaacagtattgttgagccatctcaagcctctaatctactccatcaatgaagcaatagagaactcatatatcactatagctattctctctcgaatcagccaaccaaagctaaggagatgtagattagataggtagatagacaaacagacacacatatatctacatctacgtatgacattcagaggcatccacttaaaaattaaattgcccaaagttgagatgatgatggaactcgatcactcctctcagtctgagatgtttttcacataggctcaggctagggaataacaaggaccaagtccagttttcaagtactagtgaaggccacaaatatggggccagggcagagcaaccaagcacagtgcctggcaaacaatactataaatgttgaattaagcactataagtgatgggttaaatgaattaagctaggggaaggagggatattaaaatggagaaaaagaaggtgtacagaaggggaatatgagatgatcaagtcaaaccctgcttactccacaaatctacttggagctgactctggtaagaccggctctaacctgcctttgccggaagtaccttatagtgaacaaacctgtttatctattcagtagtatccagataagagtagtcaagagcacatagcttcataaataaacataccagcacccctttgcttttggctggcaggagtcaaatgaaaaacttttcagctttagaaaaataaagtgaaggctgggcgtggtggctcacacctgtaatcccagcactttgggaggccgaggtgggcggaccatgaggtcaggagatcaagaccaccctgtctaacacagtgaaaccccatctctacaaaaatacaaaaaattagctgggcatggtggcacacgcctgtagtcccagctactcgggaggctgaggcaggtgaatcatttgaacccaggaggcagaggttgcagtgagctgagattgcaccactgcattctagcctgggtgacagagtgagactccgtctcaaaaaaaagaaaagaaaaaaatgaaagataaaatgaagtcttgcttgctctgtttggactcagcatggtgcattttcatgtttgacttcagctgtttctatgtccattgctggcaccagagtcctgcatattatatcgtgattatgttttttcctctaattgagacccatgtattttttctaagacattgggttgtgactgttgctaacccccactaattttgccactgtgtgtgtatgaaagtatgtgtgtgtatgaaagtatgtgtgtgtgagtgttctcttcaaaatggttgtatgttgcatgaagatagcaatccactggccaagtatttgactttgccagtaattgctgtagttttatgtgatgataatgtcaatagttccttagtttagctactagactaagtctaatatcacaaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggttgtctgcttttgccagttactgaaatgtggaagcaaaagccccagcaccataataacaatataacataataacataacataaacagtgcccatagattagatgctacaagaaatgagtaacagatccaggaagaaagagtccagccatggaaatgtttcttagcaagttcacctgcatctctgtgatggttaggatatacagtacacttcgtgacataataaatccacccccccaacccaacatatatgactttccatgctggtcatgcttctatagcttagtcaagaagagtgttctgttaatcaagccttgaaaagcaggaaccatttttctctcccttcaactgccatacaaaaatcagggaggcaatgtgctgctgctctctagaacaggggtcctcagtgactctttttctacctctgtgtcatacatggttgagaattctcacttatattgctctagcagagctcagggttctgtccagttcccaggcactgtctggaattccactcttctctctccctattgggaaagactaggaatgcaaggaagagtgatgttaaacagtatgctatttttttccacgtaataaaaagcaaatctctctctctctctctccttctctttcacttttccctccttccttccctcatctgtttgttcattgatctattaattcttccaccccatttttctggctctcaactgagctttctttgaactaccttggcaactttcttgaagatcatttgtccatatgtatttgggtctatatctggactcagtgttattccattgattgatatgtttatcgttatgccagcaccacactgtcttgattactatagctttatactagtattgcaattagatgttgtgagctctccaacttcattcttttttctttcttttttttgagataagactgtcaacccaggctggagtacagtggtgcaatcatggcccacttcaacctcccaagtaactgatacgactggcacatgccaccatgcctggctaatttttttgtagagatggggtctcactatgttgcccaggctggtctcaaacaatcctcctgccttggcctcctaaagtggtgggattacaggtgtgagccaatgcacccaaccattcttcctttataacttgttttggatgttgtacgtcctttccatttccatatgaattttagaatcggtctataaatttttgcaaaaagaaaaaagaagcctgctgggattttggcaaggattgccttgaatctgtatatcaaatttggagaaaactgacatcttaacaatattgagttaccatgaactcagggtatctatccatttatttgggttttttaaatttcactcatcagtgttttatagttttcaggatacacgcttttcctattttttttgtcagatatatccctaaatatttcacacttttggtgctatggtaaatagtattgttttatttcaatttctgattatttctaatagataacagaagtataattgatttttgtagattaatcttgtattctgcaaaacttactaagttttaggagcttttttttttttggtagattccactggatattcattggatattcaacatagatgattgttatctgtgactaaagacagatttattcttccttttcaatatggatgtctttttcttcttgccttattgcactggttaaagcctttagtacagtgttgaatagtgatatggttaggctatgtgtccccacccaaatctcatcttgaattataatccccataatccccatgtgtcaagggagagaaaaggtggaagtaattgaatcatgggggcggtttcctcgtgctgttcttgtgatagtgagttctcacaacaactgatggttttataaggggctcttacctcttcgatcagcacttcttcctccagccacgttgtgaataaggtgccttgcttccccttcaccttagaccatgattgtaagtttcctgagtcctctccagccatacagaactgtgagtagtcaattaaacctctttcctttctaaattactcagtctttggaagttctttatggcagtgtgagaacggactaatacaaatagctatgagttttttggtgtgtaaataatttctacccacttaagtctggaaaaagacacatacaataatggagagatagttgaacaatggaagcgtcctccgaagatgctattttgggaacaaatggttgatccctgcctttattgcatgtccaaagctagattcccatagcactgcacagatatatttcatcagagaaaagtagatcctattcatggggaggagggggaggtggaggagaaaaagtgaaaaacaagaagaaaaataaaccctaaagttcatagaatcatatatacttttctcattattctcattctttcattcatgttctctctctctctctcttctttgaaagaggtagtatagtataatggttaagacagcaaatgctggagcctaattactgccttaaaagcctagcattgccctcggaaggttaccggctctccctctgcatcagtttcttcacttataagaagaaactattagtagtgcatgcttcatagggttttcttgaggattaaattctttattcattcaaaaattttactgagtgcatagtaggtacaagatgctactctaggctctggggatacagcagagaacaaaacaggcaaaattccctgtccttatgcccattataatagagggatacagtcattaaacaagtaaaagacgtattattttaaaagggaataagtcataatttggaaaaagcaggggagaggtataaggaatcgtggaggcaagaaacttgtaaatttaaagtagttgagggaaacatcactaaaggtgacatttgaggaagggtttgatttatattaagtcagttaatgcatgtaaagaaatgggaatagttctttacatacagcaaaaatatagtacttttatgaattataatttattgagtactttctgtgtgtccaacactgtgcgagatgctttacatattatcttgtttaattattataataggcctataaagtaagggttattagccctttctactgaggaggaatctcaagacattggcttgtccaaagtcacatagtaggtgatagggccaatactcagatcacatctgagcttgtctcacgaggctaagttcatctaccccttctgaagacatcctgcatgcttagggactatattagactagactttgattcacaaatattagaagactggtcctgctgctggaggcctcagatgggataggattatgtagctaaaagcttctacaagggctgtggggagtggtgaaatatcaccttatctttagtatttcaacttgagaataagggcaatattgcctggcactccaataccagcacctggctctgacactttcactactatgtatgttgtgggcaagcaacctaagaatgggaagtggggaggacagaaataaaacaacgttactgggcaatagctattactccattacaaaagatgatttgggttttcaggatggtcgcttgctgaagtttaaacgaaaaaagaaaaatgaggctggactcagctcactgatgactgaactataaattttgcttggaaaatgctggcaatgctataaaattcaggccaccatctgttagtgcttgcttaaagtagcatttgcactggataattaagatgtcacatgcatttgaagcacaaatcatcagtgcatgggtgcctagcatccctggaaagattgtggatggtgaagatgttctgagaggaatatcatgttgcttgaaggatacatttatatgaaatcacaggagctagtgttttggatcacctgagtggggttgagtagaggaggagatgaggacactgagaaaactgctttcttgagttgactggatcatttaatcaaaatgatcaactggctaggcccatgcagtatggcaggcgtaataatatgtttggccatcactgtctgcaaagctcatagtgaattcagggatataaggaagaagggaggcaagtctggctaagcctaaaattcctaattaaaaaagaatttgcttgtaaagcactttataatttgcaaacagccttctcttttgttatttcatttaattaattttacccaccatcctaggaagcaggaattatatctacatcttacagactggaaaactaaggctgagggaaatagcatatttttgcccaaagccacatagatagtaagtggtagaaccatgattcaaaacagggcccttttaactctaaatcctaaagtattttttggccaaagcacaacgtgctctgatattagagtcaaataattttacatacctgaccaaaaaaaaagaaaaagaaaaaaaccatattttacaactttacaggcaggtagagaaacttacagacttcaattccaacaaagatgccagagactgccaaatatagcaagggcctggaatttttaaataataagaaataacatttattgagtgcttcctatgcaccaggccctgttcggagtgctttaaatgcatgcattatttcatttaatcctgagaactactccatgacgttgattcagggagagttcatcagtagcttagatggtgttgcccatacccaaatattgaaggttctctttggggtgatgtctgggtactttcagcagacacagcatggctggattgtggagctgagccaaggtaatgattctcccagctttggagtctaaagagtttcgctgttttggcatcaaagaccataattaatggaattaagaaggctgggcttgcttccaagtggctcttcaagagtgtccttctttctcatcatggttggggaggagatttgtgctccacgggctttaatgagatgttctgtacccaacgtctgcatgtttatcttcacttccccaatacgtgcctatggacccttcaaggatgatcaagctattttgtgccttcaccctaggcaccagggtatgttgttcagttgtgatatttgtcagaaaaatcttaggttggtgcaaaagtaattgcagtttttgccattacttttaatggcaaacaccacaattacttttgcaccaacctaatagtatgctgccactgcccactctcctagtactgctcccccttcttctgtgaaatgcaggtaatcattctcatcactcctcctggcatcaccaggaggatatgaaaacaagcaatataatgtctccaaagaccttacaaaaaataaataattacaaaaacatacttcatggtggttttcagtaactttggggggaaaaaatgcatctccatataagtaaagttgacagactcttacccctttccctgagaatgtcttcttgccatctatgtgccaggtttgcagaggttgccccttttctcccacagatcgttatgtcctttcccaaccacatgcctagtgtctcaccgactattcatttctcacttgccctccattggcagccatattttcaggggctaactacacatacccagctttgtcctaaaaacacacaccaagtctggaggccacgagtttccttacctgattatctgggtttctattcccccacttggtggtgaggaaacacatgcataatgttgttatttttttctgcttgcttgtaatttgggaggcagtgcgaccattcattactgaatgcctacaatggacaaggcatttgtgttagtcaacaggaataccaaggaaaaggcatattgtccctctcccctgcaaatgcctcctggtggggaatctctgcctgctgtagccattcttcattccaattctggcttctagcagatgaaaaaggacgaaaagaggtataaagaagccacccaggccattgagcctgagttcatagagccattgtgatgcacttaccatgtccttcctctgtgtagaccagtggttttcagtctatgttctgtacagcccttgggttctgagggaggacctcaaagcctgccatgagtgaaagtgatggggtagtctggagtggtaaatagatggggctccaggccctcactctacctcttcctgagtgactccattttaatctgttttacatattgggatctgcctagatttcattttttaaagccctgctgctgctagaatggaaaaccaaaaaccatatgttcacacttatacatgggagctaaactatgagtttgcaaaggcatacagagcaatataatggaccttgagactcaagaggccagggataaaaatctacacattagatacaatgtacactgcttgggtgatgggtgcactaaaatctcagaattcaccactgtgtaattcatccatataacacaaaactacttgtactccaaaagctattgaaataaaaataaataaataaaaataaaaaatacaaaagccccgttgctaagaaggaactgataactaccagtgtagacccagccagagaatactcagggagcaaggtttttattggaaaaccgcctttatccaccatgcctcagctccccagtgacaggcaaagcagttctggctattggacaatctcacagtcccctttctcaattctgcaagcttttttaaaaaaagaagaaaaaaagaaatgcttcctttcatatggccaaattgctctgaacagatgaaagggaccagactgacaggtgattgttccctaagattacagcctacacccaggctgaatctgaaacacttggaggaaaaaaaaatgctacaggttttgagtaatgctccccgactggcatctgctctcaagactaaatgaacacacactatttccactccatttccttaaactggcctctgtgctaggctgtaatgaaacctgtaggggaagaaagaccatttgcttggggaaaggattattttagttgcttaagccatcctctcccaaaaaataggcggatggttaggctggagtctttgtttttaatttaaatgtcattaggaggtccatgagttttcctcatatttattgtatgctatacatacacattgtagctattttatataaccctataaacaatttttaaaataaattttaaattgtctctttatattatattcactaacaaattcaaccttatcaccaacaatataatgttatcatcaggcccaaccttcatccccttcgttatactggtcttcttcttgtctataaaatgtctgcttttccataccattgcacctatcttgaataacctgtgtccttcaactacccatgtccaaacactagttcattgaaaagagctcattctttcaaaatagataagatatgtatttctatcccagctctagtaccttggacaagttaatctctttgagcctcagttttctcatttgtaaaatggggagaataactggaccttcctctctgctagaaattccttgaatgttcactgagatgacttaggcagatcttctggtacatactggtactcattaaatggaatcgttgttattacttatatttcaagacaattactgtgccccttactccatcatgtctcccttgatgcaacctgagggcatctctccctcctctgaacagcatctatttagcattgaaccagacactaagatgtgccattcatttgtttattaattcaatgagcaactatttattgtgcatttagaatgtgataggcacattaccagatgctggggcagggtgggcatagagaggtggatgtgaaagaaggaggagagaaggtggagacagcagggctgaaacagatactgctcttaagcacctaattttctagtaaagaagatattcatatacaaaaataactagaatacaaggaacaaagctatgtgctttgtaagaaaggtgcagctggagactcggctggaggactgtctccactggaagaaaaagttctggaaatgtcaactgtcttctttcttgttaactttccctttgtttgcttatctctccagcaaagttctggctgtggctccttgaggaagagtgggagtacttctttatcttccacagagcctaccaaagtacaaaatgagctctcagtgtatgcgctgatgtgagtaaagtatctgcagtatctgtagtaaagtacctgcaaagtatctgcagtaaacagaataggtatacaacacatgccagaaaagaccacctattctcttattccatcttatagcatctcataaaaagtgcatgcactgcaactcgatatgtgaaaaagttctaaaaaaaatggatacataaagaagtattcttcctccttgaactttaaagattcttgagcttattttaaacaaagagcattttgttgaggattttggtattgagccaactatagtacacattgcatttccctgaacctcatgatgttacagagaggggctaggagcacttctggggtacacttaccctacaggcacttctatttgaacctactgcttgtccctgcctttctgaatctgagaaattatacctgagagtactttttaaaaaccagttgattgaagtatgattgacatataaaaagctgcatacatttaatatttatttatatttaatgtatatatctcattgagttttggaggtaaatatacatctatgaaatcatcaccatcattaaggacataaatatatctatcatgccctaaaggtttcctcctgccccatgattattattgttttgttttttgataagaacacttacaacataagatctaccctgttagcaaattttacatataaaatcaagtattgttagccataggcactatgctgtgtagtagattcccagaacttatttatcttgtgtaattgaaagtttgtaccctttaaccatcaccacccccttgcccagcccctggtagctaccattctcctttctgcttctatgagtttgacctgattgtgcttttgatggatgttagaactatcttccttgacctggcttcagccatataagactgctgcagtgtctgttgaaagttgcatcccctaccccatctcagcacaacattctcctcctcctgttcatcttcatccctctttcaacccacagtagtcctttcattaacagagttgcttattcagtagtgcacagttcttttaaggcagattccaatgacttagggtttgtcctaattgactaagctggatgcaaaaaaccctgagagtcaaatgactgtggacatctgtccccatacctaaccctaagcaactctgacaccttgagaaagtcacctagcctctctgaatctgttttctctgctgttaaatgatggggctggctttgctgactaaagtacaaacaaatcgtgagacaagcccccgtcaccactatcaacacaaataatggagctagaaacacgagatcctttccaggtaatttaatactgctgcattttaaaagtcgtgggccgagaagatgagttttaaaaggagggaaaaagtaattcacatctcccaagatagtgtttataatggtctattaagaacacattgaaaagaaatggactaattctgtagtgttttacccaggacagcaggccagttcagtcaaagtgttttttgaatagggctataagcaaatctctttcggtgaaacctagagctgctttgcagaaagcagaaaagtggagttttcccctaatactttaaaaaatggtcacttcaccattgccaaacttcattaccactcccaggagctaaagcttcgagattaatgatcctcatcttaaagagaaggcagtgaccgctaaaagaaaaaaagaaattacaagcacatggtatttactgttctgcattctttgagaattaatgtcagtaatactgttgcaacatttttcaaaataaaggatggcgttttctaattgtctagttaaaaaaaaaatctaagtctgaatccccagagaagaaacctgagtttaaatcattaacaccacaaatctctgataattgtggcatgtttgcaagtgccttaatcaggatggtatgtcttagtggcctgttttaatttgatcacactgattaagcttctgtaagctaatatacgttgcatttccaattcaattaaatgagaatctcctggccttactagatattaccaaaatgccctgatgggtgaacactagacttggtattttcaattgctaccgactttctgattatataatctttgtattaaatgaaatcgatgaaagctcaaattaaattcagcaaactttaaggagtaaatatgttttccctgtatttttggcatactttcacctcaaggtgtggagcatgttagtcggaactcattgattacctttagtgataaattttatagggctctctcccccgtataccaattcctagaacagtctatcctgttagaaggcactgtaaatgtgggtgatgaataggcactctctctattatatatgtattatagttgtgcctttttcagctgtagataagagctatcttatgtaaatgtgattgctttgtaaatgtaaatgcctattgggtcatcgatcatcttggagatagaagaaacagaacaatagggggaggtgtgagagaaactgtctagggacagaaatgaagaaaattgctaagtgggtaacagattgaatcattagagctggagaactttgtggaggtggctaggatggaaacagcagccgcgaaactactggaagcctggcttgtgcctgcagagccctccaaaaggcttgcttccttgaggttctgaggactgactgctaaatgagaaatgggcctcttcagtgtaggtttgaagcaggaaggaactgaaaagaaaagcccaacttcattgttaggtgagcactgtgggtgcctgtcgtttgcctgcgcataacaggtttggaatctctcaaatccttcccactctcaacaacccacacaagttgtgagagtactacctaaaaacagccccttggtgtgccagtcatatgccaccccctggaggaggagggtactgaataatacctactgctgctgattcccatgccctagcagttctctcaattttttgggtggtatcaggaggcaggcaggcccagcagtgaactcaggaaccatcagggtgaaagtgcctctggaattttctcacaatctgttaggccctttttatggagtctggttttcaaaacctgctataagccaaatgtgtgactcacagagtaataaaggcctctaaatcaatttgtaagacatcttgaagttaaacaagaaggaaaggctgtttttgccccacatatttttttagatcctgcctacttccacaaaggatttgagatgacttccaaagcctttcttactcatgcctaagagtatttaagaactatttctgaaagttgaatccatgtgtaccatataaatagaggagaatgattatatggaaacacaaacagattggggctctctcactttatacaatagatcaactctggggaagtggttaaatgagggaagtatttggggcacttgctccagtcttcccttggttgtccttttacttccttctcccagcatctgcactctccaagtattgcctgcccttccaagcaaaacttccctgtcttgtattccatacctgcaaggaactttatttactttctaataaactctgctaataaatatgaaatagtgagtactagaggcttaatacatatgttagttgttctaatgttcaaaggaattcctacaatggtaggagagaaatttgaggccagaaataatgccattaagcatttatcccagctgggcatggtggctcacgcctgaactccaacactttgggaggccaaggtgggaggataatttgagaccaggagttcaagacaagcctgggcaacatagtgagacccctatctctaaaaaaaattgttttaaattagtcaggtgtggtgacatgtgcctgtagtcatagccacttgggaagctaagatgcaagaatcaggagtttgagtctgcagtgagctatggtcacaccactgcactccagcctgggcgatagagtgagacctcatctcttaaaacaaaacaaaaaagaagagagagagagagagagagagagagagagatccctcctatggatttaataatcatatcctgcattggggcaggggtgggttgaggtggaaaagggggtgtgaaagccatattatagagatgggcaccaagaccgagttttaaggaaagaaaaagaggccaagaaggatcactgaggaccccaaaggcaaacttggctgccttagaattttgctggggctgaggactctctggtttaaaaataaatatgaaagcaaagatattaaaggcaaagcacaaggatttacagagaaaatgagcagactgatttttagttgaaagatgtccacaatttatcactaagttattggtccaagctcatattccatcctatcactgttctcctgcacagtgacctccatactctaagcaaaccaaacttcctgagccgcacattgccaccccataccttggctcatactgttctctccagacacatttcctgctctacctctttgtccaaataggactgacttctcaagacttcattcctcctgatgttcaacagctgaagcagccataccttcctctgaacctccggaatgggttttctggacttctcttaggggacgctgttcatctggctttatcatgtatattcatgtccaagtcttctcttcccttcaaggctgcagacatcttggaaggagggcaagtcctctttatatctttactcctctcttcccatggactgagctggcccagaatcttgaaaaatagccaaccactgataaatgctttctagttaagagttcagactctggagtcaggaagttctggcagcaagcctcagcttgtgtttattacttcacctctctaagtcttggtttcctcatctgtaatcacctacttcggagttgtgttttttttttttttttagatagagtctcgctctgtcacccaggctggagtgcagtggcatgatctaggcttactgcaacctccgcctcctgggttcaagagattctcctgcctcagcctcccaagtagctgggattacaggtggccgccactgcgcccagctaatttttgtatttttagtagacacaaggtttcaccatattggccaggctggtctcgaactcctgacctcaggtgatccacctgcttcagcctctcaaaatactgggattacaggcgtgagccaccatgcccagcctggagttgtgatttttcaatgagataacccatgtagaatgcttagcatggtgcaagacacatggtatacattccacaattatttgttattgataccatttttcccttaaggaaaggtgcagtcttctctggctccctgtggcaataatccaactgagccattattccagaaggaaatcacattagggggcttttgggcaagggtttgctaaatgccctgactcacactatgtctacagtgacatttaccccatcaaaatgcagggaaagacaggaactggtttcaacttgaattcgatatttctgtggcccacatgctgaatgccaccaaagcctccactcccagagcagcagtttgtagagatggaatagtggcagtttttcattttccagagtccactcatccttccaagaatctcaatgcctcattgattcataatacagtgcataaagatttcatttttcctgcccacagtgatacattatggaggcaatctgttttgccactgaaaagtttgcttagtagaaaaatttggagttttgacattcaggaaattacagtcatctgtaaaacacgattgatatgccgaggctaacattttcattgcacttgcagagccagaataactatgataaaatatgtgttaccccacacacatttcaggatcttttagaaacattagctctgagaacctcctcccagggctccaggactagaatagctatccccattagttgtttgtttgccactcacaaggataatatctccattgacccaaccaagaatcagactgtaagacaaagtgatggctttcccgtaccaccaggttaaaggcatgaaagaaagtaaaaagatagagagataaagaattccaccccgttttggaattgttaaccagccacaaaaagcgcaggtataggttaggtagaactagaagctgaaggcttacaaaagagaaattagactgttctacatctgcctacaatttaaacttgttctctgtatttttacacccaaccttttttttttttttttttgtctctttccacatgcaattttcagtgttaaatgacatcaaaagcctagggctccggaactatccacttgttcaaaatttgatttcagaatgataaatacagttgttttagctgagagatgtagttgatttccactggcatactgagaaagtggtccattcagggtcagatttggccaggttgtgagcacttttcacttggtcctcatgcactgggacccacgggaagtgcacaaagtctgtggttccaaggcaaatgacaggtaccactgcttttgactttggaagtggcttagagtgaaccccattcagctctgggacagcttcttcaggcactgagaacacattctgcccaaagtgtgtaagtctgactcatgaatcaagcagtttttagaggtgtcattgaagtcctgcatgcaaccctatgcaaacaattattgccagtgcttactgaccttatattatgtgtcaaacacaattctaagtattaattcatttagttattacagccactctatgaggcaagtgatagaattatcatcttcactttatgaagaaactgaagcacagagtctgagcatctctcccaaagtcacactgctatctcataagaggtagagctggattcaaatcctcaacagaatggctgcagagctcatgctcatgatctatattatattgccttgcataaagaaattttataaaagccctctgttgtcagacatgctgcctggattatctcacaagtgccccatgcccatggtaggaaggctttcttgtcctcctaaaacacttggccaaacttcactctcctcctgtcccatggttaagcctcttgcatccaacaacttggcttcattcatttcctaccagtgtttgcacagatgctagaggagcaagaataaagccaatgggtatagggaggagaggagatggatgccaaagacacacttgggcaaagaccatgcctgcctaggagttttgggactctccagcaggggaataaggggaaaagtgatttcccagaggcatgttgaggattcacttgcttgtccccaggctgaagctttgggggtacccatattcagctttctctcctgctgctcacctctgggccttatttcagctgatctggccactgacaagggaaactaagagacagtggagcaaagaggactcatcagaatacaatgaggggacatagaggctggaggggtggagaagatagagggggagaaaggggagttatggcgtcaggacaggaaaaaaagatgaagagagaatggcaaaacaaccaggaggaggaggaagtcactgaaaaagaagaggggatgcacacagcatgaggtgggatgtggagaagactgagagaggaaggaaactgaggggaaaggctgatggagatgttctctctcctcacttctgtgatctcagtcctgtccatatgggcagtctgatatggtttggctgtgtccccactcaaatctcatcttgaattgtagctcccaaaatccccatacgtcgtgggagggacccagcagcaggtaattgaatcacaggggtgggttttccatgctgttcttgtgatagtgaataaatctcacaagatctgatggttttataaagggcagtccccctgcacacactgtcttgcctgctgccatggaaaacatgcctttgctcctcctttgccttccgccatgactgtgaggcctcctcagacatgtggaactgtgagtccattaaacctcttttctttataaattacccagtctcgggtatgtctttatcagcagcatgggaatggactaatacactctcctcaccaccagtagtcttccttgactgcctgctgggcaccactgaaaggctcttacgttgcacggtgttccaactagatggccttgctcttttccttctgtgagctccaggtacacttagagatgaggcctgtcttcttgtcctgaatttggacacatgacttttttttttttttttttttttaagagacagggtcttgctctgttattcagactagagtgcagagctgctatcatggctcactgcagcctcaacctcctgggctcaagtggtcctcccacttcagcgtcccaagtatcagggactacaggcacatgccaccacacctagcaggagggatatcttagaggtcatttagtccctcccccatgcaaatgaccaataagtcttcattgcttttgaccccgtactccttatctcctatcatcccctacgcacaggaggcagattcttaaaccaaaggaataaactttacattgtggattgctggccaactgtgttggggaggggctgtgcttcccagcactcctgaacttatgccaccccacaaggctggccctggttgcctgtcccattatggtgttgtagaaagctctccgctgtcatgcaaattaccttttaaaataaaatgaacaaagtggcatggggtagaaaaatgagtctggatatctagacttgggtttaaaacatatgtaacttgatgacttactggctgtgtgacctttcacctctctgtgcactaatatcagtgtctatgaaatggactggaactgtctatttctcagtcatggtgtaaggctctatgaagaagaagatgtgttttgttaaaaataaatatatatttgctataaagaactttttagaagtagaagagaaagagggtgctattcctttcaaaagatttggaataatagctctttaatccttgaaaatgaactgagaaatataaatacttatgattatttaaaaacctcaaaggtgacctgctcatcacctgaactgtgcttggtatgctgaaatgcagcaatgccagtctcccaaaaatgtacctgcccatatttcaactgtcagcacattctttccaccacgtagaaggtgaaggtcgacatgttctccctgcgtgcatttctagtaacaccttaactcatgaatgttaaatggaaggaggtgggataggggaacaacaggacttcaaaaatagccttggggaaatcaaatcttgctttaacttagtgtgttcatgaccgattcatggctctgaaaaggaaaaagtgtttgatcaaaactgtcaccaaaagacctcattttaaattcctctactttctttgagcagaaaggaataggtatcctgattatgactattgaagcaggctttacctgtgcataatagctggtctcctatattctgtgatttttggatggcctcctgccccatagaacttgccctactgctgcctgaaattctaccataagagggcatagcattgccccttaggggctgcccctttaaaatggaaatgcttctggtggtgctaagtacatgacactttgacaaaatgagtttttctaatgactttccttctaggtctcagattttgaacagactaagcccagagagagagtccagtgggggaaaggctggaagaagggggaggtgtaggaggaggaatggagaagcttggagggccgaggtctcccagctacaacaaaggaccaaagaaatagtaactaaggatgggatttcaggcctcagtggggtacatttggaggagaaggggcctcctttacccttacaagttgtattgtgggtgcagcagtctctcctgactggggaaatgccaacctggggacctgaggcactgcaccagccagaggtggagtcactttgggactcgtttcagggcctgtgtagtttaggggacaatgccctttgtttctgattggtgggaggaggaactgatgtgcagtgggatgggagaggataaaatggagcatcctgggtgatttcaaggcttcatgctagaaggctcatcaattaacccaccagtctgagttcccataaggtgctgggccctgtgttgagagacaggagagatatcaaatagtttggctcttaaggaatgtctagcctggtttgcaagacaaaataagagaaatggagtatgcagccatttatttgaggcttaatgtgcaacagagaaaacatgggggaaacactgaattgggagttaggaaacctgggttctggtcctagacccactgctgaccaactatatatccttgggaaagttgcctcctttgtttgaggttcagtttccttagctgcaaaatgggaattttatatcttgtcctgtatacttcataggattgagtgagaaactaactttataaaaacagtggaaaccttttcaaatttctcattgtgattaatcagccctccctccctcactcctatcttcccactttccctttttctgtccttccctccttccctccctcccccctttcttcctcccttccttccctctttctgtcctttctctctccctcgctccttcccatcttccttctttccttccttccttctctcaggcactgatatcaatgaattttcttcagatgacttttctgaaaaactattttgagaagggcaatgtcgtttagagtaattatctctggccttaaatccactttgcagtgagtcactatttctgagaattaagctcaattccagacaaaaaagcccaagccaggagggaaagctctgtaggtggctcacgcagcacgcaagcagatctctcttctcattgacatgtcctcacagtaaatgatgacttgaagaatctaagggaggttctgccctctagcatttgccttagttggaaagtcagggtcaggcatctgtcttaatgtgagcattgactttgagtccttttttatgggtttaaagtcttgcagtaaagaataagtgaacgtcaaccaaatagaggggttgcctttgcctaaagccgattcctgttcattggtcatcttaagggtgatattcaggaaagtgaacaaggagtcagagacttggttttgggtcccttctgtgccataaactggccaaatgaccctggatgagtccctatccttcacctctgggctttagcattctcattgctaaagtgattggagcaggtaacctctgagaggtctgccaaaccatctactctatgaaaaatatgagtttgtcactttcatctttcatttgtgagtggctctcattggttccattcacaggaaccttgcccttcatcggttggccagtttccacacatgggacatggctcttactcaacgagagagtaatccagagctcactgtatgcatggagggaggtgtggaacactctcaggctcccccttggttgaactgcccccaaccatgatgagtaaaatggcctcacccactttcagtgaagtaagatcccgttttgcacaagatgaggtttgtaaagtgcccctttaaaaaaaaaaagattctattctgtcaaaaattatggaatgttcatgctttcatcaaagtagagccatggcttatattttacaacacgcatagctgtctaatttcacatactgtttttctattctgtcacattttggacaaaaatgtcttttctctaggattcaggacattgcagtgtgatgtaaaattgcaatctggaggaatatactgtgcgtggagaagggatgatgagggcaactgccccgtgactccccaatactaggccactgatttcagggaaggtctcctttttgccttaaaggggaaacacagttgtccaaagtctctatgccatcaaaaagaaacctctgatgcacgaaacttatagaacgcttgtcagtttcagcattaacataaccttcaaaataattccttctgctcaatcaggatcttcatgtcttcagtcctccttcctgtacttgccccagtgtgacatcacattccttagctagagaggtgggatgggggatggatgagtttttttcaccacccagtattatcattgcaaagaaacaaggctgtgcctgttactgtatagaatgcttatttccccacacatgtagcccagccatgttattcagtaattatgccttttgcagcttgaatatctgaaggaaaaactttcccaggtgaaaggaggcatgaccctgccagcccttgaaattctgaatggcttcaattctttacagttcaaatggttaaaaagttctgttcccccacacccccccagaaaaagccagggtttgcacttcatatctctcagcaccttgaagcaatattagagctcattaaaatcaacccagggctcaagaagggaagccttcatttagggggaaaacttttcccctgtgctgctctggaaaatagcacaatgctgagagcaggcatttttcctgactaggtttcctctaacgatttctccaaagcacagttagggtacctgcctcccagacagcacatgtccagcaggcccaggtgaatgcgtgggactggctatcactagctcaaaattgccttaatatttattgacggcctaccatgtgaaaaaggcctcttacttgatttcttgtctctgtggaggtccctaaagaaatgattctgtgtgtctctggatttctcacaatctagagacatggaaagggagctggctatctggttcgggatccgtagaatacgaagtatggtctaaaatggtgtccagctatacccctgcccccaggcccctcagctctaaaatgctcagatcccagccctgcggttctgtaaggggcccacaaaaaccacagaattggatccctcatttcacatcccagcatatccaactgcctcctactcaaatgtcctgctgcattcaggccagttgtgctcctggcctgtgactcctgaggctgtgctcaggcacaaatgagaatgaacagcccagtgggtgagagcacacacattggaggctcagacacatctgtcagtgaggacacaaagaccaaatataaagaccagattttatcttcataaagactctatggttttcatgcattgtaaatgagaaaagtagaagcacagagaggttatttgcccaagatgacacagctagtaactgccagaactggaatttgaacacaggcagtctggctgtagatcagcattgtcaaatagaaatacaatgcaatggatgcacctggaggcgataaacgtaagcgaattaatgcaggaacagaaaaccaaatattgctgggtgtggtggctcatgcctgtaatcccaacactttgggaggtcgaggcgggcagatcacttgagatggtcaggagtttgagaccagcctggccaacatggtgaaacctcatctccactaaaaatacaaaaatcagctgggcattgtggtgcatgcctgtaatcccagctactcgggaggctaaggcaggagaatcacttaaacctgggaggtggaagttgcagtgagctgagatcgcaccacttcactccagcctaggagacagagcgagactgcatctccaaaaacaaacaaacaaaaacaaaaatccaagtatttcatgttctcgcttataagtgggagctaaacattgagcacacatgaacacaaacagggaaacaatagacaccatggactacttggttgggtgaggaaggggttgtgggttgaaaaactaccaattgggaactgtgctcaccacctgagtgatgggatccataccctaaacctcagcatcgtgcaatatatccatataacaagcctgcacatgtacccctgtatttgaaataaaagttgaaattcaaaaaaagaaatgtgatgcaagtcacctatgtaattttaaattttatagtatccacattaaaaatggggatacagatgaaattaattttaataatacattttatttaacccaatatatccacattattatttcaacatataatcagtataaataataattaattcatgagatattttctctacctctaagtcttggaaatcttagtatgcttgaaaacttaaatcacttcttagttcagactagccacatttcaagagctcagtagtcacatgttgctgatggctaccatattggacagtgcagctctagaacaagcccttttcatgatatacactgtgactaaaatgaaggcattaacacctatttgataggttttctgaaaaagcttctagcctagtgtctgacatactgtaggcacctgttaaatcaaaacatctattagtttcctgtgtgttttgctctttgctgatgtcagaatgccgtccacccaccccaccaccatacacgcacctagtcaaatcctttttgtccttcagaatccatcatattcctcctcttctatgaagccttccttgatgaccataatacagtcaactctcttctccccactcatttctcacttaatctctgtatgacacaattagcactgaaatatactgtgcctctatctgcccccgccccctccaattctaagcccgttgaaagctggcacccgtatacatgcaacttcctcaccatgcctacagctctaattatggcgacttctaggtcagagttgatacgttgttcatggattgattaaacttctgtcttgcaacccaaggccaagcccctcacctccagggctaaaagggcactatgtaccctctttgcacatgcctgtttctggattgagtttcatgaaagtaccagttttattactttttagttaagacctgaaacatgcagggttttatgtggatgtactaatcaatcaaaaggcaggaccaaagcaatggattcctgggacaagaggcactagggatgtttatctgaagagcaaaccatgatagtcccagtggggacacttagaaatttccccaacctcctcccatccactgtggcatggagcttatgattcttcccctctgtgcactcttgtttcagggttgggagaaggaagagaaccaacccctagctctggcagttccagatgccaatcctcaagggatggcaatttgacagaagatgtcacatagaaacactcagtaagctgagaagttccatatgtggagggaggagttcctagaaggaaagtcaggcaggaagcttgagtgtgttaatcagtggcagatctggtctccatgtgacttgggcagatcatatcccttcatgggaccccagtcccctaatctgcatgctgtagggtattttcataaaagtttcttccacctcaagaatacactgactattaatgaaccaagactcacaaaataattttagaatgcaaaaaattgggagaaaggcagtgtaatctacaaaatttttcatgatgtcaagcaattggatggattctgggtaaaggcctgcaactatgggtcataaagtttggaatttcacatcttgttaaagaactcagctttttcactatttgcaaaagcccttagagttatgtactttgaaacctactgggctttgggaaaaaggagagtgatttcttttaaaaagaagtaaatatcaccaggactcattgtgtgaagaattccaccttgagtttgaattcaaaggcattagaaatcttctttattttcaacaaaggaaaaaaatttctgctttgttaaagaaaaagaatcgcatagaaaaacatccttctgtttaatgaaagcccatttgtgctcctttgagcactccccacaatacacacagatgggtttacttttagttaatcagaggaaaagaatcaatgaatgaaggtgttactttatatacacagaactggtcctttgggtgaggtatgaagaagagcagaaaactccttcaaggagaactaatagcatgtttggtgggtgcaagaccttcagcctcttcagatttggttttgtgtctggtagatcttttgtctaataagtcttgcttgtctcatggatcactgtgctcccaagagttcaccttgctccccacctcctgtgggtagcccagaaagtctggctaagtcagcagcccacagcatgaacttcaaggggaaaggaagaggttcagcatccagatcatttaggtctttctagtgttgtgaagacaattaaatgaagtcatgtgtcacactgctctatgtaacccactgtctgcaaatgcaacagctcactcttctcactaggtaaagcatgactactaagccataaaacttgtgacaaatgtgccaaaaacaacacatctacaggcacgtctgtctgcttcaaagtagtccccttgtgaagtcccacacttcttttatgagactgctgccactgctgataacagcatttattaaactcctgtttggggactactaatatgagctacacaagaaaagcacttaaaacagcacctccagggcttaaggggtccagctccatcagaagcatgtttgcctttgattcaatttaccatacttttatttagtttgtgctcacatattaatattgtttgatttgaacgccttcctccttgctttgacccagtcatttacatgcaatgggaggatccatgtggttgctttagacttcattagccaaggaaggagaccagaccttcaacattaatgactcagtgtcatatacaaccaccccaactattggcagagttacttaggaccaccaaccacagttctttttctaccactcattgtttctccaagaacaagatgtgcaaaggctgaacttttatatatatatataaaatattttatatatattatatataaaatattatatataatatatatataaaatattatatataatattatatataaaatattatatatatattatatataatatattatatatatattatatataaaatattatatataatattatatatataaaataatatataatattatatatataaaatattatatatataaatatataatattttatatatatattttttatatatatatagcacatatatatgctacaggtataatagaatgttcactcctattgatttgggataagaatttgtttcctttcttaaattaactttttattgatcactcctatgaccttaactgctacgggttttctggccttcttctattaaaaaatgtctttgatatttatttcccctttgagtagtgcagggaaaaccttatcatggcctttcgtgaaccagtagcctcaaaggaaagtaaatgtttacagcatgatcctcagaactttgctcaagtaacattccctggactttcccttgatggaaatgggtgcccccagggtttctccaaggggtagagagaagatagggcttgcatccgggggcacagttggcttgtctacactctagataccacctgggatttctgagagacttctgatctctgaagccacatgcctaggacagtgattctcaaactcaactgtgtgtatatcagaatttctggatgggcttcccaaaatgcagattggcaagccccagcctctgagtttcagattcagtgagtggacctgagagtgtgcatttctaacaagttcctaaatgatgctgatgctgatggttctgggctcacactttaggaaccacttttttagttaactcatagaattagaagtcctgggcttgtgccctagcaccaggatggaaagaataccatttctagagtgagagagacctggattgaagcctgaacacacctacttaacttgaggcgtgacccagagtcacatcatctctgagtctcagtttcttcattctggaaaagggaataataatatatgattcacaggattgttgggagttaacgtataagtgtcaggcacagagcacccccagttcctggctatgtagttggtgtaagaaagtgtcctctttgagcagccaaatgtttacccttcatgggggttagtgagttctttcaggcctggttgagtgtgccatcctaggtaactagcagacacaaagagggtctgctaaaataacaggacttcggcccagaaatagttctctcaggtagattgattctcaagggctactggcaaggtgtgatttggggacaagtccttgcctgtctctctctgggcctcagtatccccacctttaaagtgaagggtttgacctaaatgatttactgtctcaaaggtttcctcctgttctgacgagtgtaggactctgtgacttagaacttgggcacttatttcagaatggtctattaaaaggagaataaaaaataagattcttgtttttaaccatttagttatttttaacgtccttaaactttccagccttcttttaaactgggatactgcacaaaaagtcagggacaacagctaaatataacaatgtccttcacagctacatctccttaaaatgctccattacaggtataaaatggtatatctgttatttcatagtgacatctagtggcttttccttatcaaagaataagatacgcattttcctatttgctcatcataagctctgctgcttctcctgcagaaattcattcaacaatcttttattaattgcttactttatgtcaaacattgtgctaggccctgaggatagatacatggttcttaccctcccagagctcatagtccagcggaagaggcagaaaaatcgcttgacaatcccagcacattgtgatacatgttacaatgggagaacaccagggcgtctggagcagagaagggggtgcttaactccatccagggaggtcaaggaaggtttcgcggaggagacagtctttgagttgagttttgaaagactttgccaggtaacctacaaaggataaatagaagccattcaaaagagtgggcactccatatacagaggcaaagcacctgtggagtcactgcctgggactttgatttggaaaattcagcatatagggtatagagcaaggttcctcaaccttggcattattggcatctgaggcagggtatttctttgttgtagggggactgtgcatgataggatatttagcaacatccctggacttgacttactagatgccagtaccaaccccctccccaagtcattacaaccaaaatatccccagatattgccaagtggcccagagttgggggtttggggagtggagatggaagatcactcacaattgagaaagacttgtatagagggagctcacttgagaaggctggacagaaagaaaggtggttgctggattccacaaggctgtctgtagcatgtggaggagcttggcttcatgtcatagttgatagggagccattgggagggcttaattagggaatgacaggtcaggtatgtgccatctgggggtgtggaagtggcatgggactggagacctgaagagtaggacgggatgctactgcaatgttttagtagagaagtgatgaaggcctgaccccaggcagtggtgcaaaggatggatttcagagctattagaaactggaaaggacttaagcgaatgtttagctcttagtagtgaggggagattagaggagtcaaggatggccctttggtttcttgcttggacaactctttcatttgttgctattatttcgacaattgcttatcagtgacaggaaaaagttggcctaaacttgtagacacaaagcaggttcactgtgcattgtttataaacttctatgggtttggtgagacagaacacactcataagcaacaagttacatgaagtgggtttattacttacagataggcagcaagggacaaaagaagcctaggatccactgtgagatggtttcccaagactcaagaaagctgcctgggtgaatgagtctcgattaagcatgcctcacttgcaccatagctgagagaccccaaaaggcagcctttcctgagttatatacctcaggggccatgtgactcatttagcaaagctttgaaggacatcctgcttctgagagaaaggaacaaaggctgggctgtcccaggcagttcctccctatctcaagatgttagattctccaggaaggactggaacaaggcttttgctgtttcaggcagttcctccctatctcaggatactgcactcccagcacattctacagttattcttaagaatgacaagcaagaatgaggggagtattgtgttggtccaaggccacccagagaactgtcattcagtagaaggtggtaaacctttaactgtgtagtgcctgtaaagtcaccatgggcatacagaagcaccaatcagccattcaattaacccatgtaacccaatggggagtcatggctccaatttaaaaatgtgacaccttgtcattttaattaggtgatacatttggtcacaagaaagtcctgtccaattactactaagtgaaacaggtggcgtatgattttcctggggctgaactggcctcattcagttaaaattcagtcagtccattcagcggcacccttcagtttcatgtcaacctgaagaaagatttccagcaactatcagagacttgctctcacctgcatcttgctctgttttgatcaatgcctgaatccaggcattgccaacaggaacaggaaagtatggtgaagatattgggggatataatcagaatgtagatgtcttttgacaggcttagatttcctccatcaagaagagattaaacagggccacaaatacactgcatcagttcctgacaatatagattgcgttccagcgtggcatatatgtgaaagtatgaaacaattgagcttactgtgtatcagtggtgtggtgtggccgccaaaatggtccatgtgatctgaggccacattaagagaaatggtgtcaagaatgaggaaggtgataggctgtcccttcttgttgcttgtcagatcgtgcttagcaggccatgttccaataaagtggaatgcacttgcaggcagacaacaggatagcggggccttgaagctatatagagaatagttgaaaaccatttttagcataaagaagagaagccctggggtaaatgctgtcttcgaatatctgaagccacacaagtggaattttaaaaaggtccctaaatagaccatgatggtctggaaattaccactttgtgctgaccactccgtaccttatcttcagcccaggttgctctctgagtgccagatctgttcattcaactctactcagatgtcccgcaggcacctcagtccttcctccagagctctaggaggcatccttaagtcctcctcctctttctcccccgaatcccttttgtcacttttacccgctaaatatttctctagtctgctcctccttctcttttgccttgtcttctgcagtggcctcttaactaacttcacgaatttcatcttcatatacataatgatctttctaaaacacagacctcatcatgtcattcccctgcttaaagcccttcaaagcctctctgttgcctgcagaattaactttgaatgctttaatatggcatctgtggcctttcacaaccaggtcctgggctccctctccatcttcaattcctgccactactccttcactccccgggaggttttttgatgcacgtttctcttgcacaataggctggtttatgcctctgtgcctctgctcatgctgatccttctgtctcatactcctttcctctctccttgactcatttttttttttttttttttgagatggagtctcacactctgtcacccaggctggagtgcagtggtgataccatggtgcactgcagcttctacctcctaggctcaagtgatcctctcgcctcagcctccctagtagctgagactacaggtgtgcaccaccacgcccactaatttttctattttttgcagagacagggtttcaccatgttgttcaggctggtcttgaactattgggttcaagtgatctgcccaccttggcctcccaaagtgctggaattacaggtgtgagccaccgtgcccagttgcctcatctaattcttgtttttcaaaataaagctgcagaaacccttgtcttatctttaggctaggttagaaatcagtgtgaggtgtttttttttaatcataccctgcacttgctccaagcattcatggcacacacaattgaaacactttccccgggtttccatgtcttatccctgtctgtatccccagtgcctgccatagtgccaggcacacattaggtgccaagactaagcaagtcttgacctgacctgaccactgagggaaaactggccatgtctctgtttgcccccgaccccagctgcattccccagcgtgcttctctgatattgccctaaaagctcttccttggatataatgagcatcctggattctttttctgacataacctccaaggtgttatctttacctgccttcctacttccaacacaccatgaaattcaggagacccctggaccctggacacctacccttcagcagatctttctttctttctacacatggaatatttctaagcagcatcaagtgctttcagttgaggcattctgggtccccaaggctatttgccctggaagaagggggctgttgacactcactgaatctctgcaggttttgtcatatgagtctaggtggctgttatcaccaaggcagcagtgtgtgtatgtgtgtgcccctctaacttctctgctgcagtgaaaatccctacagtgtagacactgaggctgcctacgttgggctgtccgtatttcttaagggcactaggtgaccttcaagttgaatgcatactggatccacacacccacaacatgagagaccctctctgaaagtctgtctctgtgttgccttctctctatccatgttggggtaggggtggtgcttatgaaacattgattgtgtcattaaccctggtggttgggatgtatttgctctgaaaggctaggaacaatgtttaggaaggagagctgcagacttccactgtggtgcactcttaatatttaccagaagatgtcactgtaggcttaaaccaatacaagaagttagggcaagaagacttccagctaagcatgaaggtgactccattttggggggttagaacaccgagcagcccccattacaatgcatgcctggaaaagctggttgaaaggttaatccaaatgtgtcacagaccttaataaatttctttttttttttttccaaataatcagactaattgccactaaactgttgcctcagggctagcataaaggctcaataagtatgcactgaatggatgagtactaaagctaggagtggaaggagggaacccagggctttagtagtcatctttgttggtaaaggctactggagaacaaaagctgctactctttagcagtggcttctcatagagatgaattttagtggcaccaacaagatcaggtcctagggaaagtagtgagacaagtgaaagtgctcttggccccttttccatcctcactcccagatgcttctcctgtgcccaatgcttgtttcttcctgaaaaaatatataaagtgatttattttaagaaaaaccttcctgtgattttttgcaaggcacttagaagattatccagagtttttatgtcatgaggcatgtccctagctctctccttcctcttccccaggatagttcatcaagtaagcagttaaagaagttactgagattctgctttatgccagggatgaaggccaatgtacaaagctggaatggatgggatgagggctatatagaagaataggacagagcccctgtccttgaaaacatagtttaagtggaaatataaacaattaattgtaattcagtatcacacatttttgggggaggcagtggggtggaggggtagggtctcactctattgctcaggctgaaatgcagtggcacaaccacagctcactgcaacctccgtctcctgggttcaagtgattctcgtgcctcagcctcctgagtagctaggattacgggagcgcacaaccacacctggctaatttttgtatttttaacagatggggtttcaccgtgttgtccaggctggtctcaaactccttacctcaagcaacccacccacctcagcctcccaaactgctgggattacaggcatgagccaccgtgcccagccccagtatcacaaatattttaacaaaggctaagtatagaagtgctatggcaacacagaggaagaaatgataactggcaacacagagtggggtacattttttcacaaaagagatggtacttgaactggtattgaaggatgagtagaattttccagccaaagagggaagatcatggcaggcagagcaagcaccatgtacaggatagaggcataggagatagatttcaggatgcctgaggtgatggaagccccagttgggagaaacgtttcctcaatgaacatcagccaatattcagttaagcaggtggctgagcaggttccctgtggctcctcatgtatgtgtagagaacaaccactccctcagatgggaatgaatatttcagaaaagttgcaagccattctccgggtttcctttaagaagctaaatgctaatattcaatgtttattgttgctttctttccacaatatgcccttctgtggcctcgtccttcatcttctgtacctgagtggtaacccatttctcatgaaaagcacaatgacacggttctctccttaagtatgcctgattgtatcatggacttgatgtttctggggcgtgtgcctaccatgtatggtgtgagtgtgttaacatgtggtttaaatgtttgctagtctgctatttgagcaaagaactttgtttgaagccctaaagagaagacagccatacagcaaagcctccacacttgctgacatccacgtgcccttttagtagataaggaaaagggacattttgaagctgctgatagagttaagtttcctatcctgggaatattatcataggagcaaaggtggaaaccaaggtagtagcttgcatacatgccattggcagctaccatgtctatttcagtcagtgactaaccacagcgtttattgctggaggccctgggctactctgcctatctctacattccacttccataatgtatgagccataatatgacaacagccagaatcaagagtatcatatcatacactcttttaatgagttttttaaaaacaaaaagatatgcagattagactggatattagaaaaaatgctattgcatatttaataagattcgaatttgaacccacttgtcaactccatttcactccaataaagtatgtgcttccaatgagtctccatttcatgatcactaaatggtttagagtggggggcatgaaataaagtggttgcctagttagccaatggtgtcattgggaagattttgtctttggttagagagggagaaaaagaggggaagggggaacgaacgggagtgaagcatgacaaggtcaatgtctggaatctaaccttttcatacctgttttagctgaagtatcagcaaattggttgaaaaaattagctatctctaggctagtgagactcagagaggggactgcagtacagtttacaggacaaatgccatcagatccctgtcatttttgctttgccttcctttttagccagtgaacaccacatatgccatgtacctccatgactccacttatttcgcccatatctctgactgttggtttttgtgcttcatccataggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaatta

SEQ ID NO: 5041 - DNA, 329093 bp, human
atggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcgggacccgggcctaggcgggcggagggctgggaggcgcggctggcccaagccggggacctagcgcgcaccctgacgcccgggcgtttgcaccccggctgggcaggtgctgggcgcccagtagcgcacgttcgccgcgctgtggcggccacagaaaggctttccgctccggccccggactgaccgtctgtctgtccgcagggtggcctgcgtgatggttggcagagcgtgcgggggaggcggccgagcggccggaacggggccgctgggacggggcatcgtactcagtctccgcactggagagccctaaagagccgcgctctccgtgcagcgtctctggatccctgctttcttctactctgcacccgggttccgaagtctcctttcagcgctctcttcctcctttcggcgcccgcattcttccctccccccgctttcccccctatttcgtctatttgccttgttctccctctttctctcttgtgtcctagatgttgtctgctcctgtttgctcgctgtttccttctttccattcccctctctcgcttttattctttttctctcttaccctttctgtttttctcttcttgccggacttttatcacctcgctccttccccgctctggctctggtcttcccgggcgactgggtgtccctctgtcgctattttccgacatccaaggagagctcatggttcccaggcttgcttatcactactggctgcatgagaggcatccgtggctctttgggagtggcggggggcaccccgcggaccgaagggcgggctgggatggtgccctggaccccatgtggggttcagtcaccaggagcctctcctgatttacaaaaaatatttaaaaagcttgagccccagcatggggcgctgccagcccatgttctgtgagcctgggctgatgcggtaaaagctgatttattaatagtctgtagccagaagcaagggtattttcctccctccagacgcgatgtccagttgctagaggtcatgcagtactgtaaagtgggtggtggtggggtgggggaagtgagtgctatggggtgcagttagtccagccagggctactgtttcgcaagtctccttaaaacaaatctgggctgaagcagggagtccagggggtgcacaaggtgagtttcatggcctggaggcctctggatggggtctctgggccggcaaggacatgtctgtgtcccatccccatcccccgggtgcacttggtaccctggacaaggggatgctttgcaggtgactgttagaacgcaacaaccagtgtggatttttctgtccaactgcagcaaatagagccctagagccctctgactttcagattaccattgagatttaaggggaacatcaccccctggctctcctcttcactctctcttctctcagtttacactgtcctttctcaaatgctggaattgtgtcagaatctgccaaacttgtatttcctttccaatactaacaaattttttcttccaccccaagaaaaccttagccccaggacctcaatccattggtacaattgtgtaagtcattgtcacaacaatattctggtgtttaataagttcccaaacaatttggcaatattgaaaagaatttctcatactgacagaccttgtaggtgtattgagaggtggtaatatttaaaaagctcttctgggcaaaagtagaattccacagccatgactatagcagagaagtgaaaacaaggtcttggtcaccatgaaagccatggccttgtctggagttccatggggcacatgtgcctttactgatccttttgaacatgtaggtcagagtatgatgtctataaacacacattattaatgtggtctagattatctgtttggtggctactgtcctctggcagattccttcccgcattctccagaagataaccagaacccctcaaagcctcttggattgtcccaaattgaagcaaaattatttgaaatgacataggattttcttggttattaaaagggtgatactacagtagcatctagtctaatcaaagagcaaccatgttctaaaaagtcacagttactggattttacggtgtttgcaaaaatgaaataaaacttgctagagaaatgcattgctacctcaagggcacctttttatttcattcattcctgcccacctccagaaatattcactttgaagaatagggatagcctaggggttccagaatttctctggatgttgacagatcccctaggaggttgcaggaccagttctgtgagttctgataatctgtaagagctaaggtgtgcatgtgtgtgtgagaatgagagagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctttaaaaaaaatcagaaattggatttcatccatctgtctgccagtatgttgtttgcagtcactcagggtcctgctcattttagaatttctgagaccatttttgaaagtgtatccaaacattgttgctcacaagctgttaaaagtcccaaattctgcaggcttttcttaggccaaatttcctctgtttgtagccaactctagtgtgccatttgttctgtagagggaattcagaactgggcccaaagaaatagcactagcccccttcttcatcactaagtatcatgctggccagcatgcacagaatggggttgagaggtcagggtccatggctatacaagtcaaagaatctgatcatattcatgttgtaccctagacttttagcatctctaaaattttcagtttggatgagtgattgggccgggggtaccacacccattgggagaagaacagatttctacatccctgaggtgttttattcaccaggggtaggtcttgtggctagattgcagaggggcctttcattgccatattgggaatccctgcaaagctgagcaggatgggagcaggctgaggcatctggaagagtaattaattatcatctcaaatccagtagcatatcattgatgggaaaggactaaaaagtgtttgtttagatggagaaaagctttttttggtcattctatttttttttaattgtgggaaaagctttcttttattcccatttgtttttaaaaggtggctctattttgaaagagctgtaactatagagtgtgtgtacctgatcatgcctcacaagcccacgctttccctctttcttctccttgattttgcagtgaggcaaaatgacacaacaggcttgtgatataggctgaggcattaagcagaatggactgttacagccagtggtcagtactggtcgtgtggttcatcaggctctaagctgttgggctcagttttacttagctgaggatacatttcttcagctgtctttgagagctgtggtaccatcttagctatttcatagaagagggggagaaatctaccattacaatatctgtagaattccagtagtattaattagcatctttgcatggatgtcgaacatggtgttggagtccttacaaagctgtaagttctcaggtagtacaaaaggctattcagaattaacatcacttaataataattttagatcagtgctatggggcaattaaaatgctagagcttgtctttcatggatatcagtcatcaactgaggtagtatgtaatgacattaaaagaatagccatccgtttttttctgtcattcattaagcaagattttgtgaaactgttcattatattccagggaagagacatcattctctgtctcacagagcttatggtagaacagaacaatttagtactttagatatttaattaaaaaatggattttgtttgaaaacaatttgaaaatcaataatgtctttaaaatgtcatacatttaccagaatatacaaaaaatagacaaaagtccatctgttatgttgtagtttgggtctaatcggcaaagcagatggagtaactattatgtctctggcatggtgctagcagttgtggggagattagagccaagaagaaaccaaaaaagccaagataaccatcttcagcctcaagtccataaagattagcatgtgaagtgcaggactatgtcatgtagacaggtgctgggagaggaaatttagattttggacaggcccttttccttcccttggtctcagtgtcttatctataaaattggagatttaaatgacatgctttccagggccctttcctttctaaagtatgaggaacaggccagaaaaaggagacatccttttgagaaggcctctgggagtaggagagttgtattaagaagaaaggaggcattgtgggtgggcacggagtcctcatgaccttttgaggtccagcaacctcacctaggcaggtctggccagacccgaaaggttcatgcttggagtaataatggttagggaagtagatggggttaggctccactgtggaggacttgaatggcaatgaggaaccccagtaagtatgagaagctcttggatggaaagagtgcaaaaacaccatgaaagtaaataaaggtcggagtctaggtaaagctatctccctgatatctagtctggaatgtaggtggtaccagccaccaaaacagagaggttgagaaggggatctggttcgggctggagagtactaagaagtcatgactggttcctgttgcctagatttctagtggacaggacttataaggaggtgacaactggggctctggggcaggttagggctccatcgtacattatatgtgggaatctgtggacccagttaatctgaattcacaattggcgttgttatttaagtgatagctgcaattcacatatgggactcttagccaaggaaaaggatgtttgaataaaggaaaaaagatcaatagttatgattacataagaataagatatgcttatctgtcaaaaaaaagccaaaacgaaaaggtttcaaactggtaataatatgcacaattacaacagacacaaagttgaaatctttactgtacaaagaactctcacgagctgattagagaatcaaaggacatgaccagacaatttacaacataggacccccaactagtttgcagacatggaaaaactgttttatttcactggtactaaagaaatgcacatttaaacatagaatactttttttgcctctctaaccctgattaaaacaaacaaacaaacaaagcaaaacccaacatatatcaccaccaaacaaaaaaagtagacagtgctgacaagggcatggtaaatatcaaaattctcatacattgtcagtgggaatgtaacttgaatgatctttttggaaataaatagtgtaaacacagaatataaaaatatttatttctatgacccataatttcttttctgggattttgcagaaaaacatacttttatacatgctttcattcattcactcatttatttattgattcagcaaatatttattgagtatctggtatccctgtgctatgtgctggggttaccgggaagaaccaggtagatgtggtccctgccttcgtaggagtgggaaagatagacagaaaacaaattatcaattacttaaaattatatgaagtgccatgggggaaaagtacaggatgctatgagaacacatactaggagactaactggagttatcataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagagaaaaagagatagaaaattatggacccagtacgactacaattatattaaagaaaaaaagatagcgagcgagcgagcgagagaaatcatctcctacccctcccaaatctaagcataaaagacagagactggaagaaaaaaataatagaatataaatagatctattagtgatttattttcttattctgcttttctgaaggttttgagttttctttgagtctacattacttatataataacaataagcattaacaatttttaaaataatgttttactaagctgtgattaattgcacacaggtctacttttttggttcctggctggttatttcattagcctcttgatatcctgggagcctttaatgaggagagtagcctcagccctaataaaccctcaccctgaaaggcagaggtgatgagtcagacattggctgctgattttcgataactgacttttatcatattcccacacaatgcatggaactctttttataccagtatggtatagagctacttgagtgaattgctattgtttctttctcatttataaattataaattttaatttataaattatatggaacaggaagttaatagtggtacacagttggaaatataaagcttattctgctcagccagagccatccgagatagtctggactttggatctccatgagcttctttcttagtgagttgacaccagggctgatggtctggctggaagagttaaaatcttggggttggtaaagggctatagttctaaacatccataactgggagcttagatcagttagtgtatgtgttgctctcgtccagcagaaaaggagagttcactttgctaagcagcgccccctagagaagtttcactgcataagagtattacccccagttaaccataaataaagttgattagaaatgtcattgtccaactattccaatatctgagggaccactctatgcacatatagtgaggtgcataatcttattgttgaaactccactgaaactacaccgtaggtacaagttgttttgacagtgtaaagaatgtccctcacagttgaaaagctaatattaacattctgtgacacatgaaatgaggtatttagtcactgagtttaaaaagagatgtatggatgggaatttccccctttccattaaaggataatgaataatccacttaatggcgtatgtcctctaaaacagtgtccttgtaagcttagataaatatttgtctaaactttagtaaaatatttattggcaaaagagcttttctcatttactaggtattgaactttgcagattattcagttggtcttattgcatcccatttgttatttctgccattttgcctctaaaaactgtgctgaagactttgacacatttcagagcattacactaaataaatctgtcttgcacattccactgtgctttttctggaatattataaatattcaaatataggcacacacgccgattcaaaatacaatttaatacatgcaaattgtgcataaattccatatttataacttggcaatagtttcgaacttgttatcctatgatataaatgtatcaaataggagctcatgggaattatcaataaatgtatttttctgattaaactgtgggctctttttcagtcacaatttaagcttcaattctgagttatattataagagaataatttgcacttcatttactctgaattgtcaagaatcttgttcttccccaatgtaagtgtctgcaaagaggacttcttattcagtttgattgctttttaaattttactagtggagatgccctagtgagtctgagagaattggtctgtttcttatgaagagtttagttctaatgagttgcttccatgcactgttctgtgcgaatacagagcaattgaaatgtgcggtgtattgatttacctcaaatggattaggcctgtgtgcaccattccttgcattaattgactttctcccataactgtactaataactgcaaatcttcagtatagtattagcttcaatttactcataaagatccttgggtttttgctaacttactacaggagagtcaatgcaagcaagagtatttagaaattgactagggggaccaagttacatcatacaacccagaaatacttttaaagggctctttgatcatggcagccaactcttcagttattacaataaataggagttgactaaactcaccagttaagacctagattatcacaatggatgaaaataaaaaatccagctatatgctgtgtataagagacaaaggtaaaacataagaacataaagcacacaaaaaggattggaataggtacactatgcaaacactagccagaagtaaactgatgtggctatgttgatatcagacaaaacagactttaaggtagaaccattattgggcataaacagatcactgtgtaatgattaacagttcagtttttttttcagataacaattctaaacttgcatatgcttaataccataagtttgaaacgtataaagcaaaagttggcagagctaaaagcagaaattataaaatctgattttttttcagaaattgataggtaaaatgaacaaaaaatgaataaggatacagaggatttgaacaacatgattaacaaactcaatataatgggtatatatatatacacacacacatatacatatacatctaaaatacacacatacacacacatacacgcacacacacacacatatatatatataaaatctgcacccaattggaagaatacacacacaagtgcatatgaaacacttttgaaaatagaccatatactgagccctaaaattactcttgaaaaacttcagtgaatgaattatcttgtagaccatactatctgatcatatgcagtgcttagacattgggtgttgtgttaaacctgagtgcgtgtgaaggaacgttagtagtttgctatatttgtaagtattaccaatccttcaccgaccacataacatttcttaattgacatacaaaagtgaagaactccaagacttaggtagtttgacccaggtaacttggccttattttccaagaagatctattactattttggggtacctattgagacaggtcctgtgcaaggagcatattatatattttctcatttaattctcacgacaaccctctgaggtagattttttaatatatactttaagttctagggtacatgtgcacaacgtgcaggtttattacatatgtatacatgtgccatgttggtgtgctgcacccattaactcatcatttacattaggtacatctcctaatgctatccctcccgcctcccctcaccccatgacaggccccagtgtgtgatgttccccaccctgtgtccaagtgttgtcattgttcaattcccacctatgaatgagaacatgcggtgtttggttttctgtccttgggatagtttgctgagaatgatggtttccagcttcatccatgttcctacaaaggacatgaactcatcctttttatggctgcatagtattccatggcatatatgtgccaaattttcttagtccagtctatcaatgatggacatttgggttggttccaagactttgctattgtgaatagtgtcacaataaatgtgtgcatgtgtctttatagcagcatgatttataatcctttgggtatatacccagtaatgggatggctgggtcaaacggtatttctagttctagatccttgaggaatcaccacactgtcttccacaatggttgaactagtttacagacccaccaacagtgtaaaagtgttcctatttctccacatcctctccaacacctgttgtttcctgaaattttaatgatcgccattctaactggtgtgagatggtatctcattgtggttttgatttgcatttctctgaaggccagtgacgatgagcattttttcatttcttttttaattattacactttaagtgctagggtacatgtgcacaacgtgcaggtttgttacatatgtatacatgtgccatgttggtgtgctgcacccattaactcatcatttacattaggtatatctcctaatgctatccctcccccctccccccaccccacaacaatccccagtgtgtgatgccccccttcctgtgtccaagtgttcttgttgttcaattaccacctatgagtgatgtgatgtttggttttttgtccttgggatactttgctgagaatgatggtttccagcttcatccatgtccctgcaaaggacatgaactcatcattttttatggctgcatagtattccatggtgtatatgtgccacattttcttaatccagtctgtcatcattggacatttgggttggttccaggtctttgctattgtgactaatgccgcaataaatatatgtgtgcatgtgtctttatggcagcatgatttataatcctttgggtatatacccagtaatgggatggctgcgtcaaatggtatttctagttctagatccctgaggaatcgccacactgacttccacaatggttgaaccagtttacagtcccagcaacagtgtaaaagtgttcctgtttctccacatcctctccagcacctgttgtttcttgactttttaatgatcgccattctaactggtgtgagatggtatctcattgtggttttgatttgcatttctctgatggccagtgatgatgagcattttttcatgtgtcttttggctgcataaatgtcttcttttaagaagtgcctgttcatatcctttgcccacttgttgatgggtttgtttgtttttttcttgtaaatctgtttgagttctttgtagattctggatattagccctttgtcagatggctagattgcaaaaattttcccccattctgtaggttgcctgttcactctgatggtagtttcttttgctgtgcagacgctcttgagtttaattagatatcatttgtgaattttggcttttgttgtcattgcttttggtgttttagacatgaagtccttgcccatgcctatgtcctgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggcagcagtaccatgctgttttggttactgtagccttgtagtatagtttgaagtcaggtagcgtgatgcctccagctttgttcttttggcttaggattgacttggcaatgtgagctcttttttggttccatatgaactttaaagtagttttttccaattctgtgaagaaagtcattggtagcttgatggggatggcattgaatctataaattaccttgggcagtacggccgttttcacaatattgattcttcctatccatgagcatggaatgttcttccatttgtttgtgtcctcttgtttcatcgagcagtggtttgtagttctccttgaagaggtccttcacttcccttgtaagttggattcctaggtattttattctctttgaggcagttgtgaatgggagttcactcatgatttggctctctgtatgttattggtgtataagaatgcttgtgatttttgcacattgattttgtatcctgagactttgctgaagttgcttatcagcttaaggaggttttgggctgagacgatggggttttctagatatatagtcatgtcatctgcaaacagggacaatttgacttcctcttttcccaattgaataccctttatttccttctcctgcctgattgccctggccagaacttccaacactatgttgaataggagtggtgagagagggcatccctgtcttgtgccagttttcaaagggaatgcttccagtttttgcccattcagtatgattttggctgtgggtttgtcataaatagctgttattattttgagatacgtcccatcaatacctaatttattgagagtttttagcatgaagggctattgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgaggatttttgcatcaatgttcatcatggatattggtctaaatttcgctttttttgtgtgtctctgccaggctttggtatcaggatgatgctggcctcataaaatgagttagggaggattccctctttttctattgattggaatagtttcagaaggaatggtaccagctcctctttgtacgtctgaggtagatgttttaaaaccccatttaaagatgagaaaacagaactggacaagatacataacctcctaaatcttcacagctacacagtattggagctggcatttaaaatcaactgggatatttggcctgtctggtatattttaatgtctactaaattctcagacaaatctccaaaaacctttttcttttctgtggctaagtctatacaagctaagtggaatggagacctgaagtaactatctggagataccaagatccaacatattagcttgtttttaaaaaaacaccttttaaaaatttaataaaagtcactctttcaaggtgaactctgcagctcttttttcccgtcttaaagatttagatgccgaagttatttcaaatactttttacattgaagatttacacataagtatgatgttttaatggaaatgaaaaaaggcgctagagaaaagattcaggttttcttttttcaaataagaaaaatgaggaccttaactgtattttaatttctacccccttgtagactgcatttttggtacatacactatgcaaaatttgtaagaggccaaagaatcttgctccttttagaatgttggcatttgtctcattagcagttagttgcattgctttgaccaattgtgacctgtttctataaatgaccattgctttttgctgcatttggtaagtgtagacacagcctttggagggtaatataaatgagttcaggcagggcatctcttgtaatctgggaacagaggagccagtgaaataaagatgctttctttcaaaaaccaagggaggagtcctagatgaaatgaatcctgaaggctattcttattttgggggctcatcatgaagataataagaatccattttgttgctgaaataaccaaataagagtggcacattcccataggagtgaccattctcttccttttggaaggggcagctttagaaaagtgccattatgcaaagctgaaggccataaaaaagtgccattaaagagaatgcaaattagcatgggcctaccagcctggcaggcattattaatgttggaggtaaagaaattaggttgaaggtatggaagaaccataaaaaaacaaccagaggccagtgtgacattgggctgatggccacttaagctgatgcctcatggctgagactttgctaagtggaagattaactgacaaaacagcttgaaggttgacgaactatttgagctcattgccagatactctagaggcaaaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcgaccacaaaattcagctcttctgatttgctaggatctgactccaggatgcagtactttctggttaacagagggggctcttgtatgcagtaaacctcccaagatggagagatgtggtatcagctattttcattatagccatcttaggagtgtgaagttgtatctcattgtggtattgatttgcatttttctgatggctaatgatgttaaacattttttcatgtgcctattgcccatttgagtatcttctctggagaaatatctatacaggttgtttgacattcttaattgtgttatttctttttctttttaatattaattggttttttttaaacatattctaggttcaagtctcttataagatatacgctttgcaaacattttacccccattcagtggttgttgcttcactttcttgaaggtacccattgaagcaggaaagttttaaattttggtgaagtccaatttaatttttttctttgtcacttctgaaggctttgcctagtgttcacaaaaatttactcctatatctgcttttaagagttttatagtttaaccttttacagtaaggtcaatgatctatttcaggttaatttttgtgcatattgtgaaaaaggagacacacccataagattggtataactttatccttttttatttaggtaatatttgtcccagaatcctttgttgaagactgtttttctttattcattttccttggtaccattatacaaaaccggttgatcataaatgtttggatttatttctggattctattttacttgtctataaagctatctttaatcaagtgacacacagtcttgactactgttgctttgtagctagttttgaaagcaggaagtgcgaatcttttatttattttttctttctctagattgttttggctattcttggcaccttgaatttcattgtgaattttagcatcagcttatcaatatccacaaagaagccggctgggatttttttagggattgtattaaatctgtagatcaattttggggagtattgccatatggacaatattgtttttcaattcaaaaacatgggctatttttccatttgtttaggtcttctttaaattctttcagtgctaattttgaagcctttagattgtaagttttgaatttattttgttaaatttatttaaaagtattttactcttttgatattattgtaaattgaatttttttcatttttggattgttcattgctactatataaaaagatagttttttttgtttgtttgttttgcaacggagtctctgtcggccaggctggagtgcggtggtgcaatctcggctcactgcaacctctgccccccatgttcaagcaattctcctgcctcagcctcctgagtagctgggattacaggtgcacgccaccatgcccggctaatttttgtatttttagtagagatggggtttcaccatgttggccagtctggtctcaaactcctgacctcaagtcatctgcccgccttggcctcccagagtgctgggattacaggcatgagccactgtgcccggccagttaatttttaaatattgatcttgtatgctgcagccttgctgaattcatttttaagttctaatagtttttcagagtatccctcaagattttctgtatacaaatgatagagtttggatgtgtgttccccacaatctcatgttgaaatgtaatccctaatgttggaggtggggcctggtgggaggtgtttggattatgggagcagatctctcatgaaaggctcagtgccctccctgtgataatgaggtcacatgacatctgtttgcttaaaagagtctagcacttccacctctctctcttgctccctctcttgccatgtgacacactggcttcccttcaccttccaccatgattctaagcttcctgaggcccttgccagaagcagaagccaacactatgctagctgtacagcctgcagaactgtaagccagataaacttcttttttatgttacccagtctcagacattcctttatagcaacacaaatggactaatacaacatgcttatgctatctgtaaatagacactttaatttcttactattcagtgttgatgaattttatttccttttcctgccttacttccttggctaaaatctccagtaaaatgtgaactggaagtggctataatgaacttctttatcttgtttttgatctcaggggaaagcattcagtctttcattattattattattattattatttgagacaaggtctcactgtcattcaggttgggatgcagtggcatgatcacagctcactgcaccctcaacctcctggggcttgaggaaacctcccacctcagccttccaagtaggaagaactataggcaaggatcactatgcctgactaatttttaaattctgtgtagagatggggtcttgctatgttgcccaggctggtcttggactcctgggctcaagtggtgtactgcctcagtctcccaaagtgttgggataacaggtgtgagccactgttctctgcccagtctatcactattaaatatgtgagctctaggtgtcttttatcagattgaggaagttctcttattcctagtttgatgagtgtttctttaaaaaaaaaacaatgaatggatattggattttgtcatgattattctgcatctcttgagataattgtgtttttttctctttattttttatttatttgtttttttttttttgagacagggtttccctttgttgcccagggtggagtgcagtggcatgatcatggctcactgaagcttcaacttcctgggctcaagcaatccccccacctcagcctcttgaatagctgggactacaggtgtgcatcactattcccagataattttattttttattgtagagatggggtctcactatgttgtccaggctggtctcaaactcctgcgctcaggaggtcctcctgccttggcctcctacatgctgggattacaggtgtgagtcaccacaccctacctctttattctattgatatagtgttttacattaatttactcacaggtagtaagccaacctcgcattctcttgacaaatcctacttagtcatggtgcataatctttttttatatattgctggattgcttagattttcttctagtattttcatagtttcaggtcttaggtttaagtctttaatcttgagttgatttttgcacatgatgagggctaagggtccagttttattcttctgcatgtggctatcaaattttcccagcacaagttattgaagagggtgcccttttcccaatatatattcttagtgcctttgttgaaaatcagttagatgtaaatacacagattttttttctgggttctctactctgttccattggtctatgtatctgtttttacagcaatgtcatgttgttgtggttactataactttctagtataatttgaagtcatgtagtgtcttgcctccagcgttgtcctttttgctcagtattgcttcggctgttcagggtcttctgtagtttcatacaaatttcagaatttgttttttctatttctatgaagaatgttattggtattttgacagggattgcattgaatctgtagattgctttgggtagtgtggacattttaacaatattaattctttcaatctatgagcatgtgatgtctttccttttttgtgtcttcttcaatttcttcagagttttattgtttttattttacttccttgattaaatttattccttgttattttatttttttgtagctgctataaatggaattactttcttgatttccttttcagctagtttgttaatggtgtatcaaaacactgttgacttttgtatgttgatttttgtgtcctgcaactttactaaattcattaaatagttctaagatatttttgatggagtttttagggttttctatatataagacaatgtcatctgcaaacagagacaatttgactttctctttttcaatttggatgcattttctttcttttttttttttctttctcaacttttattttaggttcaagtgtacatgcgcaggtttgttagatgggtaaattgcatgtcactggggtttggtgtacaaatgatttcatgacccaggtagtgggcatagtatctgacaagtagtttttcaaccctcatcctcctcccagtctccaccctcaagtaggccctggtttctattgttcctctctttgtatctaagtgtactcagtgtttagctctcacttataagtaaggacatgcaatatttggttttctgttcctgtgttaatttgcttagaataaatggcctccagctgtatctatattcataggagacattggtctatagttttcctgtgatgtctttgtctgaatttggtattagagtaacactagtctcacagaatgtgttgagagatattttctccttttctatttttttaaagagtttgtgaaagcttggtgttaattctttttaaatttttggtgtaattcactagagaaacatatgggcctgggcttttctctgtggtaagttaaaattatttatttgatcactttactttttatagttcaattgagttttttatttctttgtgagttaatttcagtagtttattgtctttctggtaacttgtgtgttctttccaagttatccagtttattggcatgcagctgttcatagcattaccttataattcaatttattgttaaaggatagtattaatgtcccctctttcattcctgattttaataattgagtcttttctctttttgttcagtataagttctgtttatcaattttgttgatctcttcaaagaatccatttttgttttcatggaatttattattctttttcaactctcaattccctagaatctataatatttcttttcttctgcttgctttatgtttagtgtgttcttcccttttcagtatcttatgatataaagttatattagtgatttgaaaattttcaaattatagttgtaaatgcctatattttcaaaaagaaaatatttcaaatcgcttcatcccataagctttgatatgttttgtttcatcccataggttttggtatgtttggtttcattttcatttgtatcaaacaattttctgatttcctttgtgattttttccttgacttattggttattttgcagtgtgatgtttaatttttcacgtttgtcaatttcccaaatttccttctgtaaatgatttataatttcattccactgtgattggagaacatacattgtatgattcaactattttaaatatattgagacttcatgaccagtctgggcaacatggcgaaactctatttctaccaaaaatacaaaaaattagctgactgtggtggtgcacacctgcagtcccagctactctggaggctgaggtgggaggatcacttgagtcctgggaggtggaggttgcagtgagctgagattgtgccactgcactgaagcctaggtgacagagtaagaccctagctggaaaaaaaaatatgttgagacacatcttgtggcctaacatatgctctatcctggagaatgtctgtgtgcatctgagaagactattttgctgttggtggtggagtgttctatagatgttgctaaaacttggtagtttattgtgctgtttagacttctatttctccattgatctttttctagttgttccaccattatttaaattgggataatgaagtctccaattattattattgaattatctgtttttccctttggtcctgtcagtttttacttcatgtgttttagggatctgttgttagctgcatatatatttataattgttttgttttcttgatgcattgtttctttatcattataaaacttctttctttagtaattttgtaatatttattttctctgatattagtatagccattccatatttcttgtggttcttgtttccatgatatcttttctcttctttttcctctccaatgatttctatctttttctatctataatgtgtgtttcttgtagacagcaaatagctggatcttgtttggtttttatttcattctggcagtctgtgccttttgattggattgtttcatccatctacatttaacaatattaatgatatagcttgatccatcttattttgattttccatatatctcatgtcttttttgttcccctattgctcctgtactgctttgtcttatattaagttaatgctttccagtgtaacattttaattcccttaatgattttctactgtattttgttgttattttctcaatgtattctctagggcttaatctatgtatattaaattatcagaatctacttcatatttatagtaacttaattacaataagctctttaagtgttttcctagatagctctgtttcttcttctctctttttgtgctgttattgttataaattttacatctatacatgttacaaactcagcagcacattgttataattattacttaatgaaattttatgtcttctaaagaaggtaagagaagtgagagaacaagtatatttattgagtttcttataaaccaccttatgtaccattactggttctgtttgtttgtttctgtgcatttaagttaccattttgtatttcctcactccagtacagccttgctccaacacatttcttttggtttgttattgtcatatgttaaatgtatatattttatggtcccaacaatacaattatatacctatttttttattgcttttcaaagtttgttatgagaaaaggggagtaaatatgcatttatactgtattttgttattattacattattattttattattacattattatcttcaaatgagctgattttttctttcatgtggacttgaattaccacctggtcccacttgctttcagccggagaatttttctttattatttcttgtaatgcaggactgttagcatgagattgtctcatgctaacatgagatactttgttttctgtgaatgtctttatattgctttcggttttgaaaatacttttgctggatatacaattcttaattattggtttcttttcctaagcatgttgaatgccatcccactgcctttgtcctctattgtgtctgatgagaagttagctgtcagtgttattgaggttcctctgtgtgatgggtcacttttctcttactgcttttaagaatttctctttctctttttaacatttttagtatggtatgtctgtgttaggatctctttttggttatcctacttgcagttcattgagctacttgcacgtgtagattaatttttcttccagcttagagaaagtattagccattaagatttttttttcttttctgtttctttctctttctggtactcttccattaggtgtattctggtgtgctttttggtgtcccatatttctctgaggttctgtccatttttataccttctttctctctctgttttcagattgcgtaatgtctactgaaatatcttcaaggttgctgattatttatcctgccagctcaaattgtctgcggaagccttgtagtaatttttttttaaattgagacagaatctcgctctgtcacccaggctggagtgcactggtgcgatctcggctcactgcaacctccgtctcctgggttcaagcagttctcccacctcagcctcccgaatagctgggattacagacgcatgccaccatgcctggccaatttttgtatttttagtagagagggggtttcaccatgttggccaggctggtctccatactcctggcctcaagtgatctgcctacctaggccccccaaagtactgggattacaggtgtgagccactgcacccagcccttgcagtaaatttgtaatttcaattattcttttcaatttcagagtgttcattagtttcatttttataatgtctatattatataacatagacattatattatagaaaatatatatagaaaaatatattatatataaatatatattatagaatatagaatatatatagaatagaatatatattctattctaaatacagaaatatatagaaaaatattatatattatataatatagacataatatccttttatggatattatatatttaatgagacattgtcattataccttcctttacttctttaagtatggttttcattagtttcaacactatttctaaaggctactttgaattctttgttaagtctgacatctgggctctgtcacagatagatcccattgcttgcctttttctcttgtgtatgggtcacgcctttctacgtcttttcgtgtctcataatattttgttggaaactggaccttttgaaactctggataatgattctcctccaccttcactgggttgtgtatttgttgctgtttgcttatttattctgggacttgtctgaactattttactaaaacctatttctcccctgtgtgaatcctttgatgtcagagggctgtcttgggcatgtgcagagtcacagtgggataacagttttagcagggatttctttgggtctttccctgatatttctgttaaacagtctgtctctgttgttatcatgtctatctgttggactccactaattgttgggtgattgctgtattgtttttgacagtgtcctggggcatcaattgctccacagtctgatcagatttggacacttttgctggggtattttttttttttttttgaggtggagtcttgctctgtcacccaggctgaagtgcagtggcgcaatctcggttcactgcaagctccgcctcccgggttcacgccattctcctgcctcagcctcctgagtagctgggactacaggcgcccaccaccacgcccggctaattttttgtatttttagtagagacggggtttcactgtgttagccaggatggtctcgatctcctgaccttgtgatccgcccaccttcggctcccaaagtgctgggattacaggcgtgagccacctcgcctggccttgctggggtattttttgaggccagtctttgagatttgttctaaccccaaaagggctcttctttgctggttctttttctggttatctaatgttagctttcctatgatttagcttgtcactgttacacatcctcttaaatgcttaccaccaagatttccatttttttctcagaggacctttagggttttactttcccttatgctataataaaaagtcagttcctttggggagagctttggaactctctgttttatggcttgcctttctgttggtgtacagtgtctgagccattgctttggagttggaggcaaggacaggggtcttgtttctctcaaaatgacactgcttcttttctagctgggtattcatggagtcagtatcctctggtcttctcagtttgcctctcctgatatggagcttctttgctgatagcgagctacaccagtggtgactggggggtccagtgttgttgctctgctatgcctgaagtacagtctccatcctataactggagacattgttgaggaagggagcccctgtcttcttggccatgcttgcctggagtttagcctttgcaacaaagagctgatgttgatgagaattctggaggccttggtctcctggggagatacatagctcttgactgggagctaggaattgtgggtatctcctctttttgtccacacccacctgtactggtcctgctgtgtgaaggggagggagtagatcatggctcaagtgctacagactctccctctttctaccaaaggttagtagacttccttgaataaatctttccttatttgctatatgcattaagaacatttccagagacagtaaatggctgctttagaattttcaccggtatggttgttttactggggagaggcctgcagagctaagtcacaattttcttggttttaggtatgatggatgatttttttttattggctccaagacatattatacattatgttcagggatgctgggtcctatttaaatcttttattttagcaagcagtctccctgtttaggtttagcatataggtcttggcctactttttttgtctgtggttccactgtgagtttaattttcacagcatttgtgttgttatttaggtctcctctgtttatttagtattattggacttttcactggtctctcttagtgctgcctaaggaagccaaggactttccccaagccaagcccttgggtgtcttttggtgggggagggttgtattgagatcctcctaatagtattatccagcctggtgtctcaggtttggggaggaaattcttgggtccatggggactaacaggcctcttagacccatatacttgctgcagttgtctcttttggtagctcttccagcctgcctcaatgtctctggtcaggggaggagagtgtcaggccaatagggacaaagagcctttccagtggctgggcgcagtagctcatgcctgtaatcccaacactttgggaggccgaggtgggtggatcaccagaagtcaggagtttgagaccagcctggccagcatgacgaaaccctttctctacaaaattaaaatacaaaattagccaggcttggtggcacatgtctgtaatcccagctactgaggaggctgaagcatgagaatcacttgaacctggaaggtggaggttgcagtgagccgagatcatgccaatgcactctagcctggacgacagagcaaggctccatctaaaacaaaacaaaacaaaacaaaacaacaacaacaacaacgaaaaaagcaaagcgaaaaaaaaaagcttcccagaatgggctacttgccacaattgggtctcttttattggttctgcccacccaccttgatgcctctgggaaagggaagagagtcttaggctcatggggacaaaggagcatcctatatctagctgttaggtataactgagtccctttttcaatctccgtctgcttatcctgatgtctctgggggaagaggggtcttgagtcctcgggggacttcctgaaataagtctcctagctgtggttaggtcctgtttgcttaatttggttttgtggaccttttgcatatccttgttgtttttctctctagtttttctatcagttttccagagaggaggtcgaagtttctaactataactgtggatttgtctatttctccttttagttccatcagttttcactttatatattttgcatttctgttgtttgttacacacacatttagaatggctgtgtgttcttggttgattgacccttttatcattatgtaatgtccccctacattcttggtaattttgtgttccaaagtctactttatctaatattagtatagctacttattgctttattttaattgatgcctacatgatatatctttctatttttcagtgccttcttttgcttgttttatgtattatgtcaggctggagtacagtggctattcataggtctgatcacagctcactgcagcctcaaattactggcctcaagtgatccttccacctcagcctcccaagtaggtaggacggtaggctcacaccatggcacctggcttgtcatgtgtgttttctgtaaaatctagaattagttggaggaatagagagaaatgtgtatactctgtcttgtccagaaccagaaatctagttcacctatttctgttttcttgaatgatctgggttggctttttaagtctttgaggctccgtgttgcactcacctaattttagctcaataagatcatgttactgagtctactactctgtacatcaagggctgtagtggctcaattttttttttcaaagatcaaattttcaaagtccatatatttttatcaaatatgcccttagccttttgttgctttggttgcatctgtccctccactgcctttgtaggcatttggttttggagagttgcaatgatgtatgatctgcaaatctccatctgctgcctgccactgactcagcatgaatagaaacaaaaattgactataaactggttgacaccaagatagacctaataacatggcttatttgtatgaagttggactctgctattaattcattcagtatgaagtgcttactgtgtgccaggatctgtgttaggtcctggggttacagagctagcagtgccataggtactgattttggagagttcatagactactgagaggagacaatcaaatagggtattcggtgctatgataaaggtgagcacaggttgctgtgacaatagagaacaagggtactcaaattagggtaggctctgttgatggaagtgacacctgagttgagtccctgatatagtttggatatttgtctctgcccaaatctcatgttgaaatgtaatccacaataattggaggtggggcccggtgggaggtatttggatcatggaggcagatccctcatgaatgccttgggccatccacttggtgataagggagctctcactctgaattcacatgagatctggtcatttgaaagtgtgtggcagctgggcgaagtggcacatgcctgtaatcccagcattttgggaggctgaggtgggagtttgaggccagaagtttgagaccagcctgaccaacatggtgaaactccatctctactaaaactacaaaaattagccaagcatggtggtgtgtgcctgtaatcccagctacttgagaggctgaggcaggagaatcgcttgaacccaggaggtgcagtgagccaagattgccccactgcactccagcctgggcaacagagtgagactccgtctcaaaaaaaaaaaaaaaaagtgtgtggcaactactcttgaccactgtctctctcctcctcctgcttttgccatgtgacatgcctgctaccctttcaccttccaccatgattggaatcttcctgaggcctccccaaaagccaagcagatgctaacactctgtttcttgtgcagcctacagaaccatgagctaattaaacctcttttctttataaattacccagtctctggcatttctttctctttttcttttttcttttcttttcttttttttttttttttctgagacagggtttcactctatagcccaggctggagtgtaatgttgtgttctcttatcactgcaacccctgtctcccaggcacaagcgatcctcccctctcagcctccagagtagctggaactacaggcacatgcctggctaattttttgtatttttggtagacacggggttttgccatgttgctcgggctggtctcaaactcaagcatttctttatagcaatgcaagtatggtccaatgcagtccccaaggatccataaccagtcaaggattgggggaaaccttaggaagcagcatgagtaaagggagtttcaagaggaagtgttgcttgtacttatgggctagaatgagatctgtgacctcagaatttgatagaaaccaggacacctagagcccagtaggatatgcgacatattttggactttagtctgagagcagtgagaaggcattgggactttttaagtagaggagtcatttaatttgatttgtgtttttactgaattcctctggcttctgtgtgaaggggctggagagtggcaagaacatggcagtgagttagaaggctgcagggagcagcccagggagacagggttgtggcttggcttggggaagtgattgtggggatgcagagaggtgaatggattcaggaggtttaggaggaagaacagaaagaatgctgcgagtaaaagatatagatggtagggatgagagtgaggaagcaaggaagtttctgccaaggattctgccttgagaagactggagaagctgtgataagcagggcagtgggagagagtctttgtttacatgtggaatttggggagactgtggagtcgccatgttgagatgcccacgggcagtggatctgtggatgggggggctcagtactgcagacatagactgggagggttttttgtttgttcgttttgttttgtttttgagacggagtccccctccgtcacccaagctggagtgcattggtgcgatctcagtttactgcaacctccacctcctgggttcaagtgattctcctgcctcggcctcccgagtagctgggattacaggcacacaccaccatgcccagctaatttttctatttttagtagacataggttttctccatgttggccagactggtctagaactcctggcctcaagtgatccacccgccttggcctcccaaagtgctaggattataggtgtgagctactgcgctcagccagactgggagttttgaggtgctttgtctcatttatctcacttaaaataatttcaaaatatgttaaaaggaaatgttatttgcaatgcatagacaggttttcctcgctagttgctgaggataaaatccaaacaactggacctaaacagacaggattggaagaggctgttctggaccaaatgggatgctaaaccttagaatggattgacaagagaaggccatgcagaatggtgagaaggccctacttacctcagcccagcttcaaggccctaagtgagggatacctggaatgcctctgaagactggcatttggatgcccattccttcccattgcagttgccaagcccaagagcagtggagaacaactgtaccttcttgtcatgaagtgtgtacaccggaaaaaagtaaatgcttgtattttctttttcctctctttcttttctatatacagctctccaaaaacgcagatttctctagatcacagttgttcgtggagaagtgagagtgacaattttagagtaaaaaatttaatattgtgggaattatctctaaccagtcaaattactaatgaagatatttattcttgggaatctagaatcagctatttaagctttctaggatctggagtcacacagacttgagttcacatgatggctctttcacttaccaatcatgagactttgggttaatcactgcatctacttctgaccttcagtttcctcatttgtaaaaggagaatgctacctcatgggactgttttgaggcccaaatactgtatgtaagtgagagggctttataacgtataagttgctctttaaatgttatttaatcattatttagcttctggtttcattctattaataacattttaaagtgttattagaaaaattgtaagattcttgctaatattaaaatatgttgctttatttaaaagtaactcctaattcatgcccacctaataataaagaatatcattaggtggctgtaaacaaaaaaatcaaacagttctttctttcctctatacactcacacacttctggtcatcaaaatgtgtgaatttttccgacagagaccaatactccgacactagctgggtgtcttacaattcaattcagttctgaaactaaccagcattagtgcaggccccatagattaagagctcagtcccacaagtctgccccctccccttcagacatctatctcaagtcccaggttgtcacctgtacttctggctgtaaatcaaggtttccacgaccccctccttgggtttgacaatttgctaggacagctcacagaactcaaggaacacttgcttacatttactggtttattatttaagaaaggatacaataaaggatacagatgaacagccagatgccaaggtacataaggaaaggtatgtggggagggatgcagagcctcttgtcacctccatgtgttcaccaatatggaagcattctaaaccctgtctttttggggttttgtggaggcttcattaggcaggactgattaaatcatttgtcattggtaataattcagtctctctttttatcttttgttttgagacagggtctcaccctatcacctaggctggagtgcagtggcgcgatcacagctcactgcaacgtctgcctcctgggttcaagtaatcgtcccacttccacctcctgagtagctgggaccacaggcgcacggtctcactttcttttccaggctggtctcgaactcccaggctcaagcaatcctcccacctcagcctcctgagtcactgggactgctggcacacaccacgacacacggctaatttttgtttttcctagaggcggcatttcgccatgttgcccaggctggtctggagctcctgagctcaagcgatctgcctacctcagcctcccacaaagtcctgggattatggacgtaagccaccatgccccgtcaacaactcaatcttaaacccctctccctttcctagaggtggtggggctggtctggctgaaagtttcaaccctctaatcacatggttggttcccttggcaaccagccttcatcctgaggctatccaggagcccccagccatcagtcattcattagcacacaaaacatctatcacttcagagattccaacagtttttggaggaatgaaaatcaaaatatatatttcttattataaatcacaataccacagtgattattggtatgtatgcttttaattttaggctaagcgaggattgattctattcaatttttccctcaggcttataggaacacatttaagggcatctgttgatgactcattaactgtttcaaacctaaaatgtgtcaaatgctgtgactttgcaactattgttgctcttccctttagcacgaaatactttaatgatctcaagacatttatattatcagatttttgcatatattcactaaaatttggttttattaatggtctcgatgtgtcccataaatattcctggtttccaacttgagctggatttattaggaagaggcaaaatttagcttatgtgccatacctgaaggaagttacgtatcgtagcttgtgatgctgtgggacagctaaagaacaagcctttacctggtgacagattttaactggggaatagttattgtaaaaaatattttcattttttttagactacaagatatgcgggctagcattggatgcttgaaaggaaaattacatttttgctgaaatccaggcaatgcaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaaaataaaatgctgagacctaccccccaaccatctaaatggacttcctcctcgaccaaggcactcttaaaatttaacttgaaagactggttcaagtcatgacaggttgtggcagtgggacatgcctcatgattacctctctggcattaacatcaacacagaccttaagtctgataagaagcatttacaatctgttctcttggaatcttcctacctggagacttcctctgcacaataagaactttggtcttcataatcctttatcttaacccaaacatttcctttctattgatcctaggcctttatttagataaactcaaccagttgtcaaccagaatttttttttttttttttttttttgagacagagtccagctccgtcacccagactggagtgccctactgcaatcttggctcactgcaacctatgcctcccaggctcaagcgattctcatgtctcagcgtcccaactagctgggattaaaggtgtgtgctaccacgcccggctaatttttgtatttttagtagagacagggttttgccatgttgggtagactggtctcaaattcctggcctcaagtgatccacccgccaaggcctcccaaagtgttgggattacaggcgtgagccacagaaaaattttaaacctacctataaagccggaagctctccccttcaagttgttccgcctttctgaaccgaaccaatatatttcttaaatgtatttcattgaaatcccatgcctccctaaaatgtatacaaccaagctgcaccgcgaccaccttgggcacatggtctcaagacctcctgagggttgtgtcatgggccgtggtcactcctatttggctcaaaataaatcacttcaaatatcttacagagtttaactcttttcattgacactctgccaaaaggagccctgaaatgttggtcagatttggataaggaccatggccatgtggcttaaatggcatttgctcgcttgttggtaatgagttgcatttgaagaggtggaataaatggagacaaccggcatcattgggcacctgtggacaaagaaaagcctttttggttgagccaaggtgatactatccacatctgcctaggaagttgtttttttgtttggagtagctgggactacaggtgcccgccaccacacctggctaatttgtttggttttgtatttttagtagagacggggtttcaccatgttagccaggatggtctcgatctcctgacctcgtgatccgcctgcctcggcctcccaaaatgctgggattacaggcgtgagccaccatgcccggccctgcttaggaagttttttgaaagagtgtttatttgtgaaaatgaaggtgcttctttatgtctatagctttctggctttactcctttcagagatttgacttgtaaggcaatagatagaaatgatagctcatcagcatctaatgagccaaattacttactccataaaatattatcctactttctaactccaaccatacaatttgaaggaaagaagcccaggggtcccgattaagccattgacatgtctggctgaaggatgatatgggcttctcattgactgagccaacaacatgacctgcccaggcgggatccgggctgactcctaactccaggatgaaagcaggaaggtaaacagtctttgggtaatttactcaaattgtagccagtgaatacctcaagcatggcactcaccatgctgtagtgtaattgcctggcttttgtttttgttttattttgttttacctgatgggagctctctaatacttcaaacatggcacttaccatgctgtagtgtaattgcctggtttttgtttctgttttcttttgttttaccagatgggagactatgtctttcatgtctgtcttcccagtgtctttgtccgcagtaatcaattattgtatgttgaataagcaaaattataatttttaagcaccataaattcaacctgccaaaagccaaatccaattttttgtctttcaggggatggcacaatagccagcttttcaggaacctgagtgttttccaaaccagcacttttcaaacttaactatgcacatgaatcactaagttttgtgaaaatgaagattctgattcagtaggtcaggggtggggcatgagattctgcatttttaacaatctcccaggtgaggctgatgctgttggtctgcagactacaccttaagtagtaaaggtctagaccctggtctctaccttatctccaaaatttaatccatcaccaagtcatgttgtctccatctcctttgtcccaactcatgtctgtttctgttgccaccactttagctgaagccttcatcatttcactgcagagattattgcaatagctttcatgtagtctacctgctctttattctccactccactgtctatactgcagccaagatgatatctctcaaatacacctttgggcatgtcaatccattgttaaggggctttcaatgtaggataaagtaacagaccttctgtggttagattgcctttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctgtcctgggaatgggatgcagtgccttgggtggtttcaggagattgacacacttccaggaccaggcattttcatttccaccttaaagaaggagcctgctgtgctttctgagacctactgtatctgggatggccagacttcaggagacaagaagaggaaggcatcctatccttttggtgggtggatggacgggccgaatctatctcagaaatttttaatttttacttccatgtcactttccagtcttcagccagccccccaccgtctacctcccactgctggagtgtggcttcattcaggggagaatgctgagctctgttgacatttggtagaatttgttttcttccctctttaatttagcaactaatcacgggggttgttctttgttcatctttccagggttttccgtacgctgactaatgcttacagctggctctctctggagagaagtgctgggaagatcaatcaaatgaaatcttaaagggtaaatcaggttttcaaatgtgttcaggcagctttaaatcgtttcagtgagaagaagtgcttacaagggcagaaatttgcccagcgaaatgcctcccaatggcaacagaacaatcacaccttggatggctgctttgtagcctgagtgtccagttcttctgagatttccaatggccatttacaactcaagagtgagggacaaaatgaagtgcatttgacttgaaggaattcactaatgcaagatcaaagttgtaaaaactgtaccttaatatgctctatcaaagggctgtatgcagatgttaagaaagggaagctgcacaaaatatcccttttcaataatttcacattttctttagtttttcagctcctataaatctcaagaaataattaacatgaaacctatattatgtttcaggaaaaactccagagagtctttcttaggcttttggaagtcagtgatgctgttttctgtcttcttagagaagtcctaaaatggaaaaattttatcatggaaattgacccattcagagcagagagtttatgtgactttatggtacaggaaatttgaaaatcgcatctcatcttttattttctattgtcatgttaaactatggttgtgcctatgggattaagtgaatattctagccacttgcattaaatgattagccagtcttttcatagtgacagttggttgtatgtgctgctagtcctgcagcggtctagtctgctagtggttaactatggagaattggtcagaggagtccctccccctattatacacatctcattaaagactctctgccactgccaaaccagaaaaggcaacttatttcacgattcattaaagaaaacataattgggaaggtaattttgtaaagtcatcatcaaacatagtccaccacccagtaggaattatcctctcattatctctttttctagatagtcattgacattgttcccctctgttagcatgaataattaaggactgagcataaagaagtggtgtggacctatggtcaatctgaaggtgtcatcagaagagttagcagggctttcttgccttcagcaggccatttattctgagctaacctgccaattgtatttagaacagggaccattaacagggtgactgtttggctggctgtcagtaggctgtggggctttttccagagcaaatagagaagccagctgggcttcactaagaccacccaggaagagagatcatgtcccacctgatcacattccaagcaggtagcaaatgggctccagttgaattgtacttctgaaggctttctgaaggggtaggggaaaatacctcccatcttagaaattatggctgctagtgtccagtttaaaaaatttctggccctcagcaccaagtgtcttagctttttgtccatctatagctgtcagaaagacacgctttgtcttcctggcaaaactgcctctcaaggtctatgccatcattatggcttggtttaatcaagctaccagggttgcccctgtgtctctcatctggctcttccagaagggacagtttgggaaactttcagagattctgaagatttcatagggggagaccacacttaaggaataagaccctccacacattgcagtgagagtgacatgttcattgccaccaaaagaagcccctctgttaaaacaaacctgattccaaacagagctaaggttgcttgggggctccgtattgtaaggcctatgggcatgcaatgaaataggagttgatgtggactctgaaccctgaagaagcagtttaaatcactagcactgctgtttattagctgggaaattttgggcaatctatttcagttgtcaggtcttcagtttcatcatctctaaaatggggaggacagtgcctgtctttttacactcctggacttgtgttgaggagatcatggataaagtgtgttgcacacagtaagggtagttatcatggttattaaccacactgcagctaattgggctctagctaccccatttgtccctggtcaggcaggcccaggactttcttaagcttttctcaccttaaagcggaaacacattccctctcctgtggggtcacgtggctctgtttaaatgtggctctaaatgagatgtgtgccttttgacaggtcaccttgtaaagatacacagcatttccaaccatgtaaaggtggctctaacttcttgaaatcctctctttgagaactgcctttagagctggtcattttagtcacaaaagaaacatctttcaacagggtcttttttttttttttgagagggagtctccacccaggctggagtgcagtggtgcagtctttgctcactgcaacttccggttcccgggttcaagcgattctcctgcctcagcctcccaagtagctgggactacaggcacacaccaccatgccccgctaattttttgtgtttttagtagagacatgatttcatcatgttggccaaactggtctcaaactcctggcctcaagtgatccgcccgcctcagccttccaaagtggtgggaatacaggtgtaagccaccatgcccagcctcaacatggtcatgttttgaatatgcttggacagaaccttgccaccatttctcatagtcatgtgtatggtatttaaaccatagaatgtcagatttgtaatgccccctagaaatcttctagtccagtagttttcaaactatgttccccagatctcaactgtttggagaagggacatcaaggtcagggaaaatccaaagcaccatatgttcttgatgctaagatgccattagttgtagtttgcaccatcaattaatactggcatttcaggaatattaaaagaatgtatgcagtcattctaagacccatccttattttagatatgaacttcaattaaatacagtattagggttctctggaggaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtcccagactccaaaagctgaagaatccggagtctgatgttcaggggcaggaagcatccagcacaggagaaagatgaaagctggaagactaggaagtcagctaattccaccttcttcttcctgctttgttctagccacgctggcagccagttggatagtgctcacccagattgagggtgggtctacccataacactctgctgactcaaatgttaatctcctatggcaacaccctcacaaacatatccaggaacaatactttgcatccgtaatccaatcaagttgacacttaatattaaccatcacactgtccatcatcaaattaaagaaatataatgttttctgttaaacagtataattttacacaattgggtaagcactgtttcattgctattttatagattgggctaatgcctatggtttcatgtcacagatttctgctcctacagagtttgaaaattgacctaatctaacccatttcttctgtagaggtccagacaggagaaggtcatacagatagttagcagcagggctggggctagaactcaggcttcttgactgccactccagttctcttcacaatgttacagtaccttttgtctacagccatattgcataccagcccagctttcctttgccatgacttggtttgcatgcaggaattgtaaacccatcttattaaaagttaccaatgataggctgggcccagtggctcacgtctgtaatcccagcactttgggaggccgaggcaggtggatcacgaggtcaggagttcgagaccagcctgaccaatgtggtgaaaccctgtctctactaaaaatacaaaaaaaaaaaatagccgggcgtggtggcacacacctgtaatcccagctactcggggggctgaggcaggagaatagcttgaacctgggaggtggaggttgcagtgagctgagattgcaccattgcactctggcctgggcaacagagagagactctctctcaaaaaaaaaaaaaagttaccaatgataagaacattttatgttactatagcccttaacattttacagaacaattttatattctccttttccttacatctttaccacagcttgttaggtggagcaaggaggatatcatcatcatcattattatcatcattattaagacaatcacctccattttatggatgagaaaactgatacccagggaggataagcaattggctcaagatcatgcagacagttaacagaactgagaagaccatccgtgggtcctgatttactcattcaatgttgttacacattaaagcaaaacataaatctaaagatacgtcttgaggaaagagttattcactagaagcttgcaagaacatcattttattgctgaaagcagctcaccttcaccagggacgttgagtcattgatatcccagaaaccccgtgtcattgggtgatttcaactacaagttggtgccatagcctgagccctgagccctgagccctgaggatggccttatactgagcattgggtgttttatcataacagagacagttaaggtttaacaatgggctaatggccgatggcagtgcttcctgcactgctagtgagagtgccaaaccaaggaggagctgaggaacagtccagtggctaatgtggggattagctgctgctttgggtaatctgtgtccagttcaggctggttacaggagagcctcaaggactcatttcacttggctgcttcttgacctgcaattttgcatgctgcatgctgcaattttccctttgaaaatacatctttccttttaaaaatgtggtgacatgtgacttctctgaagtttaaatgtttgatcatttttaagctggcacaaaaatggttataaatcttaatacttaaaaatgtaaaaggaaagcataaaccctaccaacttgtttggtcccttttgtgtgtttgagagagcaagcccagctcagcaggccctttggatgtccgctgaggttcagaaagcaatgatctagtcgcatcaagatattgaatcttctgaattctggccttgtgccccccaggtcagggctgttgtgttggttagatggctgcccaaaaaatggtcctgccatgcccctgagtttccctcttgtgaatgaatagaaagtttccatctacagagttggcaagctctgtgctgttaatttcacttagttaaaaggaaaaaaataactaaacacacaattattagtaaaccaccctgcagacaagtttaggattctaaagaacatttggtggttaggcttaaatgctgtaggctatgattacccttaattctgcacacagacaggcttcagagccagaagttacatgatttggtcttgtcagatgaggtcccctttttgccttattcacagggagattatggaggtggtaattgtcagtggattccaaaactccctggtcaatttaagcatttatatgtgggtttaataaaatgatgatataatacagaaagcacactgtcagggaaggaagtaactattagcaacatcatgacaccttaatctttttctccctctgggagagcagaatgggttaaacagaaggtttgcttttattattgaagcacaaaaaatcacatttttgtctaagttgtttagtcagtgagttttgtgtaattcaatggaaataattccatagtaacttagtaagtcagtattgaaaaggctgggtgaaaggacagcattttagagcaggcagtgggaagcctgagggagcaggagagggggagaggggctggttaatcagccgtcatatgccaggacaatatataatcctgtttgatttggtggaacaggccctttatgggtaacatattccccaatcccaaatcaggaactgtgaactcattttacttgctataacctcaatcctcataggactggggcttataaattgtggttgactaagtggggagggctgagttgtggaagatgccacctaagggtagtggggacaagcacttcaccaggaaaatcagtgacagaggatttttcagtgtaactttgccagctggagacctctgcagccagcgatggccatgcctggatctcactcaggccctgggcttgccacaggaggcaccctgctcacttggcccagggggctgtgcttggcttgcactcctgcccagatcccacacttgccacaggatccacactcagcctgcagctgggccgggcatgctgcaaccagcttcccccttgtgtgctgacatctggatgaggggaacacagtggcatctgaacagggatgccaacaacctcaaagccccagagggggtgttacagtgtgctaacagttgttttagtcccaccatccacagcctgagcaaacaggggtgtgttaacagctctttcagtcctgttgccctgctccagcccgcagccccagggctaggctggccctgctgctgcttcctggagcatgaagtggctgcctggcactggcggagggcagagggctacagttttacagccttctttgtacccacgtttggcaggttctgagttcttgtcccacatccaagaagaatgagggtacgttgacaactgaagtgtgaggagagttttattgcatggcagctctcagtagagaggggactcgagaggccagccctcgagtggtggtcccaaagtgtggctgagtccggggtttttatggactcggaaggggatgcacgctgattggtttgtgagtattcaaaaaaggctaaaacaagggcaccactcaaaggtgggcacgacagtataaaaagccaattagggaagggtaggtatatgtaaaataggtgaagggtggggatcaattaaaggaaagcatgccagatgggaagagaggttctcaattttgtccatggatttatctaggacttgtagcttggctttcaagctttaaactgtctatggtttgaaggtggggttttatcagggacttgcccctgtctgcctaagacttgtctgccttctgctgctatgagcagtacacagaggcaggagcaaaagcagaatagagccccatctgagccatgagttgggagattttacaatgggtcagtaaaagggacaaaatttatcaaatggaagagcacaaagatgagcatttggatttgtcaggaaagttccaagagaaatgttagcacaatcacagagggttaaattctgtaccatgaactacagatgaccctgactcctttgttggttataaaatacctttctagctccatataaagcaggatgccacagcctacatgtattaaatcatgcattgtattgagttgaattgaatggtatttgggagagggaggggatagcccaagtggtcccaggttaggaccaacactggggcagctgtgatcttgggacagaaatgtgaaaacacagactgtccagatgcagaacaggtgactttcatcaaatccagtccctccaatgaacataagaggaaactgatgccccatgaggggaagcaacttgtttcaggtcacctaccaggttagttgcagaacagacctaaagggtaggctacctaattttcaatttagtgtttgcttctctttaggctttattgttactttgcaatggagatcatacagatatgggtcaggagactcaagaggacaagtgatttgccccaggctacactagtgagcggcagtagccagtgtttgtctgattccagagtctgtggacgtaactacagggatatatgatagagtgttttgtggttggaggaggagagaattccttaagagtgtgtgctcatgaggccaggtgtggtggctgacgcctgtaatcccagcactttgggaggccgagacaggcagatcacgaggtcaggagatcgcaaccatcctggctaacacagtgaaaccctgtctctactaaaaatacaaaaaattagccaggcgtggtggcgggcacctgtagtcccagctactcaggaggctgaggcaggagaatggcgtgaacctgggaggtggagcttgcagtgagccgagatgggccactgcactccagcctggacaacagagcgagactccgtctcaaaaaaaaaaaaaaaaaagagtgtgtgctcacgaaaggcagctctaaagaggtcacatttaaactgaaatctaagggatcatgggaaagaattagccatagcaaagccaggggaagtccaggctgaagtaatcacaattgcaaagaccctgaggttgatttgtccctgggataaatgtccttgcctgatgatgtgcttgcctaagtcctttttttagaggtaattctttgacagacccattgctgtctggaactcccaatggacaattactgctttgttggtgtatctaattcaagagttagcagcagaggctcatgtcatgaaacttcccttcaagcttgtttgtctgctgagtttttggtaggagcaggatgggatcaggatggttagggggccaggagcggtgggaaggaaatgagttaggaatggtcttttatgtgcccatgagaccaggctactggtaaaatactgataaatatttcccctctaagttttttttttttttttgagatagcgtctcgctctgtcacccaggctggagtgcagtgctgcaatctcagctcaatgcaacctctgcctcccgagttcaagtgattctcctgcctcagcctccctggtagctgggattacaggcatgtgccaccacacccggctaatttttgtatttttagtagagacggggtttcaccatgttggccaggctggtctcaaactcctgacctcaagtgaaccacccgcctcggcctcccaaagtgttgggattacaagcgtgagctaccacacccagccccttctaagatttttaacatatgtcatgctgcaggattcctattccattagaggcttgtatttaccgaggcaaatggacgaaaggcaaggaaccagtactagaaatataaaaccatccctgtgttggatacgccctggaacaaaggaatataaggccaggattttactttctgccctggaactgacttccctttgactctgcaagttttactttcctgctttatgtctgataggcataaaatgcctaccattcttctttctaatacaattgtaatttcatcaatgggattagtgaaggcactaacaaaatctaaattctccatagtactgatcatcagggtgttctttagtagtgacttaaagaaaatcatgctctttgaaagaatatatataagttgcctttacattgctcactgagaaaagataatggagcccaaatctaggcttcttgttcctcgcctcccttttttttcctgggtgatcatacttttcaaggttatgttctttcatattcagtgttgaccatgcaaaactggtgaacaagaattggttctgggatgatttgttccagctataaagtagaaagcattttactaaaataggatgcttagatttgtttggatctacagtttattcttaactaaaattccaggaactgttggtaacagtctagattcatggcaaccagtttttacaagaattagaaagaaacgaataaaatgttctcattataaggttcaggaccgaatttgaaggctttcaggattccagatggcaaatggtagagcgaacgtgaaaatattagaaatttatgctcaatgatcatcatcttctgtccagtgaagaatgtagtttaagcaggatgggtgcgggcgtctgatgtcctcatttatttccacctctgtagctatttaagtgatgatcattcttggtggtggttaaattatgatgcacgaaatactatctccctaaggaccttgctacaggacagaggtgattacaagaaattgttgctgctgatgtaatgtttcgtataccaagattaaaccacaagatgaagtaatgtacattttttgcctttgaaatgcagctggagggaaaccagggtaagaactattgccaaatgaaatataatgccccaggaaaaatataagatactgtaaatgtaaaatcattacaaaactgaccatctgggtcatatattaaaccacagctttcaatttgttatggtttgaggaatgacttcacagtgtgtaccccttcctccgtaccttcctcagcctcaggaaagcattctattttcatgagtgtagaaaaaaaagtaatcttaaagttttgtttttaaaaaagagttccaatcaatagctcttaataaaggcacagtgtttgcttacttctttgcatttagtcctactatatagtcttgtgttgctaattccactttagctgtggcaaatataccagtgtgtagccaccgggccatgaggtaaattgaatccgtgtggagctgacagttgaaaaacctctgtctgcctcagttcaggaaacaagagcgtgttcaactcactttgggaaacccccaggcattaaaattttggcattttcatgttttgagagaactgaggagtagccctgttttgataatcatttaaaaatattttacttaattagagcagaatttgctcaggcagaaaatcacatttatatggtagccaggctgtaacacctcatagctacccattgtctctaatcagaaatgacagcctggtgactggctccatgctgggtgaagtccagcaaactgcaggccctgtaagtgcctaatcccaaacctgggcttccagtggagttggtttttttttttttttttttttttcagtggagttcttcaatgggtctggctttgaaatacttctatcctttctagtttaggaaagcaatggcacaagaaacccatatataagtcagctacttttttgatgtgtaattcacataccatacaatttcccatttaaaggctaaaattcagtggtttttagtatatttacgaagttgtacatccaaaaccacaatcaattttagaatattataattccccagaaaagaaacccctcactctttagccttcactcctagtctccccattcctcacacctctaggcaactactaatctactttctgtttctagagatttgtgcattctgataatttcacataaatggacaaatgcagtgtgtggtcctttgtgactgtcttcttggttcaacatgttgtagcatcaagcagcaattcatttcattttattgctgaataacattccattgcatgaatgcacaatttatttattcattcattggttgatggacattcagattgttttcagtttttaactattgtgaataatgctgctatgatttgtgtacaactctttgtgcagacatttgttttcatttctcatggagtagaattgctgggtcatgtgataactctgtgtttaatcatttgaggaattgtcaggctgttttccaatgtacctgcaccattttatatttacaccagcaatgtatgagggtttcagtttctccacatcctttccaacacttgttataatctgtctttttcaaatagctgtcttagcaggtttgtgaagggttacctcactgaagttttgatttgcattttcctaatgattaattatattgatcatctttatctgcttaatttctatttgtatattttatatagagaaatatctattcagattctttgcttatttgaaaattggattacttgtcttaagttattgagttataattgttctttatatagtctaggtacaagtcttttatcagtgacaggatttgcaaaaacttcctcccattctgtgagttttctttcttgatgttctttgaagcatgaaagtttaaaattttgatgatttccagtttatgtgttttttcttttgttgtttgtgtttttggcatcatagctaagaagtcattgcctatccaaggacatgaagatttacaactgtgttttcttctaagagttttattgttttagctcttacatttctgtctccgatcgatttcaagttaatttttgaatatggcataaagtaggggtccatctttgtccatttgcatgtggacgtcgacttgacccagaatcatttgctgaaaaggctattgttaacagttccctccctgccccatagcagccatgcatggggcaacttccagtgaggtgagtatgaggttgtggcaagcaggcctcagtgatggtggcatgatgaccatgctctggggcttcatctgtaatgacccgttcagtttcaacagcattaacttggagacacttacagaaacttacaagattcctttttacttacaatatcttgccagagtattttatcattgcagaggcatctagtggaaagttaatggattgtattgtgggtaaagcagaaggttcagtagctagggaagaatggcaccgttatgccacagctctttctgttgcccaaaatttccatatcttggtttggctgttaaactcatagagttgttggaggaaatttcagaaaggcacaagacaagggtgcctttggttggccctttaataatttactgtacccctagatagcacagggaaacaagtgtcttagtccatttatgttgctataaaggaaactgaagctgggtaatttataaagaaaagaggttttatttggcttatggttctgtaggcagtacaagaaatgtggtgctggcatctgcttctgggatgacctcagaaagcttccactaatggcagaaggcaagggagagcagacatcacattgtgtgagagaggaagagagtagagagggagtgctgggctctgtttctgaatcacttcttggctgggcatggcggctcatgcctgtaatcccagcactttgggaggccgaggtgggcagatcacctgaggtcaggagttcaagatcagcctggccatcatggtaaaaccctgtgtctattaaaaatataaaaattaactgggcgtggtgggtgcctgtaattccagctactcgggaggctgaggcaggagaattgcttgaacccgggaggcagaggttgcagtgagccactccagtctgggcaacagagtgagactccatctcaaaaaacaaaaagaaaaaaaaatcacttcttgagggacctgctagagtgagaactcagtcattatcatgaggatagcaccaagcccattcacgagggatctaccctcatggcccaaacacctcccatcaggccccacctctaacactggggatgaaatttcaacatgagattggaaggggcaaatattcaaactgtatcagtgagaaaaataaaataatatgagaattgagaaagaagcaaaacttttatgttgcatagatatgattgtacaaatagaaaatccacaattattcttatggatttattacaataaatgtttagaattaacaatgtttaagaagttggatataaattcagtacaaaaatcaattgcatttcaatatacaaaaaataacatttagagaaatatgtcatttgcagtgttaccaaaaaacattaagtgtttaggaaaaacctaacaaaagccatgcaagacctctttgaagtttataaagctttattgagaagcattcaacatgagctagctaagtgggcagatagactgcacttgtagattagatgacgtgatattataaaactggtaattctccccaaattgatccacagatccagtgtaattgcaatcaaaacctcaagtatttttgtgggatttgttaatctgattcctttttttttgaaacagtgtcttcctttgtcacccaggctggaatgcagtggcatgatctcggctcactgtagcctcaacctcccagactcaagtgatcctcccacctgagcctcctgagtagctgggactgcaggcctacaccaccacacctggctaattaaaaacattttttcatagacacagtgtcccactatgttgcctaggctgttaagctgattcttaaacttgtgaggtaacggaaatagctaaattaagacaaaatattcttttaattttttttaatatagagatggggtctccctgtgttgcccaggctggtctcaaattccttggctcaagtgatcctcccacctcagctgacaaggtattcttaaacaacaaaatgggcatacttgcccctccaaatgtcaggctataataaataagactttgtgttagcgttgtagtagttgtccagaccagtggaacagaatttgagaaacagatccaggaatacatggaatttgacatttcttagaggagaaattgcagatcagtggtgaaagaattgacttttcaaagtgtggtagaacaatttgacagccatgtgtggaaaaatttttcccagattactaccttatcatatgcacaaaaaataaattccagatttatgaaaaatctaggtgtgaaaagtaaagctaaaatgctctttaaagatagataatataggagagtgtctccatgacctcaggatagaaaataacttcttcaacaagccattgaagcaataactgtaaaggaaaagttcatatattcagtttcattgaagtgaagtcattttgttcttcaaaagatgtcataaggatcataacaagaccaaccacaagttggaagaagatatttgcaaaagcattacaacagtgtttgttggttatctggaatacatagagaagaactatagctgggaaaaataaataaataaataaatatgggaaagaccattaagtactatacaaaaagagaagagtaaatgggcaataaacaaaaactgcatttggccttattagtaatcaaaaatgcatattaaaatcacgatgcggcaccattataccatgagattggcaaaactaaaaatgtccaaagcaccaagccttggtactgtggggatggagttttactcaattctgtgagtgtaagctggtacaagcaggttagaaaacagtttggggccggctgtggttgctcacacctgtaatctcagcactttgggaggccaatgtgggaggattgcttgagaccaggagtttgagaccagcctgggccacatagcgagatctctgtctttacaaaaaaaaaaaaaatagctgggcctggtggtgtgggcctgtagtcccagctgctaaggaggctgaggtgggagggtgccttgagcccaggagttcgaggttgtgccactgcattacggcctgagcgagagtgagaccctgtctctatacacacacacacacacacacacacacaaagagaaaaaaaagaaaataaaaaaggaaagaaggaaacagtttgacactctaataaagtggaagatatgcatactcttttgacccaggaatgacctcataactgttgaccttagatattgcactatgagacgcaaaatgagaatattcatagtttttaatagtaaaagccggaaacttttaacaataggactatgggcaacttatgatatattcatacaatggaatgctaaacaacacacgaggctaagtttcacaatattaactgagaagggcaaatcaaaaaaatttaaaatataactccatttatatgaagttcataaacaggagaaactaaactatattaggtggtaaattagatattacttggcaatgcctaatttctttccatctatattaggtagtaatacctaatttattgctacttaatattgctatattaggtagcaagcagcaagaagataatgatcacaaaagtgaagaagtggagacctcttggtgagggaggggaagttgatgactagagggacctgagggaggctacctttgggccatggccacatgggtgcttactgcagtctttaatttgtacatatggatgagaacattgtatgtatgctatgactaatctataaaatgagcatatcaattactgcaacataacatatagtaatttttaaaaaccaagtaacagaattgtggttaaaaactacttttttgagtttatcttttaagaaactatatattatagattgtgaaatattagcatgaaaacaagaaagtcatgtttttatgctgcaaaataatggtcacaaatcctatgtaataaaaattgatattgtgatgtaaaacaaaggctattattttctcactggatttttccccactgttttagcacccttgttgacaatcattgactaaaaatatgaggatctggactcttaattgtatttatctatacttatgccaacaccatattttattgtcttgattaatgttttgaaattgagaagtgagtcctccaactttgttctggttttcatgattgttttggatattctgggtcttttatagttctatgtgaattttatgatcaactcattgatttctgcaaagaaaagtaagattttgatagggattacattgcatctgtagatcaattaggggagtattgtcatgttaacaatatcaagttttctgattcatgcacatgggatgttttcccatttatttaggtcctctttaatttctttctgcaatgtattttagttttcagagtataaattttaggcttattttattaaatttattcctaagtatttaatttctagcgatgctattgtaaatggaacagtgttcttaatttcatttttggtttgtccattgctactatatagatataaaattattgttggatattggtcatgtatcctgcaaccttattaaaattgtttattagttctaataaatgtttactttattccttaggattttctatatacaagatcatgtcatctgcaaatagttttacatcctcttttccaactggggtgcctgtatttccttatcttgcctaattggcctacctaaaacttccagtacaatgttgaataaaagtggctagaaaaattatccttgtcttgtttctgatctcaaggggaaagtatcattctttcaccatggagtctgatgttagttgtgggttttttctagttattctttatcaggttgaggaagtccattctccttttttctttaagctattgattatcaggatggatttaggtggtcttgctgctttggaaattgtagacttccttcttaaagcctgctccattttatccttctaagatatgcatgattttggaaagactacaagcttcccagttagaggagggccttcttgtttttcaccctacatacaatgagcctccttgttggatgccaaagtaaggtctttacatccttcattccctacagaccaggcttcttaaattatcaggccacaggtaacaaatatatttcatctcctgtaccaattctgatgttttggtagtagctgcccgaaggattgttaagaaggaatctgaggccaggcacagtctcagtgctgtcattaattagtgttatctggcctggtgcactggctcaggcctgtaatcccaacactttgggaagccaaggctggcagattgtttgagctcaggagtttgagacctgcctgggcaacatggtgaaaccccgcctctaccaaaaaatacaaaagctagctgggcatggtggcacacgcctgtggtcccagctactcaggaggctgaggtgggaggattgcttgagcccaggaggtggaggctgtagtgagccgagatcacacaactgcactccagcctgggttaaagagcaagagcctgtctcaaaaaaaaaaaaaaaaatgagtgatatgtgtcactggtctggtagtagggaaggctgcaaattgatacaacttctggattagactgtgcctgtgcctcaaccaattccagtggcctttttctcagtgccctccgtactccttcaacaacattaaatcttatggtccatacccctttgtaccaccctctcttctttagatctctgttacaaagcaatattctgggtctcctgtaaagtctctggccttccctcccccgacttttcccctcaacatatctctctagctttctcaactgagcctttgatcctgtgtactgtttgcttgggatattttgcccttcttttacatctctccttgctgaaaattgtgccattcttcaaggtccatctcaaatctgcttccctggttttccccatacctgagagactgttctgcccttaaactgccaaggcataggatatttgggtaccatacctagaattgttttccttcatgtacttttctgagttcctgcccagtactgaaaatatgaaattttttaagtccaggcagggactttatattcttagcatatgactccctgcttttactatggtggatgctcaataaatgtttggtccttttaaactctttgcttgctgtctattggaatgattatttttaagatttcatgttatttctattataggctcattagtaatgctctttattttgtgtttttcctggtgtttattccaggacatacaatatataacaatttagtattagtacacatatataactaggttatatattgctgcatgacaacctgtcttcgaatttagtggcttaaaacaacaaacatttattatctaatagttttagtgagttaggaatctaggcatggctttgctgggttctctggctcaaggtctctcacaaggctgcaatcaagatgttggctggggctgcagtcatttcttctgaaggcttgattgagggaggatgcaattctaagctcatgcatgtggttgttggaaggattcagttccttgtagtctgttggactgaaggcctcagttcatcactgactgtcagctggaaacccccatcagttccttgccccatggaactctgcatagggcaatttgccacatagcatctattttcatcagagaaagtgaaagataataagagagggtgaacaagagagaaggcagagtctttttttttgtaccataatcttggaagtgacatcttagtacttttgcgctattccatttgttatgagtcattatatccatcacccattcaaagggcaggtattacacaatgacatgaataacagatgttgtggatcattggaagtcatcttagaggctgcctaccataacatccttctaacttttaatattctaccttgaaataataatataccattttagatggtatattattcatgtgaaaacctataacaatatattttaattttcctcttctcagcctttgaactacctttctcatcatttttctacatatgttataccacatatagtacaatatagtattatttaattaatttatttattagagatagggtcttgctatgttgcctaggctgtttttgaactcttggcctcaagcagtcctcccacttcagcctccaaaagtgctaggattataggcatgagccactatatctggcctattatttttgatttaaataattatcttttaaagagattttacaaatgagaaaccaatatttaatatttatgcacatttttatcatttacagtgttcttcattcctttttgtagctccagcatcccatctggtgttattttccttgtgatgaaagaactttattatttcttatagtgttggtctccttgcaatgaattctccctcaaaaaaggaaaaagaaataagaagtgtaagaattgatagggaagatataaaactatcattacttgcagttggtatgatcatctgcagaagaaaaacaagataatggatagaaaaaatgataaaaactaataagaaaatgcagcaacttataaaaatcaatagcgtttctctgtaccgatgataactgatccaaaaacagctggacttctggcagtaattttctcagactgctcccttatttcacctaatttttgaaagacagttttttttttctgtaaatagaatgataaggtgtcagttttttctttcaatacttcaaagatgtcacactattgtttttggtttgcatagcttctgatgagaagtatgccatcatttttatctttgttcctttgaacaactttcacattttttcagtacttagataatgatttgctatggtgtggttttttccttttatttttggcttacagtccattgaaatttttagacttgcgcatttatagttttcataaaatttgcaaaacttttggtcctttttcttcgaatattttggtacttcattgaaccctgtggtgtttcccatagctaactgatgctctgttctgtttgtctcagtcttttttctctatgtatttcattttgaccagtttctattgctgtgtctttaggttcattcatcttttcttccgcagtgtctattgtactagaaatcccagcctatgtatttttcattacagatactgtatgtttcatgtctagatgtttgatttgagtctttcctgtaccctccatgtttctacttaacatgcccagtctttcctctagctcccctattaaatgggagcatatatataatgactatattttaatgtccttatatgttaagtctataatttgtgtcatcttagtttgtttctgttgattgatttttctccatttaagagttgtatctttctaattctttgcatgtctgataatttttgattggatgttggacattatggattttatattgttgggtgctttattttatcatatttctttaaatactattaaactttgaaccagcatgcagttaattggaatcagtttgatccttttgaggcttgatttttatgctttcttagggtagtatcaacgtagcctttagcctgcagctaattttatttcactaccaagacaatacacttttcagggctctaattattgccccatatatcacaaggtctttccattctgctggtaggaacacaaactgttcctgtgtctttgtgagcttctggggactggccctcctactttttctttttttagcaattcttttattggtcttgggtagtttcctcccatacgtatgccaatcagtactcagccaaagacataaagggatccatctgaagacctccagagctctctcctatgtagctctcttctctctggaactttttcccacaagttttaattattttggcctccctcttccctgatttctgtcttctcaatgcaggaaatcactgggctgtttgcactgcatcgtggaaagcctctccagtcagtaagctagggaagatttaggggtgcctcacttgttccccttctctgagggctagcaatcttgtactgactgttgtctagtgtctgaaagccatttttttttcatgtattttgtccagttttttagttgtttaatctgattgcttttactccatcatggttggaagcaaaagttgttaatacgtttttgtgatgccagactgaactttcattgtttggctattcaagggctaactcttcagcttattaaaatgcagagaagcttatatatatatatatatatatatataaccttatgttgataaagagagcatatatgacaggacacctttttttcaaactgagtagttagtagaagcatctagaagagaaaacatttggttttctaaactattaggaagatattaagccatttagggcagtgttccccaatcattttggcaccagggaacagtttcgtagaagacaatttttccacggacagggggaggtgggggatggtttcgggatgaaactgttccacctcagatcatcaagcattagattctcatgaggagcgcaacctagatccgttgcatgcagagttcacaatagggttggcactcctataagaatctaatgacgccactgatctgacaggaggcggagctcaggcagtaatgcttgctggcccgctgctcaccacctgctgtgcagcctggttcctaacaagccatggaccagtacccattcgtggcccagggatggggacttctgatttataactttgagtcactcaggctaacagcatcatggttaaggggatatttagcaacagaaataaagtgacttttctgagagtatgcaatgactccattcgccctaggtccaaaatgatgagaattgaaacacatatgttactaagattgtaaatggaagagggcggagggaggtggtgaacatcagcatagggcagaagttgtcacatccacactttcttgtatgtcccctattcctggagctgccttccctatttttttgcatgtctaaagagcaagtcatatcactgatctctgaataataaaagttaccatttattcagtgcttattatgttccttgcactgtgctaagtttatatattatctttcactgaatcctcacatctgcctatgaggtgggtgctattactattaccattttatagatgaggaaattcagatatagagaggtttaattatgtacttaaaggctatacagattagtgattggctgagctaggactagaacccaggctttttgactccatactctgtacttttgccttcatgtctccacctgagttgggatttcctgttcttccaaatcaatctcggcattatttagcactgaccacgattctttgcatcccttgcccccgctccccccgcccccagcacctccaagtatctattttaggcgactccagctcaggaagagcctcgatgttactcggcaacaggtatctctcaacctctaaaatgttccaccttctgatagaattccaccttatagttttgtcatgttgcttccttcaacactagatggtggacttcctcattgtctcctgattagaccttaatcactgctgcctttaaatgtcatgttccttcaaagctcaagacttagttggctctttcagttagtctttcctgatggatcacatgctgtcgaaatccttctaatgctttgaattatcagcatttaccttggatttggttagatggtctttctgactttctctgagattctctggtactttgaatctctttctagatgtttatgacatagcacccctatattcatattataacctgctcaaaattcccaatcatagaatatttactgagttcctaatatgagcaaaacactgattttaacattgcccttctcttttgagacaatcagtgtttccactgtttaatttttaattttttgtgggtacatagtagatatatgtatttatggggtatgtgagatattttaatacaggcatgtaatacgtaataatcacatcatgtaaaatggggtatccatcccctcaagcatttaccctttgagttacaaacaatccaattacactctttaagttattttataatgtgcatttaagttattattgactctagtcaccttattgtgctatcaaatagtaggtcttactcattcttttttttttttttttgagacggagtctggctctgtagcccaggatggagtgcagtggcacaatcttggctcactacaagctccgcctcctgggtttatgacattctcccacctcagcctcccgagtagctgggactacaggtgttcaccaccacgcctgggtaatttttttgtatttttagtagagacgaggttttaccgtgttagccaggatggtctcgatctcctgacctcgtgatccacccgcctccgcctcccaaagtgctgggattacaggcatgagccaacactcccggctcattctttctaactattgtttttgtacccattaaccatcctcacccatccccagtcccccacttcccttcccagcctctggtaatcatccttctactctctgtctccttgagttcaactgttttgacttttagatcccacaaataagtgagaacatatgatgtttgtctttctatgcttggattaattcacttaacataaagtctttaaactcttcatgtttattattcctccaattatttaatatgaagatctgcctggtgacagtattggagtgacgctcctatagaaccaaaagaggcacctgagttgcagttttcatcaaagtcatgtagtatacaccataggcattcagagtcactgtcagtccattgataagatgtaaggcaacagattagaacccacagcccagtgtcagcaagcagaagtgatgattgataccagtgagaggaaatagatgaactaacaagtatggccagctgccagatagttgtttatatgtcagtatcatcattgagcatcacattatcataacctagtacagtaatagatattcctaaagactgagacaaaatgcatataaagccctcatctaatgcctgacacgcataaagcacagaataaagtgtgtgtctatgtatatacattttatatatacacacaaatatacaaatgaaaaggctaaattataatcattgtattttatatatatcatatatatgtgtatatgtatgtatatcattatatacattgtaccttatagaagagaagtatacatgacattttagaatgatttccgtggaagtagctagaattaaaaaatatttttcgtttattgagaagtactttcagttatcacagtgcaacactgctttctgtaatgaggctagaaaaatgaggagccattgtatttaataaaataagaattttttctgtctccatggtaagattaacgaacacacttcaacataaagtaatacaattgctaccttcttcctggtggcatgctccctgtgttaaatttaagtgacagtaaaacgtaatgagttagaggagaaaaattttaatttattcgtttatttgaatagggaaacccaagagatcagtgatagaatttgaactgcgagacaaaaagaaagaagaggttttagttttgtagctaaaattaaggtggtggcacttgaagtgaaatttaaaaatacacattcacttagttttcttggccatattctgcttctcatgtgaaactggacttcctgccttttagccttgtattctgtccctttggaaactgtatcatcttttaaaaatgaagtacgtgactttcgtaatgatcttttatattataaaaataggccgggctcagtggctcatgcctgtaatcccagcattttgggaggccgaggctggtggatcacttgaggtcaggagctcgagaccagcctggccaacatggtgaaaccctgtctctacaaaaatacaaaaattagtcggacatggtggcacatgcctgtaatcccagctactcaggaggctgaagcaggagaatcacttgaaccccagaggcagaggttgcagtgagctgagattgtgccactgcactccagcctgggcaacagaacaagactccatctcagaaaagaaaataacatcaaaataaataacataacataacataacataacataacataacataacataacataacataacataacaataggaatttcaaaaaatctgaaacccgggcctggcacagtggctcacacctgtaattccagcactttgggaggctgagacgggtggatcacctgacgtcaggagtttgtgactagcctgaccaacatggtgaaaccccatctctactaaaaatacaaaaatcagccgggcgtggtggcgcatgctgtaatcccagctactcaggaggctgaggtacaagaatcgcttgaacccaggaggtagaggttgcagtgagctgagattgcgccattgcaatccagactgggcaacaagaacaaaacttcgtctctctccccacctccccccccacaaaaaaaaaaaaaacctgaaacccatcatgactatatcatgatgctgtagcctcaaaatggacttcacaagttcacctgtgattccctcaaaagcacttgagttttgatttgctgattgccagaagtgtatttgaacagtcccactttatatggagccccaagcatattaaatggagattccagataattagtgagctctggatgaagctcctgggatgcagtggggaaaaaactggatctggagtgttaaggtttgggctctgggcctgactttttcccttatcatttggaaattaggctcaggattgtgtattggggaaacacagcaagctgtatgcctatagtaaatagacaccctgtttagtggcattcaatagacctcaatgccatattcattcttccccaaccctatctgtcttggcttcaggcagatcttggcatagggcaccctcatcctcccccactgccacctagctcctgggtgaatgtctcccagcctgggaagagttctgttgaacttcatgaacaatgctgtctgcctagcattggagctcataccctgagactttgccttagtcctctcctttgtgcccagaggcatacatttgagagacagtcaatagagccttagacccctaactttgcacatataagtcctatgaaccatctgggccactcactctgcttagagcaattgcacactgctccctctcctttccttccatttacatctacagggagatttttagtttactaagccctggtaaatgacagttactaagatgtaatacaaatcttaacagtgggaacagtgactactgtttatcacgtgaatactataagtcaagcacaacaaccctttgtggtgctgctagagttaaggaggcatcctcagaggttgaggaatgtgcccaacctcagatgctagcaaatggtagagctttgttcagagtccaggtcctcattctaccacatctcactgcctctttatgttctgatgtctctactgtgtatatcaatgcttctcaaacgcagtatgtacacagttggccctctatatccgtgggttccacatttatggattcaacctaccacagacagaaaatatttcaaataaaaagcaataaaacataacaatacaacaataaaaataagacaaattttaaaagcaatacagtgtaataactgtttatatagcatttacatttattggatacgagaagcactctagagatgacttaaagcatatgggggatgtgtagaggttatacacaaatactttgccattttatttatttgtgtgtttgggtttctttttaagatggagtctcactctgtcacccaggctggagtgcagtggcacaatctcggctcactgcaacttccacctcccaggttcagatgattctcctgcctcagcttccggggtagctgggattacagacatgcacacccacgcccaactaatttttgtatttttagtagagacggggtttcaccatattggccaggctggtatcgaactcctgacctcaagtgatcaggctgctttggcctcccaaaatgctgggattacaggcgtgagccaccatgcccagcctgtgttgccattttatatcaggctcttgaacatttgtggattttggtaccacagggggtcttggaacattgcaatactctatgaatactgagggacgactgtatacatatcacctgggaatcttgggaaatgcagattctgatcttgtacctctggcatgaggccttgattctgtgtttctatcaagttccaaggtgctgctgctgctactgatccatggaccacattttgagtagcaagagtgtgcactatcagaaatacaaggggagtcaagaatcttataaccggattggacatttttaacaaaaatactgttgaaaatttacaggataaatttttgaacattttgaaagaacaaaatgttttatcaactagaactttgcttcattttcaatatggtcttcaaaaacaaaaacaaaaaatcaaaaccacaatgagataccatctcacaccagttagaatggcgatcatcaaaaagtcaggaaacaacaggtgctgaagaggatgtggagaaataggaacacttttacactgttgctgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttgttgtggcactattcacaataggaaagacttggaaccaacccaaatgtccaacaatgatagactggattaagaaaatgtggcacatatacaccgtggaatactatgcagccataaaaaatgaggagttcatgtcctttgtagggacatggatgaaactggaaatcattattgtcagtaaactatcgcaaggacaaaaaatcaaacaccgcatgttctcactcataggtgggaattgaacaatgagaacacatggacacaggaaggggaacatcacactctggggcctgttgtggggtggggggagtgtggagggatagcattaggagatatacctaatgctaaatgacgagttaatgggtgcagcacaccagcatggcacatgtatacatatgtaactaacctgcacattgtgcacatgtaccctaaaacttaaagtagaataataataaaaaaaaaaataaaaaaaacttttgttctttcagttaacatttttttttttttggtaaacatttggataaggaaacctgcttatccaaatgtttaccaaaacagtatcatccagatgatgacagttttgccccacttgctgaattcagcttcacattgctgacactctaagcaggggtctttgaatgtgcttcgggagattcacacttctcctccccatgatcatatacacagtcattcatatatgtttctttgtacatgttctgaggaagaatcggaactgttcatcacattctccttggacttgcaaaccagtgctccaggagaaaggtgcactccttctaatggttctggaattccccatcaccaaatccttgaccaagaagaatacatagtaatatatgcaatttatttgtatcaggtgctatgagttctcaggctgctgactacataattgaagcccttggaaaatgccagttgaatgctataattaggtaaaaataaatgcactaggccttttagataactttccagatgattgtcagccaaagcccaggcagaagtagtccctaatttccctagagctgaaagtcagtgaccttcagcttcccttttccacccttgtgattgtcattagggctgtgcatgtagcaccctcagccagcaatacggtagaagtgaggctcatcgttacttacctaggtctctgcattttcaatatctatctgcaaaatgagcttgatcaatatttaattattagtcaccaggaggtaattagagttacagaaaccaaaaagaatacatatagatgagctcaaggtgttctgagcacaccaaaccattctgacgattcaacatggaaacagctctgatcccaataatagccatagaagcctacctttaaaacccatccctgctcatttttattaggttggtgcacaagtaattgcgggttttgccattacttttaatggcaaaaactgcaattacttatgcaccaacctaatgcatttccatcattttcatagacctgagcacttatgagccatggccttgtagtcagactgcatggattcaaatcccaattattccacttaatagttgtatgaccttggtacattattgtcctctctagtctcagtttcttcttcctgcaacataagaataatgatgctaataataatagtgatagatagtactgctctcatggggtagttttcagattaaatgaaatgatctatgtcaagcacacagccaaatgactggcacatagcaagtactcactaaatgctaactgttgttattactttctaggccaaaaacaatatgtcctctttaacaggagcattgggtacaaagagttactgttgcctatgaaccttaactctttcagttagtggaggagaaattaaaaatctttgtgttatctattctgttcccttggtctttgtgcctatttttatactagtaccatgttgttttggtgactgtagccttgtagtatagtttgaagtcaggcaatgtgatgcctccagatatgttctttttgcttagtcttgctttggctatgtgggctaattttaggattgttttttctagttctgtaaagaatgatggtggcatttatctatcatcgtctttccttccacccagaacatcagagctagttgctacttacttccacattgcctctctgtttctccaccttcctagctttgatgatctgcatttctgctccattgtacttccctcacatacccactaccaaggtcacatatttaaccttacactttcgtatgtggatccactcctaagacctcaacctctgactacattcatcttggactacatacatctcttcctttctcacctcagaatctgctcttggtattcccaggactcattgatcttcataccgttccctttgacccagtatagaagcttctccctactttcagccacttccccccttctcttgccatggattcacactctcctgtatcctgcacaccattgccagtcatttcaacagatgactcataattccaaaatccctcaacaccataatcttatatcattcttgatttaatccccagcataatctctctgctcttgaagtaccaagtgttggtggaaaaagttgcaaaatgatgctcattgggtacacagatcagtagtactttctgatcttagctgggccctccctactgcttgaatgctctcttggatgctcttgtattcctctcttgccatcttctcagagaggcaggatggcacagcagttaatagcccaagcacaggcaactgatgagacttagacgctgaaatcctgggtctgctacttgctgcctgtatgattgggaaaattgatctaatcttaggctttagttttcttcacctgtaaattgggattgctcctcaccttaggggattgcttgtgaataccaaatgagatcatatatggaaagcacttataacacagtgaatggcacacgaagtacaaacacacacacacacacatgcacacaagcacatacacatcagctctattgaggtatgaattatataccataaaatctaccaattgtggcaggacacgttggctcacacctgtaatcccagcgctttgggaggccaaggagggcagatcacttgagcccaagagttcacgaccagcccaagcaacatggtgaaaccctgtctctacaaaaaatagaaaaattagcaggacatggtggtgcgtgcctgtaatccagctactcgggaggctgaggcatgagaattgcttgagcccaggaggcggaggttgcagtgagctgtgatcatgctgttgcactccagcctgggcaactgtaatgaaactctgatatggtttggctgtgtccccacccaaatttcatcttgaattgtaactctcataattcccacgtgtcgtgggagggacctggtgggagataattgaatcatgggggcgggtatttcttgtgctgttcttgtgacagtgaataagtctcatgagatctgatggttttataaatgggagttcccctgcacaagctctttattgcctgccaccatgtaagatgtccctttgttcttcctttgtcttccaccatgattgtgcggcctccccagccatgtggaactaagagtccattattaatctttataaattacccagtctcgggaatgtctttattaacagcatgagaacagacgaatacaaactctttcttaaaaaaaatctaccaactgtaattgtacaatttaatgattttagaatatttatacagttgtgcaattgtcataatctagttttagaacacttccattaccccacaaaattccaatgtgcctgtttacaaacaggcaattgtagtcaattgccattttcactcttgacctctggcaaccactgagtgaaccactttctataattttgctttttcttgacattcacataaatggagccatataacatgtagtcttttgcatctgacttctttcacacattataatattttgggggtttgtgcatgtggcatcatgtatcagtactttattccttttgatggccaaataatattccattttgtggctataccacattttgtgtgtccattcatcagtagatggatatttgaattgtttcctcagtgtttccaattgtgaataatgttgctatgaatatttgtatacagctctttgtgtggaaatatattttcattcctcttagatctgtacctaggagtggaattgctgggttatatggtaagtgtgtgtttaatttttaagaaactgccaaagaatgttttaaagtgtcagtaccattataccttctcaatagcaatatatgagattccagtttcaccacattctcaacaatacttgttagtgtctatcttttattacagtcactctagtgaatgtacagtggttctccttttgcttttaatttaatttccctgatgtctaatgacaattgatggcatatacttattaaacattcacagatctcctttgatgaaatgcctattcaaatattttgcttataattggtttatgttctcattattgagttgtaagagctctttatatagtatagatacaagtcctttatcagttctgcccataatgaattctctcagactttgtttatctgggaatagccttattttgccttcattttcaaaggacagttttactgcatgtagaattattggttaccttttttcatctttcagcattttttttttttgagacagagtcttgctctgtcaccaaggctggagtgcagtggcctaatctcagctcactgcaacctctgttcccaggttcaagcaattctcctgcctcagcctcctgagtagctgggactacaggtgtgtgccactacgctcagctaatttttgtatttttagtagagacggggtttcatcatgttggtcaggctggtctcaaactcctgacctcaagtgatctgccctccttggcctcccaaagtgctgggattacaggcgtgagccaccatgcctggccctctcagcattttgaatgttactccactacctacagcctccattgtttcagacaaaaagagcattaattgtattgatgctctactgtacataagaggcttttttctgttgtttctttctagatttttctatcctgtcttctcttttttgtttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtggtgaacatatttataagaggtcttttgaagttctcatccagcaagtccaatatatggggacatccagaaactttattgattgctttgtttttcctgagcacatctcacttttctgtttctctctaattttttgttcaaaactcacattttacataatatattgtagcaactatggattctggtgtttttcctctgatggttggtgttgttgctgtttttctttgtttgtttgtttgtttggtagtttctttgtttattaacttgcctgatctaaatatgtgaattatgtctcccacatcgtgtgtagcccccgatgtctgtgctcagtttttaaattcttgttttttatttttaagcatggctttctattggttcttttctctgtctgtgtagtttagtgtacagaggctgtgaccaaacatcttgtgccattaaggctactatcttctgttggtgggtctgtgtttggtagagttgctcattcagggtttaagctattttcaagtctgccctggctattactttctactgggccatcttacatcatatgtgttctctgtaagttttagttgttatgattattatgactgtatattctttcctctcagcagttgtaccaaaggcttttttgctctccagtagctctcctttctagcttcttcaatctcagcaggtgaccctccttcttgctttctgaaaagatgtcggccacacagtatagaacccatgacttccgatttcattttttttattgagatataatttacctaaggtaaaattcaccattcagagtacacagctctgtgtgactgttagtataatcacaaagatgtacaactaccatcactgtctgattccagaatgttttcatcacccagaaataaaccctgtgcccattagcaatctcttctcatttctgtttcccaccaactcctggataccagaagttgtagcatgaatcattgcttcattccttttcattgctgaataatagtccattataagggtagatcatatttggtttatctgtttatcacttgatggacattggattggttccacattttttctgttgtggataatgctgctatgaacttttgcatacaaattttagtgcagacatctttttggttctcttgggtttacacctccccactttatattttatttaatgtaaagtatatattataataatgttgttacttacttctcattgttgaagaattaccttctacgccatgaagaattcttaaattttattcccactctctatcaccacttgcaggaccttgctccaacaatatcactcctcatcagtatctctcttcttgctcccacagtatctctccttaccagtcatttcatcttctcctctgagtccatgctgttagtctacaaacatgatctgatatgtttgatcccaagccttcagttacctttaacacttcccatcattcttcttatctaattggttgccaaatctggccaattttatcttcaaattaattttgaaaattattttgtactcctcttccacattcctaccagtcaaatcactctctatgccccagattagacacagttactcttttctctatagcactttgtactttgtgatggcacttagtgtcttgtggaatagtcatttttgttttagttgtaatttgttaatttcctcctggctgcaagaataatcttttattcttactcattcttgcatccccagagcagcctagcattggatcagagcaaaggagtagcactcaaaacatcataacatctgcagattgtggtttaatttggactttcaaatttattatttctcatggtctctctcctttccatccttcatctctctccctccttctcttactaccattgtatataaaactaatttctatttatatgtatcttgaatggtgtaaggtcagagataaccagtttcacacatgtttgtgtctttccacagtgtcagacttttattgatgctatttcaatcacaaaatccatgagccacatggagttcccaaggaggcaattctccttcgtacttcccattcactcggaagtcagagccatgccacagaggcacaagccactccataagtcagtcaatattgcaaaccacacaaaacagtacatttcatctatatatatatgttacagattgaacattccacaacaaacaaattaacatttaacatcaagagaaagaggataggaaaaggggttaatgaaccagtctaggaagacagatatagacaaaaagaatgtcctggtctggaccagctggtttgtcaattttgcaaggaaaagtctcatgtgggcagagcctttggtggcagatgctgggtgcttatcacgagtgaaagcaagacggtgtcagttaagacagccatttggagctgctgaagtcctgctccttttatggccacagagtcctctggtgaggactgatagtggaaaagtatgcctatgtccttatctggttggttgcagtctttatttattaagcaaaacatcttgaccctcttaaaaaagtgccctatgaaatgtaagatggagtctttttctaagatggagttacttatgttaagggcgctctgtacaatatatgcttgacatatgttaggcactcaataaaaagctgttggttaacgcaataaaaaatggtaaaggagatatcaccaccgattccacagaaatacaaactaccatcagagaatactataaacacctctacacaaataaaccaaaaatctagaagaaatggataaattcttggacacatacaccctcccaagactaaaccaggaagaagttgaatccctgaatagaccaataacaggctctgaaattgaggcaataattaatagcctaccagccaaaaaaagtccaggaccagacagattcacagctgaattctaccagaggtacaaggaggagctggtaccattccttctgaaactattccaatcagtagaaaaagagggaatcctccctaactcattttatgaggccaacatcatcctgataccaaagcctggcagagacacaacaaaaaaaaagagaattttagaccaatatccctgatgaacattgatgcaaaaatcctcaataaaatactggcaaaccgaatccagcagcacatcaaaaagcttatccaccatgatcaactgggcttcatccctggtatgcaaggctggttcaacatatgcaaatcaatgaacgtaatccagcatataaacagtcccaaagacaaaaaccacatgattatctcagtagatgcagaaaaggcctttgacaaaattcaacagcccttcatgctaaaaactctcaataaattaggtattgatgggatgtatctcaaaataataagaactatttatgacaatcccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcgtctcagcccaaaatgtccttaagctcataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcaaggaaataaaagaggacacaaacaaatggaagagcattctatgctcatggataggaagaatcaatattgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaggctggaggcatcacgctacctgacatcaaactatactacaaggctacagtaaccaaaacagcatggtactggtaccaaaacagagatatagaccaatggaacagaacagggccctcagaaataataccacacatctacaaccatctgatctttgacaaacctgacaaaaaccagaaatggggaagggattccctatttaataaatgctgttgggaaaactggctagccatatgtagaaagctgaaactggatcccttccttacaccttatacaaaaattaattcaagatggattaaagacatacatgttagacctaaaaccataaaaaccctagaagaaaacctagacaataccattcaggacataagcatgggcaaggacttcatgactaaaacaccaaaagcaatgacaacaaaagccaaaattgacaaatgggatctaattaaactcaagagcttctgcacagcaaaagaaactaccatcagagtgaacaggcaacctacagaataggagaaaatttttgcaatctacccatctgacaaagggctaatatccagaatctacaaagaactcaacaaatttacaagaaaaacaaacaaccccatcaacaagtaggcaaagtatatgaacagacacttctcaaaagaagacatttatgcagccaaaaaacacatgaaaaaatgctcatcatcactggccatcagagaaatgcaaatgaaaaccacaatgagataccatctcacaccagttagaatggcgatcattaaaaagtcaggaaacaacaggtgctggagaggatgtggagaaataggaatacttttacactgttggtgggactgtaaactagttcaaccattgtggaagacagtgtggcgagtcctcagggatctagaactagaaataccatttgacccagccatcccattactgggtatatacccaaaggattataaatcgtgctgctataaagacacatgcacatgtatgtttattgtggcactattcacaatagcaaagacttggaaccaacccaaatgtccaacaatgatagactggattaagaaaatgtggcacatacacaccatggaatactatgcagccataaaaaatgatgagtgcatgtcctttgtagggacatggatgaagctggaaaccatcattctcagcaaactatcgcaaggacagaaaccaaacactgcatgttctcactcataggtgggaattgaacaatgagtacacttggacacaggaagaggaacatcacacatgagggcctgttgtggggtggggggaggggggagggatagcattaggagatatacctaatgtaaatgatgagttaatgggtgcagcacaccaacatggcacatgtatacatatgtaacaaagctgcacgttgtgcacatgtaccctggaacttaaagtatagtaataaaaaaaaaaagaaaaaaaaagttgttggttaaatagtctctgctaaatttgcgacacatcttcccagataagattcttctctccgaacctttttttttttcctttttttttttacacagagtctcactctgccatccaggctggagtgtagtggctcgctgcaacttctgcctcccaggttcaagtgattctcctgcctcagcctcccaagtagctgggactacaggtgcatgccaccacgcccagctaatttttgtatttttaggagagacagtgtttcaccatgttgaccaggctggtctcgaactcctgacctcagttgatccacccaccttgacctcccaaagtgctaggattacgggcatgagccaccgcacctggcctctctgaacttttttaccagtatttattttaattttggttgggggcagtagagagatgcagaaaaggaaaggaaggcatgaaactgcttgagaaatacatcagtgaataaaagttttttaacatttgtggtgtaatgacaaatcctggagaagttttagttcacacctggagtattccagcagaagttggatgccagccgctaggcattcattctgcagaggggcttctctgttaggtacaaggttgggttcaagtaccttctgaagtctagctcagtgtattttttggagtgtagtatactaacaggcaagaacaagaagtggaggagatgtgccaggggaggaatagtgatgacgttgtaggtgctcagctcccagatgatgggaaaagtgtttcatggcctcacacatcttttgggttttttgttgactgtctcccccattactcaatgagctgctacagcatagggaatgaatcttcaacttgtatttccagtacccagaacagaggcttgtactaagaaggcattcaattggtatgtaatggattagaataagttgaattgaagattgaactgaagtcaaaatctgatttctaaggttccttctggcctgaaaattcagactcctctgatttcaaccataacagcctggctaagcctccttgagagaaaccctgtgcttccttagtttaaccacctctttgtggttgaatagtataggttttcaatcaagtcctaggagggtgtcagtttcttgttgtacttaccaggatgtgataggatttcaaacaaggcccaaaagaatgtattttcaggagttgagatgtagccacactttctacatttacaatggcctgaaatgggttacagtttagaacaagctttcttctttatgatgcacaggatttctatgatgggtggctgttaggcaatgagtgtgatgggggagcattttcaatcttagctcaccttagcacaccttagcacaggactctagttacagggtcataattccccatgaggttagcccctgtagtatcagctactttgtatgtgatttaagccagtactgattattctcctgcttagggagaagcggtagaaggcccttggaactgtgagttttgcattccaacttgctaattcaacatagatcctaattccttaaatgcttgtaattagaaattctcgtgaactgtattggtttttgtcaagcaatctgtttggggaacttgaccaactggggcactgctggctagggtgaaatttatttaatttgtttttatgacattcttcatcttggaaatggggttttcaaatattgctttcccaggcatcattacttatttgctggtttttatttcaggattgggactagctcagggtgccagggaagcgttttgtggtgctctatattagagtcgtaatatccaagaaaattgtctgattgtatgtggtatcttggatgtggtaccttatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaatctctgttcactttagaattcacattgaacatgagctgatccaattgctacagccttggcagtgatagaggcaggagacagccaaatccctaggcagatagggaaaggtccccggagaatctccgacctgccccacaagtgttgacaccagatgttttgtgcagataagggaacctgcacagggggcttgcctgggcatgcccacagcatactggaggcccactgggggaatgggatggagccactaggagttcacaccttatgcaggggtggagcctggcctcatcagttcttgtgtggtggccctggtattcaattgtgagggggaaacctgcttggaggacccctctccttactgagagctttcttttcacttaataaattctgccctcttcaccctttaatgtgtctgcatgcctaattcttcctagtcatgagacgagaacctggatttaactgagccagggagcagaaactcctgcatcagtagcaattttacaactgtttattaaggaatacatcttgcccgaggaggttttatattgtatccctcaaatggctattttcccctcctccgtttaaatatttttactcaagtggtttccttcttttggaatgccagtcaactccatctcctacttgatttccaagaccgtctcctccaagatgcctctcctgtctcccctttccatacaatagaatttatgggtttatcactgttagtaccaagggcttcatcatctgctctcttatgttccctgcttgtcaaggtgtagcttattgtagggttcaatgagctgctagccactgtcccatttgactagcagatgcttgagaaaagcaagtacacagtttggattcgatcctacagtgtcttacatagttcttggcacctgcatgtttgctctaggaacaaccttccttattataccgagctgatccttttgggcagcattcattgagtcaaatggcctgtgtgaaacggggtctgaccctaagtggacagagctgagaggttagagctgaaggactcaagccccagacttgctacagattagtagggtgacttccagttacttcagttttctgagtgtagtttcctcattttaagctttgtaaatattaatatctggcatacataatttgaaaaaatgctgtaaggattagaagaacgaatatacgtgcaaacctttaagaaattataagtgcaaacacacgtagtacatttccatttttagagcttcatttttttcttatctgtaaaatagacatgtaaatgcctacctttcttattgggttattgtgaggattaagtagaataacatatgtggaagtgcttagcaaataggaggtgtttaataaatgttgcctggatatgaattcccctctcgggactgtcctgatgtgaggcttttccagcccttgggggatgtgcatttaaatcaggctgcttgtaccttggattaggcaacttaaaaaaagtgtagccttgttagttccaacttctcagctataaaatgcagagtaattaaatttgctagtaaatgtttccaggcctttgaatggcagccaataaaaaggactaaatattattcttttagaattcatgtccttgatgtagaggaaatatcatatttacttacacatactcctgccttggctttttagaagaaaactaagaaaaatgttttcccctctacatttcccacttgaaggtgttatctgtattgaaacagcaatgacagctgccagcaaaggagtgtgatttttctttgccaaggtaaaccaagggttaacatcaaggagtgttggggcccctgctggtgggctggaaccagagctaattccttagcagtcactcactcttctgcctcttcagctgtctctcacccccctcccaccataaaggagtgggtgttccttcaggactgtgcactcgcctccctccctctatccctctttttcccacccacacatacttcccagaacctctccaccctgtggctgatttatctttcctgggaccaaaggcaataaagcctcaaaactaaaacttgcaaggaaagacaatcctaatggtaaacacctaacccgcaatgctgattacttgaaaataagctgttattctgtctccagatcacaaatagcctcacttaaagctctacccctgaaagaactactgaaagattcaggaaggtcaggagatccagattccaattaacttagcacctgatgcctgtgtaactctggatgggtctcagttctctagtagttgaggactggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacctgcattttggaagagaggtatttcaggatcttctcattactgaagcctctcattgtaggaccatggtcatttttaaatctcccacattgaaatgaccagttggcaaaaaccttcaattacaaaatctcttccaaagaggctgagttttttttttttcttggatcacttcacatccttttgaataccctgaggcagtatttttatgggctaacagcaaacagagtgtcgtgtagaaccaagtgtgtcccttcactttctccaccccctgcaaagtttgtgatcttcaaagcatgctggattttaaaataaaacatctacttctagtccaagcctttggctgtagactttgggcttaagtgtgtttttccacagaggtgttacatccccatttctatcagctaaggaaaatgaattcattcaaggtctcccctgccattcatcgaggctccccaagaggagctttccagaaagatctgtgccaattgtaaacttacaagatcctcagcccataacaaaatgcccagacaccttggctctgctgacacaggctgagagagataaaggaaacagctggctgaggtcctgacttttttttcacatttttttcactttttttttcacaaaggcccgctagcctttgcagactggggactttaagattgttcactacccatccagcagggctgggcatacagataccaaagctccatctccagagacgtgaactctaaccaaggatcctcaaaccacttaaatcatgaacctgaaccttgaaatgaagcaaacattacatttaaactcccatgtttaaaatcagtttgcccttttcgctcactctttactctgggggatgcataaacaccttgggtgcctgctgtgacaatcaagttggcaatacatgccacctgctggaaccatagtctccaatctgaactccttccccagctacctgtttcctgtcacaggccttggcattccctgtagcttcattgcttacctcatagaatcatgcttctcattagagagtattcaacagcttcttgtcactggggggtgcacttcatttcctctactcttggacttctgctctacttggacttcatactcttggctgtctctgaggtagaggcagagagaacatccctgactctctgctgcccattttctgccatgggccgccccccccttccagaggaggaggtgttggggaacctctcccacatggcagaacaaccactcaagtctggggaggtctttggcagtcatcttgggccagatgttgtgctagaccaagactgagctgggatttgggttttctattctcacatagccagttggaaagggtggaaacacatgtgggggtcccaaggaaccatgagagacttctcatcattactgcggagtttgactatgatctggcatcctgggctgttgtgtggaggtctctatcatgaccgacctctttggcttctcttgtgccctaaggaaggtgttttttttgctagttttgttttatgtttttagactgagtcttgctcttttgccaggctggagtgcagtggcatgatctccactcactgcaacctcggcctcccgggttcaagcaattctcctgcctcagcctcctgagtagctgggactacaggtgtgtgccaccacacccagctaattttcgtatttttagtagagacggggtttcaccatgttggccaggatggcctcaatctcttgacctcgtgatccgcctgcctcagcctcccaaagtgctgagattacaggagtgagccaccatgcccagccggaaggtgttttaaaattgaaacaaagttgcatagttggttgtgttaattgattcaaaatctttcttttttgcaggggcagctctaggccaaattcttcttgcaagtttttatggatcacatgtttgtctaaagtacacacagatcattcccaaggccagagcaggaatgctctggaagtgccctctctgatctagggcaagcctgtagtttcagggttatcgatagacctcgcggagggcagtgtacaaggcctctggctgcatgaagagaaatctggtgtgtgggactgctctcagaagcagagaggtgtagaaggctgtcaaatgcataaagacaatgtctcttcacttggaggacaatttgtctgccaaggggacggtgagatttggcttcatctcttaagaacctgcattgagggctgctcacaatttcacccgaggtccagggcaattctctcctctccagatcccatatctagtgcttgttgctgctcattcagtatatggatacttctattcttaacaagttcataagtttgtttaaccgatgactgctcatgtctttaaagccattcattcattcatccattcattctctccctcccttgtcaatcaacaaatgtgttttgaaattaagtctatgctggaatttagtgattaataagacccagatccaccaaactatgagcttcctaagagcagggagtgcatatttcatttatgcatacacagtgctgggcatatgatttccataaatatgaatggatgcttcaggcaaatgcactttaatgaagtttgccacagaggcatctaattctcaaaccaaatgctggtattttaatatcttttcataaccagaggtctgagggcatgggaaaattgctgggaaggagggctctggaataacatgatattaagatagatgcatgagtgatgacccaaagcttcttgttgtcacccatagaataacttagtttcctgtcttccctggaagaaatgtaagaggatgtgtggggctagaaagagcaacaagcttatatcacccatatagtagaaaaggagtgagtggagcatcgagcctgatcctgtgcatttacagtagcagtaatagagtaaaacagagcaattagtgcctcatgtagacttggcattgagcaccccatcgcaaaatagccatgttacatatttcagtgtttaccagtgacaacgttttcctcttctttatgatttttggttcctgagatgtttaactggccttaatgcagttttgagagattgcaggaagtgatgggctgggttgggaatggctgggcattcaagtgatttagccatgggactcagcagtgcattgcttttactcctgaaggactcttggaagaaagctctgggcctctgcagagctttgatcagcttgttcagaaagagagcgttttatcgattttatcatggttacctttttttattgttaaaagtgtctatgttgtaaggcctctttgtgtgataaaattctgaaatgatctcacattgatttattttttcctgctttcaaaacacagcaatcttggtagtttcttagtatcccaaagggataaggagtcagcttctcaataaaccttttctggttatgaacactgtatgtattaaataataagcaagccttacagagtttatatgatcacattaagggatctgttaaattccaagagttattgttatgtgtgcaaaatactacagaagcacttgattttgttccagaagcactctgctgggaatgagtgcatattggttctagtgactctgccagtaattagctgtgacctttggtaagtcacttctcctccattccctcttgcatcctgatctgtaaaacgaggagtctcttagtcccttctaagtccctcaccagctttaacattctgaggcttaaaaaagctcataggagacaggctgttctttgcaatattttccatacaggtagtataaacaagtggagaggtaattgaaagactgactttcaaaatctagtacaaggaccttatttatatgggattttaaactgatatcttgagtcggactatgaatgactacgactatcaatcagttatctgcaccaataaaggacaaccgatgtgaatcatttggagatcttcctactcccagtagatgcaggtttcgtgccccagaataatactggaatgtgctcatgtctttagcacataccaactaatcttggtgagaagtgaccccctaaaaaggtgttggaaggcaagggaacacagtggctagagcttaacacatttgttggaaagaagagcatttttacactgctgacaatatgaggactatttgttttcttattttattattatacttttaagtattaagatacatgtgcggaacgttcaggtttgttacatatgtatacacatgccatggtggtttgctgcacttatcaacccgtcatctacattagatatttctcctaataatatccctcccctagcccctcactcccccaacaggcccccgtgagttatgttcccctccctgagtccatgagttctcattgttcacctcccatttatgagtgagaatatgtggtgtttggttttctgttcctgtgttagttcgctgagaatgatggtttccaacttcatccatgtccctgcaaagaacatgaaatcatcctttttctggctgcatagtattccatggtgtatatgtgccacattttctttatccagtctgtcattgatgggcatttgggttggttccaaaactttgctattgtgaacagtgctgcaataaacatacgtgtgcatgtgtctttatagtagaatgatttattaccctttgggtatatacccagtaatgggattgctgggtcaaatggtatttctggttctagatccttgaggaattgccacactgtcttccacaatggttgaactaatttacactcccaccaacagtgcagtgtaaaagcattcctatttctccacatcctctccagcatctgttgtttcctgacgttttaatgatcaccattctaactgggcatgagatagtatctcgttgtggttttgatttgcatttctctaatgaccactgatgatgagctttttttcatatgtttgttggccacataaatgtcttctttggagaagtgtttgttcatatccttcacccactttttgatggggttgtttgtttttttcttgtaaatttaagttccttgtagattctggatattggccctttgtcagatgggtagattgcaaaaattttctcccaatctgtaggttgcctgtaggttgcctgttcactctgatgatagttttttttttgctgtgcacagctgtttagtttaattagattccgtttgtccattttggcttttgttgcagttgctttcggtcttttagtcatgaagtctttgcccatgccaatgcctgaatggtattgcctaggttttcttctagggattttatggttttaggtcttatgtttaagtctttaatccatcttgagttaatttttgtataaggtgtaaggaaggggcccagtttcagttttctgcatgtggctagctgttttcccaataccatttattaaataggaaatcctttccccattgcttgtttttgatagttttgtcaaaatcagatggctgtagatgtgtggtattatttctgaggcctctgttctgttccattggtcaatttatctgttttggtaccagtactatgctgttttggttactctagccttatagtatagtttgaagtcaggtagcgtgatgcctccagctttgttctttttgcttaggattgtcttggctacatgggctctttttttgttccatatgaacttgaaagtagttttttccaattctgtgaagaaagccaatggtagcttgatggggatagcattgaatctataaattacttcgggcagtatggccattttcatgatattcattcttcctatccatgaaaattgaatatttttccatttgtttgtgtcctctcttatttccttgaacagtggtttgtagttctccttgaagaggtccttcacatcccttataagttggattcctaggtattttattctctttgtagcaattgtgaatgggagttcactcatgatttggctctctgcttgtctattattggtgtataggaatgcttgtgatttttacacattgattttgtatcctgagactttgctgaagttgtttattagcttaaggagattttgggctgagacgatggggttttctagatatacaatcatgtcatctgcaaacagagacaattcgacttcctctcttcctatttgaataccctttatttctttctcttgcctgatttccctggccagaacttccaatactatgttgaatagaagtgttgagagagggcatccttgtcttgtgccagttttcagagggaatccttccagcttttgcccattcattatgatattggctgtgggtttgtactaaatagctcttgttattttgagatacattccatcaatacctagtttattgagagtttttagcatgaaggcatgttgaattttatcaaaggccttttctgcatgtattgagataatcatgtggtttttgtcattggttctctttttgtgatggattacgtttattgatttgcatatgttgaaccagccttgcttcccaggaatgaagctgacttgatcatggtggataagctttttgatgtgctgctggattcggtttgccagtatttcattgaggattttcacgtcaatgttcataaaggatattggcctgaaattttctttttttgttgtgtctctgccaggttttggtatcaggttgatgctggcctcataaaatgagttagggaggcgtccctctttttctattgattggaatagtttcagaaggaatagtaccagctcttctttgtacctctggtagaattcagctgtgaacccatctggtccttcgttggtaggctattactgcctcaatttcagaacttgttattggcctattcagggatttgacttcttcctggtttactcttgggagggtgtatgtgtccaggaatttacccatttcttctagattttctagtttatttgcatagaggtgtttatagtattctctgatggtagtttgtatttctttgggatccgtgatgatatcccattgatcattttattgtgtctatttgattcttctctcttttcttctttattagtctggctagccttctatctattttgttagtctttaaaaaaaaaatacctcctggattcattgattttttgaagggtttttcgtctctctatctccttcagttctgctctgatgttagttatttcttgtcttctgctaggttttgaatttgtttgctcttgcttctctagttctgttaattgtgatgttagggtgtctattttagatctttcccagtttctcctgtgggcatttagtgctataaatttccttctaaacactgctttagctgtgtcccagagattctggtatgtagtgtctttgttctcgtcggtttcaaagaacttatttatttctgccttaatttcgttatttactcagtagtcattcaggagcaggttgtttagtttccatgtagtcatgaggttttgagtaaggttcttaatcctgaattctaatttgattgcactgtggtctgagagactgtttgttatgatttctgttcttttgcatttgctgaggaatgttttacttccaattatgtggtcagttttagaataagtgccatgtggtgctgagaagaatgtatattctgttgatttggggtggagaattctgtagatgtctgttaggtccacttggtccagagctgagctcaagtcctgaatatccttgataattttttgtcttgctgatctaatattgacagtgaggtgttaaagtctcccactattattgtgttggagtctaagtttcttcataggtctctaagaacttgctatatgaatctgggtgctcatgtactgggtacacgtatatttaggatagttagctcttcttgttgcattgatccctttatcattatgtaatgcccttctttgtctttttgatctttgttggtttaaagtctgtttcatctgagactaggattgcaaccctttctttgttttactttccatttacttggtaaacctttctccatccctttattttgagcctatttgtgtctttgcacatgagatgggactcctgaatacagcacactgatgggtcttgactctttatccaatttgccagtctttgtcttttaattagggcatttagcccatttacatttaaggttaatattgttatgtgtgaatttgatcctttcattatgatgctagctggttatttttcctgttagttgatgcagtttcttcatagtgtcgatggtctttacaattttgtatgtttttgcagtgactggtactggttattcctttccatgttagtgcttccttcaggcgctgttgtaaggcagcctattggtgacaaaatctctcagcatttgctcgtctgtaaaggattttatttctcctttgcttatgaagctcagtttcgctggatatgaaattctgggttgaaaattgttttcttataatcaatagcttaccaaccaaaaacagttcaggaccagatggattcacagccgaattctaccagaggtacaaggaggaactggtaccattccttctgaaactattccaatcagtagaaaaagagggaatcctccctaactcattctatgaggccagcgtcatcctgataccaaagccgggcaaagacacaacgaaaaaagagaattttagaccaatatccttgatgaacattgatgcaaaaatcctcaataaaatactggcaaaccgaatccagcagcacatcaaaaagcttatccaccatgatcaagtgggcttcatccctggtatgcaaggctggttcaatatatgcaaatcaataaatgtaatccagcatataaacagaagcaaagacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatgtccttaagctcataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgctatctacaactatctgatctttgacaaacctcagaaaaacaaacaatggggaaaggattccctatttaataaatggtgctgggaaaactggctagccttatgtagaaagatgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaactgcaacaaaagccaaaattgacaaatgggatctaattaaactcaagagcttctgcacagaaaaagaaattaccatcagagtgaacaggcaacctacaaaatgggagaaaattttcgcaacctgctcatctgacaaagggctaatatccagaatctacaatgaactcaaacaaatttacaagaaaaaaaacaaacaaccccatcaaaaagtgggcgaaggacatgaacagacacttctcaaaagaagacatttatccagccaaaaaacacatgaaataatgctcaccatcactggccatcagagaaatgccaatcaaaaccacaatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggataaagaaaatgtggcacatatacaccatggaatactatgcagccataaaaaatgatgagttcatgtcctttgtagggacatggatgaaattggaaatcatcattctcagtaaactaccgcaaaaacagaaaaccaaacaccgcatattctcactcataggtgggaattgaacaatgagatcacgtggacacaggaaggggaacatcacactctggggactgttgtggggtggggggaggggggagggatagcattgggagatatacctcatgctggatgacgagttagtgggtgcagcgcaccagcatgacacatgtatacatatgtaagtaagctgcacatggtgcacatgtaccctaaaatttaaagtataataataataaaaaaaattgttttctttaagaatgttgaatattggcccccattctcttctggcttgtagggtttctgcagagagatctgctgttagtctgatgggcttccgttgatgggtaacgcgacctttctttctggctgcccttaacatttttttccttcatttcaaccttggtgaatctgatgattacgtgtcttagggttgctcttctggaggtgtatctttgtggtgttctctgtatttcctcaatttgaatgttggcctgtcttgctaggtcggggacgttctcctggaaaatatcctgaagagtgttttacaacttggttccattcttcccatcaatttcaagtacaccgatcaagtgtaggtttggtcttttcacatagtcccatatttcttggaggttttgtttgttccttttcattcttttctttttttttccaatcttgtcttcacactttatttcattaagttgattttcaatctctgatatcctttcttctgcttgatcaatttggctgtttatacttgtgtatccttcgtgaagttctcatgctgtgttttcagctccatcaggtcatttatgttcttctccaaactggttattctagttagcaattcctctaaccttttttcaaggttcttagtttccttgtgttgggttagaatgtgctcctttagcttgaaggagtttgttattacccaccttctgaagcctacttctgtcaattcgtccatgtcattctccttccatttttgttcccttgctcgcgaggagttgtgatcctttggaggtgaagaggcgtgctggtttttggaattttcagccgttttgtgatggtttttcctcatcttcatgaatttatctacctttggtctttgatgttggtgagcttcatatggggtttctctgtggatgtcctttttgttgatgttgatgctattcttttctgtttgttagttttccttctgacagtcaggcccctctgctgcaggcctgctggagtttgctggaggtccagtccagaccctgtttgcctgggtatcatcagcggaggctgcagaacagcaaagattgctgcccgttcattcttgagtaatgtttagcaggcatagtaagccttcttcaatatttaattgtctgcatactgatggatatttttagggatgaagataagtggttcttgtttgcagtggatacgatgcttatgaggaaagaagagctctttttaaatagagtctcttgggtagaaactcccttgattaagttcctgaagtcttttactttgctgatcctcaattcagtttcatcagctcacccagagtttatcaaactttggaggaatgattttaagaaccaaatatggccagatgcagtggctcatgcctataatccgagcagtttgggaggccaaggcaggaggatcacttgaggcaaggagtttgagaccagcctgggcaacacagtgaaaccccgtctcaaaaaaaaaaaaaaaattaagttagctgggtgtgtcactgtgcgcctgcagtcccagctactcgggaggctgagttgggaggatcacttaagcccaggaattgggggctgcagtgagccatgattgtgccactgcccttgagcctgggcaacagcgtgagactctgtctctttaaataaataaatatgtaataaaagtggaaaaaacaggcaaatgtataagtcactgatctataactctaacgtgatagtttgtttatttactaattatattgccaactgacactgattgctcagacccttaagaggcactcttgtgtgaggatttcactcaagacaccaaattacagacagtgaatgttccatggagaacagagttgaaatacttccatgcatattgtctctgagaaaaccacctcttttccaggagaggttgttctgcagagggtgccagatcccaatcctgaagaatccaaacaccttttgaaattgtattctggggctgaggccctgcttgttcaccttgatcagacaggtgaatttcctcagcttcctcagccattgatttctaaatgatctcttactttgaggtgcagataagctttcttgatgtagatcctttccattttccttgtaggtacttcgtggttcaaactttcactactgcaactacggttaccataaagtgattactatgtgctagattgtgtactaagtgctttccatgaaatatttagttgtcacggcaaccctacacaggtctggccaataaacatttctgcaatgatggaaatgttttataatactagcaccacctaactctggtagccattaacacatgtgaatattgagcattgaaaatgtttctagtgtgactaagaaactaaagttttaattttgtttagttttgattaattaaaatgtaaatagctagtgtggccagtagctatggtattgacatgatgcagatacaagtactttgattctcatattacatgtagagaagctacagttcaaagaaattaaataattttctcaaggtcacagaacttgcaaatggcagagcaaggatttgattttgaagtcagtgtccttatccctatagtgtatggccactatttagactgtgcctgctctttttgtatccaaatttgttaagaaacacctctggtacatttgcaattaaccattgaaagaaataaaactgataattatacaataaaggacaacagtcattaaaacagcactaccctggtcccaaaatagaagtatggctaatggaacagaagaaaaaatgtacaggtatgaaaatagatgttcttgtgttatatttatattcttatattactgtgatgaactgagcatcacaaaagaataagaaaggaagagctatttaactaatgacttgggaaaaactggttatcaattaaacattcataagctcccaacctagtatattgtatgaaaatatatttcaaatggcataagattcaattattaaagaacaaacttgtttaaaaaatcaaatcacaagaaacagcagaaaattcatttaagaaaccatctgttccatggtaagttctgaagaaatcatgaaggaaaaaattacagatttgactgcttaagaaataaagactaatgaacaataaaaatatacatagaataaaaaggataacagatttggggaatatttgcaacgaataagaaagacaagggtgataattacattatcaataagaaaaccttaagatacccgggaaagttaatggaaaagaacgtgaacagacagttcacacaccagggaatataactagtgattgagcttatggggaatagttgaattagggcttttcaaagaggtacaaattaagtgatgacaagatagcatcttatgccttttgaattagcaaacatttaagaaaatagtaattctttgtgttgaagataaggcagaaaactgctgtatatgctgcctgcggcagctaaaattactctgatttaggaagcaaatttgatgaagtaatcaagaaccataaaaatgttcattcagtctgacttaataatccgcccctgaaaatttatctgagaaaaaaatcctaaggaaaattcacctccttttaccatcaaacctttaaagtagaggaaaggccatatattaaataatgtgaagattttaatttatagagttagccctaataaggaaaggaagggaagcaatctaaaatgctgagtcattggtgaaggccattaaatatattatgacacatatactctgtagaatattatgcatctgttaaagtgataattatggccactgtgtagcaacatggaaaatgtttataatggcaaacgaaaaacagcaggatacacatttgtatcttgtctaaaatttcaatcctgtcgaaagatacacatgagggccaggtggtggctcatgcctgtaatcccagcacttagggaggccaaggcaggcagatcacttgaggtcaggagttcaagaccagcctggccaacatggtgaaaccccttctctactaaaaaaatacaaaaattagctgggtgtggtggcatactatgactgtaatcccagctacttgcgaggctgaggcaggaaaatcacttgaacctgtgaaatggaggttgtggtgagccgagattgcaccactgcactccagcctgggtgacacagcaagactccatgtccaaaaaaaaaaaaaaaaaaaaaaaaaaagatacacatgcctaaggacccagactggaagggaactcaaggcaaacaaaaacagttggtatgttagggtcatgggacttgtttttatttttatttacctttgtcctattttctcaataaactcaaactagaaatggaaacacagtcacagaaatgaaggatattcataaagcattgtttcctgttggaagctgccttttattctcctttgccctcagacatgtactcctcattttgatgagcagcaagtgatcagaattatccagccttcagtcaaacataatctgtagaagaaagcactgctttatgcaaggagatttactgtgtgatggttggcaaaagaaaggatgcacaaagactctgtgtgggcagatttagcagaggtactgaaagtgaaaggagaggccatctggtagaatgtgctgtggcaaattaaactgagttttatgaacatgaaataccagaagaaaatccaaatgccctggacttggaaaaagcccatctgaggcaccataaaaccaatcaactacagactgacaatatgccactcataagctcagatatgcccattactagggacagcatcattcaagccagattttgcagagctcatttgatgtggatttcccgtaggggaaaaaatcaacaaattacccaccgtgtcccccacacatgcgcagatgcctgatacagagctactgtttcaataaatatggtaaatgcataatgatctggaaggcattggtttggcttctcctgcctcacattcattagtgaactctgacacccaaaccagacaactagacttgggtatggatataaggagccatttttccctccctccctccctcctttccctgcttgcctttctcttttccctcccaattattttcattctttcctctcccctccctccatctctccctccttctctcccttccttccctctgtccctccctccctcacttccttccttctttccttcctttgtttctctctccctcccttcctccctcccttccttcctttctttctcgctccctcccttcctccctcccttcctgccttcttttcttcattctttctttcctgtccctccctccctccctcttcctcccttccttccttccctccttcctctgactctctccttccctccctttctttcctcccctcctcttttcttttcttcttttcctaagcagttcatatccctatcctttagcctgtatgtctggaattctttatagttccactacacttgccccctcattttgtcctaatgttcctccaattctccatttcctctttatttttactctggggctctttcgagtgcatgtatcctgcatattcagctacttctgcttttcctcacctttaatgctttgattgcttccattagagtgttgataattctgtcatgatccttgtctgtatatagttcttccttatatttcaagtccctttatgatagctctgctacaagtgtgttttcaatggcactgtagttctgctgtggctttggggctgctttggttttctttggaaggagatagctacatgggtagcttgattgaggaagggcacaaaagcagtctaagtgtttgaaggactgtctctgggaagaggagcttagctattcccatgtggctagaaagggcacaacaaatcccactgggaggtgtacttagactctgtaaaaggaagcacattctaatatagcaggtcaaagactgaatgggctatttccagggccgacatatctgggtgttcagtttgtgcattgtacaaagacacctggccgagaaaatgaatgggagctgaaatgcagcccgtgctttgctcactaagccctgtgctctggagtgaggccatgccgacctagaagaacgggtgccaagataagttaccttttgatattccacataaagacaccagtatgtgctagtggtagccctagctatcccaggaggggatattgtctactgttgcagaacaagggagagaatagatgaacttgtgtgctagaggaagtgcttgcctcttctccaccatctccacatttcctggatgtgctttgattctattgcactgccaaacaatccctttttctaaacttgtctgtgccaatcttgtgtcttcttatctcacatatgctaacaacatccacattaagactctcaacttccccgagatggataggtgccatcacataccgtgctggattgaattctcatttcagagaatacatcttctttctacttttcaatgaggatcagcatcccattcttgcccaccacctagtactttgttaggaacacaggaggtaaggcaaactgaaagcactttgaaaactgtgaagaattttttcatcaatatcattagacaagatcctgttacaccaggaagtcaagaggctttactggcatttagtgcctcttgtttcaccatcaagattccctgtctacaacagttcatagctgagtctctattcatcaaactttctgcagggttgacatacacaccatttatttggctctcagtgtataacatttggtggtgagtcaccctttcctgtgtacatcttgtttaccccagatagactgtaagctcctggaccaattcaggaaaccacatactggtttcctggtatggaaaggaaatgttttatttcagaaagtcacttctctccatgagcaaagaacagtgagggtcattttaaactgttgtagctgaattccaaatggcaactgagatggtcccaagatttgggccatgtcaatttagggagtaggtaattaaaggcagtccaacaatttcacaaatttatagttaggtgccatgccgtgcactgtcttggaattcctcacaaggacattgtgtaatgtatactttttgaattcaattgaatttatccttccttccacctttcctcccttccttcaacaaatattcattgagactgtactatgtttcagtctttgttccaatgaacctaaacagacaaaagtctgtgccgtcatggaactttctattcttgtccagatctgccatttactagttgtgtgtagactcaaccaaatcacttccttctccggaccaagtgtgttcttctgtgtacactgaaggtttcacagatgtttccatttttccttcctattattttttctttaatcaacctccgtacttttaattgctttcttggttatctatttttgcctaatatccagtactgtaaggaaaataacaaggatgtactttttcttttcttttttttttctttttttttttgagacagagtctcactctgtcgcccaggctggagtgcagtggcgtgataacggctcactgcaacctctgcctcctgggttcaagcaattctccttcctcagcctcctgagtagctgggattacaggcgcccgccaccacacccagctaatttttgtatttttagtagaggcggggtttcaccatgttggtcaggttgatctcgaacccttgacctcgtgatccacccgccttggcctcccaaagtgctgggattacaggcgtgagccaccgcgcccggccgaggatgccctttttcaatggttcacctttgggtatttttatatctatgtttgcctagatcattcctttgttttgatatcatcaatttgtttagcccaaagataatggctgttgtatttccgtcttgagtgccaagctcacaatgagctgttactcagtttttgaagtattttctcccattataacatcaaccttctttcatttatttcctttagtcctctgtcctgagagcatcccccagagttatagccttggattctcaagctgcaggagattgcatgtttaaccatgataaatactcaggacaaaattgagcctttttttctctcataattttatttgtttaaatcttgactgcttatagtaaatatcctctcaaagataatttcatttccaaacaatttggtacctgatctgacgcagcttgagtgtttattttggggatgttgtttttcttttttaatgagttccccaaaatagcttttattgtttttacatctttcttttttttccccgggctatcagagggattgtagttagcattgctggaggattattagtttattaataataattatctcttaaatttcttttttggaagcagcatttggtcattattgaaaaaacagagcttttaaaaaatggaatgactttaaggaatctgaagaaaagataaatgtactcctgtatgatttttatagtgtttgcaatccagtgatcattctcacattgtttaagtttcagtttcaaggtgcgttgtccccctttatctgtggggaatgtgttccaagacccccggcggatgcctgaaaccctatatatactatgttctttcctacacatacttacctatgataaagtttaacttataaattaggcacagtaagattaacaacgacaacaataaaatagaacaattataataatatgctgtaataaaaattatatgaatgtagtctttttctctcagaatatcttatactgtgatcacgtatttcctgactgtgagtgaccatggctcactgaaaattgaaagtgaaaccacagataagggtggggactatgatagtaaggtaagattggtattaatatattgtctgagcaaggcaactaaatgtgttccttttggaatgcatactgttacaattcaggtttaattattaaacagcattggtctaagtggatgaaggttctgttttcgacccataatttaacacatgtcaagtttaaatgtacacagtaactcaaaaaacggcctgcctttggttgttgtttccaggatactgtgagcattgcaattagcaataaggaaagcactgaccaactcccggaaccacatctagttgcctggcatggaaaggaaatgcttttattttagaaagtcacttctctgcatgagcaaggaacagcgagagtcattttaaactattgtagttgaattccaaatggcaactgaggtggtcccaagatttgggccatgccaatgtagggagtagaggattaaacacagtccaacagttttacaaatttctagttggtgggtggctgggaactgtttattattgttaatgttactgaaaaatcacttgtttcgtgttaatacatcatcccttctccagtcctccagccccagtgaattttgtgttgatatagcaatgtgttcatagtgccactttactgaatcagttgttaaacaaatatttgtgccatacctactattttacagacattatgtcaggcactggggaatttatgttggtgaataaatagacatggttcctgctctcatgaaacttaaaatctggtctttttaagcaagctatttcacttttctgagagtcagtttcattatcttaaaataggcataatgcctatctggaaggattgtggtgagaataaaatgagactatgtctataaagcactggtgtgatgtttggcacatagaacatggtagaacctcaacaaatgatggctcttataatcattgtgagtgctggagagccccagtgctggtctatggattgaagagctatcgaagaggttcttgctgaaggttcaccccttggagtatctctactcaatccactgagtgggaagatttgaaggtaacaggctacgggggttgaacttttcccacatggacattttaaactcagttcaaatacatttgaatgagagagcaaagtacattaagcacagaatttctagaactcaccttgggaaatttaaagctgaccattttctctagcattttggaaattatcaaaaggccagacggaatgcacaattcacttcttggctgccaggagtgaaggagagaagaggtgaggttgaatgatttgaaattcagttcgtctgtgttagaacaagtcaaaacaattctagctgttaattttagttagttgagtccagagtaaaggtttgtaaagggcataagaaagcaacattacttttttctcacaatgagcacttaaaagatcttttaaaagtgtttctgtaatgtaaaagaaatagtcttactgcagtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgattcacttacaatcataatgtagggcttgatgtaaaacatgagaagacttgatgtttctgggtaacaatgggtgcagctcttgattattcatagtctgattatccttactggggagtatcctgtctcattttacttcttgttgtctgaatgcctaccttttacctttgtaaactccagatttaaagtttgtgtagggtggggtgcggtggctgacgcctgtaatctcagcactttgggaggctgaggcaggaggatcgcttgagcccaggaattcaagacaagcctgggcaacaaagcaagagaccatctctaaaaaaaaagaaaaaaaaaaaaaagccaggcaccctagcacacgcctgtagtcccagctactcaggaagctgattcaggaggattgcttgagcccaggagttggaggttgcagtgagctatgattgcatcactgcactccagtctgggtgacacagcaggagacactgtctcaaaacaagaacaaaaacaaattttgtttaaaactgaaaatggggggatagatggaaactattttactttttatcttaacagcttgtgcaggtagaacagtttaatgaggaaggagctgacactcttgcctatggtgtgttgggagattatagattttagttatccatgtttatgttgtaccccaggactacagattattggcagctggctataaacaaatgaccaaataaatctacagttgaagttacctagtgtctccaagatttcagggatgatcaaggacaggtagcagagcctggggccatcagctgtgtgttggcctcatctcattctgaacccctctcctactttaatcagaaccctgatacttaagggactgaactagctgtgacatccatttatccattttatagaatggctgtaggtaactacagggccataatcggaattctatacagggatgggtccctaggctcattaattgatgacagggtaggagaagactttgacacctacagattcattagagacagctgaatggatttattccaaggaggtcacctttgaaaacgcaatgaatttctatgggtggataacaatgcaaataggcaaggatgaagctttagatttaatctacatctgctgcaacaatgttctgatatagaattgtttagcccaagtcctaattgaaaaggtgagtaacattgatattgtctttctgaaatggattagaaatagggctggaaattggatgctaggaagagggacatataaggtttatgaggtaaaccccaataaatggaatttactatgattatattaaaaatagagacaatgtcatgtttatacagcgtgtaatatcatgcataatgtcaaatgccctttggagttactcctgtcccttgtactgataacatggcagttttttgagtcctagcatagggaaacagtgaaaatttccaggagtgcatcttttcaataatgcaaaggatacatatcagtgtttcacaaatttctctcttttttttaagagacagggtctcactctgttgcccaggctggagggcagtggtgcaatcagctcactgcagccttgaactcctgggctcaagcgatcctccctcctcagcctctggaatatttaaaactacaggcgtgcatcaccacacccagctaagttttaaagttttttgtagagacacggtcttgctgtgttgcccagactggtctggaactcctggcctcaagctattctttctccttagcctcccaaagtgctgggataatgggtgtgagccaccctgcctggcctcacaaccttttgaaaaagatcatcccctaaggaggaaattcaatttaaataatcctaatgagagaacttaaatactaaggaaaaagatttaggggaggaggattggatgtgaagggccacaatctactgtaatatctttttttttcactttccccccaaatcaattttcttccccttatggacaatatcacccttgttggaaatgcatgatatagatctgtgaagccagccaatttatgatgtgatatttaaattgtctctggttatggatattgtttccattgcccacattaaccctcaagaggagggcagtaatgccaattaagttcttgctatgtgttagatcctttccatgcattgtttaatttcacccttacaacaaccctgaagttgagaagttaagcgactttcccagactcatacagtggcaagtcaggggttgaacccaggcctttctgatgccagagactagaatatttctaacacttacttatcttacgggaggcattacaagatgtgtcttacatagaaaggacataatggtgggtgtttatttctgaagttgattttggagtctctggattgcattttggttaccctcaggtagaatagaaaagagaaacttgattaatactaaattttctcttttattctctccacccctctttaatggtttgtattgtgtttcttagtattatgtggaaataaccttagcttcttgatatgtgctgagatcctaggaactcagtgacttacagcacaggttggataaggttaatattatgttaataacacagattttatagctcttctactaatctttacatagattaatgcctctcaattttacaaaaaatagaccattaattgtgaagctggaagaggacaattcatggcagaaaatgttaggttagtagaacaatagtcatttacacaggattgttaaagaaagggaaaggtaaactgatgttcaacatctagtgcttgagaagttgctctgcacataaaatcaaaccaggcagctttgacctagctcttgggagagaatatatcaggttgtattgatgatgcattgatgagaatacatcagtgtgtatgatgtgggagcgtgtgtgtgtgtgtgtgtagatgtagaaaatagcattttcttatctggactttagacttcatagttaaagtaaattatgttcatacatctgtatgtgtagacttcctacctgtgctttaacgcctctatctccacctccatccctttcttctgtctccccagggggcaatggtgcaagtaaaccaaattcgaaatgcttggtcccagtgttgttagcagctgattcataggtgctcccctcattttagataagaagaaattgagatttgcaaaagtcacacaaactggagctcagattgcctgatttgtactggtatattgcactgtctgtcggccttcactctttctgactctctgcttcttagaaaaagagagtgtgggaaaatgtgctggcaccttcatctggtggccagagaccaattctaggccagaggtaagctttaaagagaataaaaagtgaggaaaattggctcaccagagcacgtcattatttacataataatacattgactacgatgtgggctttaaaagaaaaagaaaatgaaagtctttctcacaaaatactctaaaaataaactttttagggaacattataaaaccatacaatgtattttttcccaaacacaaagtcccactgaaatctgtctcttggttttttagatgccaaaagtcaactcatcttgatgtagaaaatgaggaggtgctgttagtgcatggagaaatagccttctgctaagaggtagttgacttagtttctaacttatgttttcgtttcatgctatgtgatcttggtcaaatcattttgcctctctggactttgatatccttttctgcaaaataaaagggttcaactggatgattttgaaagcacctctctcttctataagtctctgcaagtgggaagatgattagtttgtagtcttataatgtttagatggtttaacactgctatcttctagcttttctaaaagttttctgatgttgtcataggcagttttgtgtacaaaggtcatttgatggatgctaatgtacctttggttgataggaggttcgtaaaagaaatatgcatcaaaccttattattcgtgtattagataaagcagatctactgacattttaatgtcaccaagtaagtaatttataaagtcagtgtgccccactgaaacatttccaaagatatttactattgagtacttgggttctgctgagggtgaatactgaaatgtattctttttgtgctaatgtttgcagtacagtgtttcccagcagtcagaatgattgtctgatattgttagtgtaacccctgtgatctaacataggcttctgtgattataatgatttttatttgaaaaggtaattgtgtttgcctggcaacctccccacttgattttttttctgtatacacctctttctttggctctttaaaagccagcagtagagtatgtgtagttaaaataccttcttcttcttgcatccacgtttttgactgtgtctttgcattgccattggggggactggagagttaatatgctgtgttgcctaaaggaataaaagcaaaaattatctttgcaatcaaaatattaccagaaagaatttattaaaaattacaacagagagaaaaacggacattaaaaagagatttttatctttgtttgctttttgttttattggcttgccgagctttatcagtcattaatgatgaaggaaatagaagacctctccaaacctatgcatttgaattttgtccagttatcaagctttcccctgtgcacacccaattttttttactagctcaaggacaaagagatttttctcattttcccattttaagataagctatataggaatctgggtacatttgagtatgtgaggaaagatcaaggactctgtaagcatgcatctttccaatcatggcccttttagcaatttgcagtcattggaatgtgggagtttagggagagtgctgtttccagagttagacacttcggtaattccactactttagggtttcctgccacatgctgttggctttcagtaacaagtttcagtaaggattctcttggagtatgcatagaattttcttaacaatctgtgagtgattataagcagtatattctgggctcttgtgttttcgggagttaagagacctctcttttgcagtccccaagagtccatggcgctcatctatgaaaacggcccaagtgacagccagatgaatgtgtgctgagcgccactgaggctaagtgccaggaaagtagaaggcaccaccctgtggaagagggccaggaattctagaggacactactcctttgaacaaaaaggatgtggaaaacagttttctttgtttccttttgagttagctttgggcatgggctgatgccaagcttcgtcctatgacaggctcattgccatccatcctacccaggagggatgcatctctgagcatggagacagtgctgaggaaggcaggttggatggtgcttccttatctgattatcagacaagccatattttttcaaaggaacagtgagaacagatgatctttctgatctcgtgttaaatacagtactgggcatctttagcatatgtgctttaggttattgccttcttagcctgctcagaaaaaaaacacagcactggcagcattccgtttacttactcattagaatctaagggctggaagatcccttgaaagtcatctactccaccacccacccccatctgatgcaccagctgtttctacaaccaagtcgttatccttgcctatgcatgatgttctcaaagacacggcattagaacaccttccattgattgagttgaaatctttttcccattgctgtcatgcactgatgctagctgggcttcttggaaccatacaaaacaagtctaatgttcttctctatgccagcccttcggagctttatgtcacattccagtctcacccttcctttccatctcagctgcagtaaggttgattaacctgaattaaggaagacttgagggtggggtgagaagttgcacatctgttcctctgataacatggatttgattctccctctcccttttggtccctctgatagaaataggctctagttcttccatattcctcttaacaatgttcagatgtggtctcactagtgttgatgatctccgtctttatacttaactttgattcagcagtggagtccaagattctgttagttcttttggtgatctcaccatactagagattcctattcaacttgtacttgataaaaattttattattgtctgtgcttcctctaagccactggtgctcaaccggggtgatactgtcatcccccacaacgtccccaggacatttggcaatgtctggagacaattttgatttttatggcttgggggatggtatactactggcatctaatgggtagagtccagagatactgctaaccatccaacaaggatgcacaaaacagccccccatgacaaagaattatccagcccagaatgttaatagcatcaaggttacagaaccctgcttcaagccacttgtgtccatattccttccaaattttttctctgtactgtgaaggtagctttgttgactcaagtcaggatcttttgcttattcctatttaatttcatctggttagaaatcatacagctgtagtgtttcaagaccttcttggacttgatatatatcatcaacgaacatatctgcagtacctccagcttcatgcatgaacccctcttgcttctgatggactattaataccaaattcagggaactctcctcttaaccaaaagcaaattgttttcctagactggcatgggattccatggcaggtggactgatgatcattaggaggtgctgtgctcagttttttttcttttttacatttttggtactcccagacttccttagtagagagctggtgtgatctagaatggcatttgtatcttctcccacccaattagattagcaagagagagtttagccaagcaccactgctctgcaaatggagtctccaaatgccacatcagcagaaagaaaagtatctacactcataagagcatggggtagggggaaacaaggatgcataggttgttgcttggcaaatccattcactcctagcactgttccagtgatattagttccacatgcctagacagatagagaatcactgcgactggtaggcaggtcctgctgtctctaatgggatctgttttaaggaaaaagttcttgcatctattctgatttctgtatcaggccaaacaatgctagagttgctgacttaatgaccacattggctccgctgttggtcaagatcatcagactctcatttcagctttcaatgatattgcatcctgcaaacaaaccacttgagatgagcttggtataagggtcctactaagagagttctgattaccttattcacttgagatgaaatttttcactggagtgaaattaccagacaactaaaatgttttttccaagggacaaatgtgcaatttttgatccccaagagtagaccagaggccaaaagctacagccattctaccttgcctgctgtgtttctgtggcacacaaactaagaatggtttttacctggttaaatggtaggaaacagtcaaaagaagattttgtgacatgtgaaagttgtatgaaattatatgaaattcacatttcattgtccttatggcggggtcatcagaacgcaaccacacttatttatgtgttatttatgctgctttcttgaaacaaaactagagtagttgcaacagagaccttatggcccacaaagcctaaaatatttattttctggccttttacaggaaaagcatgccaatccctggtctagagcttaatttgtgtaaaagacccttcattttgtgacttttattctgttaggggctgagaaaataaacttcttatgaataacgtatttgatgggagtcttttggtgtctgagtgtggactcaaggaaggcaccgagggcttttgagactgctaaataaggcatctatttctatatatactgtcatggtctgggagctggaagaaatactttaagaagctcaagttgccggatgggatttctggattttttatgtgcacaactaatagcctctcaacctagagttgtaaggtaacttctaatgttcatagggattttgagaattgcttcctgattaactctaagagttgttcagttatttacattctttcagtagaattcttttatacctcctatgtgccaggtaataaatgtggagacctttcccaaagctttttgtatatatttaatttagagagcttctacctcaattttgttgcaattaaactgatgctaaattatgttcttcccttttgaattatggctgattgtgtctctcatcatacatagagatgttagaaagctaagctttacatttcagctgcttatattatatatacacacatgcaacacacattcacatataattgaactaaattgacattgacattgagagaatatcccctgatatttatctatgtaatttttattcttaggattagattaatcagtgattgagactgatcctctgaatcaatctctctctcgatgaaatacacaatatgtataatgtatatattaataattataattattaattgttaatatataataattagatattataactacacatatatatttaaaatttatattttctccagaactttgagttttaaccctagagagactctatcacagcacccagaatattctattttaatagttcatttaggataccaacactggaaaactccagttttccagtgatgaataaagttggaaactttattcatctagcacgacgtatggtgctcagcatagtagatgcctctgaaatgctgattgaatggaactaaactgactttaatcgagagaatagccttgagatttctttatctatataatttttatccttaggattagattattcagtgatggagacttgacctaaaaatatggctctgtaatttcactgatattgtcaagagcttgtttatgctccatcagcatcaggtccgtgggtgttgattccacttataggagtccctgtggtgttgggagggggccagaaaagtaaagagtggtctgctggaagtcagtggattagctggagagctcattctgctgatggctgccctggtagagcaccccatttggaagtggagctgaagggagagacagtagtgatgctaagagaaatgagaggaagatgagaagggaaaaattagctcatccaggcagaacctttattaaatttagttccagatcttgagttcacaacttaaataccctgtaagatcagaaatgttattatttgtacctgtagatcaagacttagaatacaggaggatcatggctatccaggatggaagagacattggagcctctctatttcagccctctagctcaatggttcttcatctgggttagtcagtggcttccctgaaaaggctatgtgtctatgcatttttcttgagaagagattccacgctttcattattttctataggatgagtccaggaaacctccttcatccccactcccccaaaaagttaaaagccacctctctagaagatgtgtgaactcttcacagggattctgataaacaattgctgacagatctcatgtaaaccttcctataaaagcgaatgtaggatttcatgaggcagcacagctggaattgttgtgaaattattccccacattgagtggaaatttatctctatgtaactttccccaacttcattttatttgtttgttctctgctccctaaagtaactgaaagtaagttccacccctcttctatggtcctttgaatataaggacacaatttgtatgccttccttaaggcgacttccccagggaaaagagcctttccaaacttttctcatgtatttgtgctttacagactcttccctgtgttggttgttttgtctgttttgtctttgtccctcataaagtcatggcagctagaattgaagatcgcatttcgggagtgttctgaccagcacaaatcagaatgctatcatctacaatcccctcgttctaggtaatatatttctagtaatgcccaattaactagtttctgtgatagtgcctcacactgctgactcataatgaactgttgattgctaaagcctcctccaagctgcgtttggaggtttggcatgtgaatctatttatacccacttttttatatttaaaaaaggcatcacattgatgcccaaatcaggactgttatgcacatgtatgtagatgagtaagtttccctttatgaatttaaaaaaacacacacacgtcatttaactttattattcttgttgctttgcaaaatattaaggacatcttgatgctttcagaatgaacaccaaaacccatgtaagtggtataatacttaacaatgttcacacatgaaaatacataagtggtttatttaattcatgatcaattatttgtttttgaaggaattttcagcattttttatttggacattctggaaatgaaatagtaaacatgattagttcaggtagcattgagaacttttaacggatataatacttatgaagaatttatttgcagcagaaagtggtcacttgctatttataagatgaggaagatagtgtgagccaagtaggaggtggagataacctcctgccaacagatgccaaaatgggagactgccactcggggctgcctggaatgcaactgcacctagaagcatactgtgttgtatgtgtaaacaagcaagaacatccttgtgtaaatgtgtggtggctctgctccttggagaaatagaatggtttctcaacatcattttcttataaattccttgctgttaaatcagtagccatttatccagatacttgtagtggagctagagatccccctctggttccaagtctataatgaattgtggataaagactgggctggcttaaacatcccaggcatggcaggcccctcatatgggaatagagtcaccaggatctatctccttcagaggctgcttctgtcggatgcactgatgaccagtgagagtattctactgtgtgtggtaatctggaaaggcccctgccttcatccacagatctgtctattcagggcagggggaggggaggaagagaacaggccagcctggaagcactgtttctctctgtctttctctctcgggattttctgggaatcaaaaggaaaatattttcctgatagtttagcaaaacatttaattaggggtggtaatgaaaagtgattacagcagcacaatgcgcttgcattatgagttcgagttaacatatttaggggtacttgcgcacaagctgtttggtgattagggaccaatccgctgaacatgaaaataaataaataaatgaaactgctgtgtgaaaaatgaatgtgctgaaattaggctgtgtataattgcaacgaaaccaaaattgagcagatacagttcccacagagaggtggaaaaccttgtcagggagcattcgccagcctgagctgttgtttgtggctgtgtgtggaatggactcaaagcccactgtggctgctggaaagtggtagggtgatttgatctattcagtcagaactagctgatgtagtgaccgaattatctcaagtgcttcccctcctgttatgtaggcaaaacctctaaattcaatgggttggattttttctaacctttaatcatttgcgtttgatatcatgtcttcattgccagtttcctccttaacccaacgtctttcatcttcaatcttcttaaactttaaaagatacaacccttcatctttcctttgatcttcacctgatgggcatgttagctgtgtccatcagtttcactaacctatttctatgaaaacagagaaaatgtttaacctagtatgacgggcctatagattataaaaataattgactaattttgttgtaaaaaaatactactctttgtaaaaacaaatcagcaaagctggagttttgtctttataaaacatgatgcttggttgcttgcttttttcaccttttaactggctatttgggtatcaagttcaactgaagtgtacttttgagaactgtcacagtagggcctccccattttatatggtagctcaccaaactgactgctgctgccagcacccttttggtttgctcttaattctattgggagccctattgctggcaagaaggctcctcatttaattcccataataagcttcattttcagcaatgcctccctaccctgagcttcataaagagtatcatgcctgtcgattttctttacagaaaggtgagcggtacttctgttgcccagtttgatacccagtagggagattcacaagatgccaagggtcttctacagaggaggtactagaagagtatttgtggagtatatgaaggaccaaggatgcagcaactaagcaatatgtatactgattatagatattttcttgattttggggggaaaaacctccagataagaaaagcagtctcattggagacctttggaaaaatgaacaataaatctttggagctcttctaaagttggtaagtctcaagtttctcccatagttctacgtaagagtactagctcattatttctcatagaaataattgagagactgaatttccttcaaagtatgaaattgggtgattgtatgagatcatgtgatttcatttcctctgttagggctttctcaccacttgtaactagaatttaagaacaactttgttgcacttgaaaaagaattaagctctgtaagcctactgctttccactggcccactccagttttaaaattgctttgcgatttttatgaaccacccctgtgaagttaataaaacacaaacatggtatgcattatatatgagagggaaatagaaaatgttcaacataaccgcttttatcattaagaacaggcagcatacagaatgatttaagaataagtgctaatgtttatgcatttttgtacctgcacatatattagaattgacttcaattcttagtcatggccagataaggacacaatggctgtaggaagggcaaagtaggaagaagaaaaaaaggggaaggaaaggagaaatagagtgaaattaatattttatgagcttccaaaatgtatcaggcactgtactaggcattttcacacacccaattccatttaatccttaaaacattcttgcaatatacaggcttttaaaatcccaataatattaataacatgtgttaggtacttagagagaaagggagggagggagagagagggaggatgaagaggaaggggaagaggaggaggagggagtgacaaagggaaagagaaagggagagtggggaggagggaaacccaacgcttgcctcattccaaaatatttgggcttgattgactttgggaacctgcattattgatctcatgattctgagtctcccctctacctcatgcaactaaattcaattgttaaattaactggatctttgtgggtataatatcaaattagaactaaagatacttgtttcatagtcaagagccaagtggttgacccagttcacagctcttcagctgctcttactacttctgcagaggctctaatttatttattatttttttttgagacagagtctcactctgttgctcaggctggagtgcagtggcaaaatctcagctcactgcaaactctgcctgctgggttcaagtgattctcctgctcagcttcccgagtagctgagattacaggcgtgcaccaccatgcctggctaatttttgtatttttagtagagatggggtttcaccatgttggccaggctggttttgaactcctaacctcaagtgatttacgtgtctcggcctcccaaagtgttgggatcacagacatgaaccaccgtgcccggccagaggttctaatttgaagaggatactcatttgcatcttcccacttccatgggaagctgttttttaccctcctcttctggttgcagatccttatcatcttgaacaattgttgatcctcataggtaacttttttttatgtgtataaatttaaggtttacaagtgcagttttgttacatggatatattgcctagtgatggagtttaggcttttagtgtaatcatcattggaatgatgtacactgtatctattaagtaatttctcatccctcaaccccttcccacactcccacccttccgaggttccagtgtttattattccacactctatgtgcatgtgtgcacattatttagtgcccacttataagtgacaacgctaggtatttgactgtttctgagttgtttgacataagataatggccgtcagttacatccatgttgctgcagaagacataatttccttcttttttatggttgcatagtatgccacggtgtgtgtgtgtatatacatacatgtgtgtgtatatatatatatatatatatatatatatatatatatatatatacacacactacattttctgtatgcagtcatccgttgatgggcacttagatcgattccgtgtctttgctattgtgaatagtgttgtgattaacatgagtgcagatgtctttttgatataatgatttcttttcctttgggtaaatcacagtagtaggattgctggatcaaatggtggttctatttttttttttttttgaggaatcttcatactgttttccatagaggttgtactaacttgcattcccaccaacagtgtataagctttctcttttctctgcattcttgccaacatctgttttttttttttccgactttttaataataaccattctgactggtgtaagatggtatctcattgtggttttaatttgcatttctctgatgagtaatgattttgagcattttattatatgcttgttggtcatttgtatgtcttcttgaaaaatgactattcatgtcttttgcccgctttttaattggggtgtttttttaaaaaaaaatagtgacggcaggtggtatgttcctcacacttgacttgtcatttacaactgaatttttcagctcacgatattgaaatccagaaccactttttctatagtcaagtgtgattcagcaaaaaataaaaccttcttgcattcatttggaagtaatatatgtccttttggaatttctgtgtaagtccttttttagtgagaaaaaaatcaagtccaagttaaaatgataaaatactaaattcggtgttgccaagtagagtttaatttcaattcagatactataatttataattctgggtcttaggagccaaagcctccttagaccatccctttaatccaggcctatcatttggagatctcatagctcccttcactgtaatcaccgtctggtgctagatagtggaactgagatacttctttgctaatgacctacttgctttcagatacagggcaaccagcggatggttcctgggatctcatctgatgagtgacatctttccggacagaactgatgactctctggcagtaaaagggtggagagggcagggcagatatgtttcacgagcaagaagggaaatagtgtgttgtaaagctttgctgtaggcctgccaggatctggtgaagtgggtgggcggggagagcttgtgttcacagaagagtcagatggttaaagaatttatgataattaaaatgacgtttctatgtaagtctgaaggaatacagccataaaaacataattgctgtaaaacatgctgcatcagactaaataaccacttgatgatggcaactatgcctgtgccataaagaaacctgtgcttttgtgaggagaaaaaaatatgtatttattatggctatttgcgtctcatgttaattgttcacaacaaagccattgattaagcaatgactccttacaagatggggctggatcaaataatgcacagagtacagcaaacaaaaaatggttgtgagatgaaaggatgattctgagaaacagggtcaagctgagaactctctgaactctccttgggcacctgcagtcatagttctagaagtgtgcggaacaatttgaatgagagattagatctgagtttcggggttttcttttcccaaattctactctgtaaagaatggcttgcctggatatggaagaagtgctaatggagggaaacaataaggactgtttcacaggaacctgccacacagggttcctgtttgaggtagagatttagtgacactgcctgaactcaatcagagtgaagccaggctttctgcattctgctagtttcactgcaaactgtggccagtggggccagcattcagtcagaaacacctgtctaggaagtcacaaggccatttatgattagtcttcccaatctggacatcatggagcagactcaggcacgtgaatggcgtctatttacacacacacacacacacacacacacacggctatactgttttcctggacaatcatttttcccacatttcctggaggaactactggaatcacaaatcacaatttgtggcttgccctgggtaatgagtcattggatggaatttcatttggtagatttaaagagagttagtgttgatctatgaagccagatgatttaagaaattgaagcagtaacaagtaaattgcttttctcttgtactgcaaaatgctttctaggcgtttttggcttttctttttaaaatggatttataatgccatttctctccacctcacggctcaagtaaacctctttgctctgatgaatcctaaatgactcctcatttcccacaaacagattgttcaaaggagttcttaatatcttgttttacactgtggaagctagaatttttaattctataggacacacaaatgaatatacattccctgttagaggctttatttattctgactcctctcatgaaaaattatgtccaactatgttcaaattccttgaccttataatcaaggcctgccactaaccaacctaaactcacttgcctttatttatttgttcatctggaagcaataggaaaggcttagaatctgccatgtagtatgctagttgttaaagaggatacagaaaagaaaaaggatctgggatacagataagtccagctgcttccttcaagcaatttactggccattggccagggcagatatgagagtggacacttctatgagatatgttgaacctgtgttgaagtgtgtgcaaaggactatgagaggagaggagagctgttgcttctcacagcagcacctcctctacatgggatgcagagagtccaagaatgctccaaaatggccttttccatcttcataatggccttccagccttcccatttgtgggcacaggggccccctgccctagcaaccttaaggtgccctgttgccagtacccttgagactccctcatgtttacggatagattgtaaattacacatgaaaaaggtctcatattaactattttaactttacagaaaccccacagaagtgcagcccacttggtcttgagctccttgaaggcgaggactatgtgatgccacatctgtaacccaagaacccagcacaaagtgttgcacatagcagatgctcaataaaagttttaaactgctgggggaagaaagtactatgggcatctggaagaggggccagctaactccacataggggactctggagctgtgctaaaaaatgtgtggtccactgcttcacttgaagagcctaaaaaatgtgtagagatttatgagggattaataggctcaagaattcgaaagggtactccagacagctcagagctcttgcccccagaatatgtgaggcatcgaaacaggaaagtaaaatgtttctagcagatttcttcccccctccaccccagacagtcttgctctgtcacccaagctggagtgcagtgtcgcaatctcagctcactgcaacctccacctcccaggttcaagcgattctcctgcctcagcctcccgagtagctaggattacaggcgcctgccaccttgcccggctaatttttgtatttttagtggagacggggtttcgccatgttggccaggctggtctcaaactcctgacctcaggtgatctgcctgccttggcctccaaagtgctggcattacaggcgtggcctaaaatgtttataacagatttcttatcaatctggttctctaaaccacagggaccacttggtgaacctgaagttttgtgactacaaggagatacataaatgtgtatttgagttaccttcatacagctacaatttggagaaggacgtccaggaagatactgagaggagaagtaatcatcgggtactgtttaagagagccgctgtcattactgcctttactgggttggggtcagagacaggtgggggaggtgctctgcaggttgtgttttatgtaattggtgctccgtcctcctccttctgttatatcactcatctgtgcagcttttcatctcatatgtattttccaccatggtggcctttgtaagacataaggtgagcaaactgcttattaaggtaagacaatggaggccccattttaaaaaggttaagatgtcctcaaaagtgtcagcgcatcccaggaatcattaacagtgtatggaatgcacagcctggtattttccaaaggccacactaaccttttcaagcatggaacaggctaaaaggaatggatttcttcaccatttgatgagagaagaaatctttttaaatgcttatttttatttgcttgctgagaatcatctctgtgaagctcaatatggagaaatgaattctgaacattttagcaactcacttaaaataccattagaaagcacttgggttattaaaagctgaaaacaaaggactaggagccctctggcactaataacacttagggagaaagcgagagccacctatgccctcatgtttgccaaaaatgtatttgaatttaaactcttcattgttaagaagggaagcttaagttttgccaaaccctttttgcctttcagtacaaccacttttccatgtaattggctcaacactgctatttgcataattgtcatatttttctgcttcccaagagggctgtaaagcgtaaaggtgaactgcaaagctttgacaaagtgcacatttatgtgtgatgtgcaattctcaaattacgaagaaaattatatctttttcattgagtttatcttacacttggaaatgaagtattcagaactcattgccccctgagatgagtttagcctgcttttctttaacttggccaaagtgcaatttcctgagccttgggtcttcaaataatgatgttgccacaggaccttgactgtatgaatgacctaaagcagaggcatttttctttaagccgcggaataacaataagctcttttagttggaatcagagatttcatcacagctgggccatccgttaagctctgagaggtcaaacagatcatttaacctctcaaagcctcagtttgtttaactgtaaaatgggcatgcctttaactcacacatgtattgagtgcttatatgtgaggaagtattttacccagggcttggtgcatagtaagtgttctaataaacacatgatattgcctcgttcctcttcttttatagcaggtggatggcatttaaatgaatgagagggcttgaactttggcacgggaaaagaatggagttgagtcctgcctatgtcacctttttagggagtgggaggatggggttgcagagagctgtgtgaccttgggcaggttacatagcaggagagcctcagtttctgtatctgccaaatgaggatggataatagaatgtgattgtgcatataaacagcatgtaaatgctcagtgttacctgtagttattaacatttcatccttaacagcggtcattatcaggtttaagatatggccctatgaggagttaatgggtgcagcacaccagcgtggcacatatatacatatgtaactaacctgcacattgtgcacatgtaccctaaaacttaaagtataataatttaaaaaaaaaaaaaaagatctggccgtgaaaacttatgttccctccaggtttgctgtgtgttgtcccatcacttttcacattggggagagtggaatgttcaacttcccttcctgtgaatgctcctggaagcctcctgcttacttccccaagtggggactagatttttacaggtttcctaattgctgtgtgcttctggctgcagcctgagggcatcagattacagtgccaaatggaggaatagtattctgggtgtgatactgatcagatcaggaagatatcaggacactagacatccggcatctgacagctggtcacaggggtcacttttgatccctagtttccccttgacaaggttagccactacatgccaagtgtttcatgggcagaattctagccaagcactaaactctgacagagaaggagaaatacaggctggcaggagggctggcattgccctaatgtcacagctggcactcacattccaatgaatgaatcttggatcaattgctaatgtacggggcccaacacaacattaacagatcaaaataagaggaagttggaaagtattcaagtttccagaaacaggtagttaaatatattaacgtaaatctacttgataaacttatctaatcattttaaaaaaatgaaaacatggtaattaatgttagaaaatgcttatgttgtaatgttaggtcaaaaaggataaaaatatatagtataattagaaatgtaaaacaacaacaatagacaaatctataaagacagaaagtggattagtagttgccagggtctgggaataatgagggttgtggaatcattggccaagggacgtggggtttgttctgggagtgatgaaaatgttacaaaattgattgtggtgagggttgcatcagtgaatatactaaaaaccactgaatggtacactttacatggatgtgttgtatgttatgtaaattatatctcaataaagctgttactgacaacaagaacaagtcttatacatacaaaaatagaacagaaagaaattttccagaaggctaacagtgtatataagttagtagcaaattgggactgatttttcttctgtattttttcacattttaaaatacagtgattaagtttaatgatcacatatgtagtctcatatattaaaataaaaaaactattggaaaggcaaataaacaaaaatgaattaatgccaacttttttagctcatggaattgaaaatataaataatttaaaaagtaagagaaaaaattatttttaaactagatgaaaatgtagcatagagtatgtggccccgtgtactctggattaaatatcaatacttaaccttttcattaatattttggcttgtaatgaaattgccaaacacaatggtatacataagacacatggcataaatattggaaaatctgtgataaaaaaatttttaataaactgttttctcagaattgacgtctatccttgtttagatttagagcttttgaaactttcagaatataaattaaaaattatctttgtaatcataatgcacccctaatttacatgtcctgatcttaaatctattatttatattagcttttatcaaaacattcagataagtgatcttcaaatgattagtacttaagtactggttggagatgaacttttgcaagtgaacgtcatacaatctattatttctattggagcttaattctgaagctcagagactccctagctctcctcgcctcaccatggtaatttattattatcctttgtctcctataatgtttgcttctttggcctacctgtagcataaaccttttggttgttctgcagctatttcagttaaataactcaagccctaaaaaccacagaaagaagagaatgtgcaaagcgatcatatttatggaccaccagatccttctcagcataattgccaggctttttatactgaaaggcaagaaacagctgccttgttctactttggtgtccaactcagctgtttcagattcatcctgttgctttaagcatctgttgacaggtgggaaagctcactgtgaagagaaacattgttgccctgggtggcttctgcctaagacaggcctgacccttttgtttctcccctggaaaaggaccgaagtgttccttccagccttattaagtacagctgtcgggtacattttagtagatgagaaccatttccaaagtatctcggttctgagaactgagaggcagtgtccagaaggtagttggacaagctcgtgtgctgtagaatgtctgtaagtggctgggacttacagaggagaggcccgcacgttgctagtcctccttgtcttggacatcttgagcctcccacttgaatatcctcttaggctctcattttgtaccagaaattctggaaactggaaggctattttgttggaaccccttattttacagattagaagaccgatgccagggttagttaagtgttttgttttatgctacaaagttggttagtggaattcttctgcctatataataacatcacagtatttcagagttgttttctgtcctctctttgtcaggtttctgggaaatctctttctcctcatgtttattatttggcccttaatccagcataataaaattacaggtacatatagtttgtcacaggatttccagttaggtctcagagacctaaaggaaagaaagttattgaaagttctggaaaaacaaaagtcctgagatagtttcttgacatacatcttctttgaaatctttaaaatcaaacaaaacaacccctagtgtcttccctgtcgcccccttcactaccttcttttgtattctgcatatgtagccattctcttgggcaatagcagaaaggtacatgtggattaatggaatttatgtattcactggcggtaaaaggcactgggaattcctgcactgggtgtaaaaacttgggccttggggacctcactaatgacttttcaagagcagttctttacagagcccaagtcttcaatcttgtaactggaccatcaaccccagtgacagcctactttgaaggaggcctcataaagacaaggttcaggctctttctaacggttttggctaatggaagacctggaggggaaaaatgaaattgttctcaaacttcttacaggtagaaaggagaaaatctctggaagttctgagaagtgacaggaatgtaaaattttgtgtttaaaatgtaagaagtagcaggggatgatgaagaatgcttaaaaatgcttgtttttattataggcagtggaaaaaatgtgagtctcaatttgcttgccctggaattgctccagctagcagaataaatcaaggctagaaccagatcagaatttcttacgagatgacagggatctgaaggactttacctctatagtcgttttgcctttttaggcactgggtgacctggtcccatgtccatcctagtgggccctgtatgatccaatccaaaggcccctttaggtttgcgttttatcattccctctttctcagaatttgatgtttgtatgtaaaagcactctggaaaatatttaaatcatggtacaaatataagagaagtcatgcaggtatggaattgctttgagaagtatcattttattaatttgtctggcttgataccaattacctgatgcagttgttaagggcagatccatccagaaacctttgggttctctgctccctgattttgttttgcaaattatataaccatacttcatagaaaacaccagtggtggctatgttgttcacagacacaaagtgattctaaggcaaccacaggagagagacacaaaagaaatcacacaaaaatctctcatcacaacataaatattgtgacaattgtgtggtactttttgtcttttttgttctctctgttccttttttgtcagtacaagtaagtcatcatgaacaaataagcttttgtatcctgcttttttaacctgacatgttcacagaacataacctagtcacacacgggcaagtacatcttctatccagtgatttgtttcaccatcaccctgcacatcacttttctcatgtttcaaatgatttcctcagaagagacatctggaaatgggattactgagtcaaagattctcaacctcttttaaggcccttgatatgtagtggcaaattgccttcctgaagggctgtgccagttgacatggctggcaggggcaaggcttgagtcttcctctggacctgtacatgggtacagttaacattaaatttttttaatgagtataatttacatacaataaactggacaagccttcagtgcataggcttggggaatttttacatacctacatttgggtaaatgccacccagatcccagatctctctctctgtagacagatagatacatacatacataaatacatagatacatagattgatctatctgagcagcatttatatttatatatgatatatcacatatgatttatatatttaatattatatatgatttatatgttagtatgaatcatatacacataggcttaatttatgcataaacatatgtgcttcacatatctttacatagataaatataaatataagtatgtatatatatatatatatatatatgttccttacctacaggatccaacacaagattaacttagatactttccagcttagatattaacttagatctttccagatcagaataagaggaagttggaaagtatctaggtttccagcaacaagtagttaattatattaacatgaatctactcgatagactattatgtcatcattttttaaaaatgaaaacattgtaattaatgttagaaaattcttatgttataatgctaggttaaaaaaggataggtgtgatttttatatataaaatatatgtacagcatatatatagctacatatttaaatatataaatacagcatatatatatttatatacttaaattataaatatatgtacagcatatatatacttaaatatataaatatgtatatgctgtgtatatatttatatatataaatcacacctatgtttgtgtgtgtatgtgtgtgtgtgtgtgtgtgtgtgtgtgtgtgtgtgtgtgtgtgtatatatatatatataaaatatgatatttccattatccccaggaagttttctagtgcctagttggtatgtagtgcccagtcggtgtctccacccacccccaaggtaaccactattctgaaagtccctcatttttgagtgatttcggaaatgttcttctctcatctgaaatgatttgacaggcagtctctgaagggagattgccatggctttggtgttgctcggatttctgccaccttacattggcaggctcaagaagatatgcacagtctttatttcattgatgtccagttgcctgtattgagcttagctatcctgtgcccaggttgccttagggatcactttgtgactatgtgcagcttatccactaccttttttttcccttcaagaattaacaaaaccactaccatctgttctgaaccatgtgcggtagcaggtagggggtgacaatgaaggtgtgttacagaaataaagtaggagccatgctgactttaaagaaacacccccacccccaaatgctcctggctgttttctttctatagatgagttaaaacagagggtatgaagtgcttggtttgcaaatcctgcaatactttgccatggcaagtccctaggaagtagattaaaagtggatctcccagagtgattaggattgggcagataaaatgatatgtttgttttggtcaattgagttcgaaatacaggttcagacagtaaatactcccttgctgagactaaacagtcattttgttgttcattttgatgaaaatcatggctcccaattttccgtgaaagctatcctttctgagatagactggctcttcatgagttatgaagcacctgaaatcctctctaacagcaaaatcgaggggcaacatcaaggttaggaacatcacgagcaagaacttacggctcagcagtggttgtaggtgtaaattcagtgtcccaagtcagaaaccaagaggtgtaagcccaacatgaaaggcaaagaggggaggaaattaacaaagatggaggctaggaacaacgttaggggctttcatatgtaataatccatttaatatttgcaataagtttatgaggttgatctatataaatctccctttaaagggagggaattgaaacatgtccagagtctcacagttacatttcttctttgcctctttccttccctcttttctttcttttttccccttttcccactgttgacacattccaggacacacatcctcctcctgttttccttttccttcacatctttctcgtcctttgctgtaacatcctgtgccataacaaactgtcacttatccagtgtggcatgccctgtgaagccttccctgacaccgtgaaccatagtaagtttacaggacccttcagtgttggagttctatcttttgcagctcccacagcacctatagaagttgtgttcacagagcactcaacaatttctaggcttgaataatgctgtgacaaagatggggttctgttgggaagacactgtagccactgtcagcataaagatacaaatggtccttgtaaatggatggagggcctttgagtgatttcttatcaatggaagtgccttaggaaatgcccagttgctgccttaaaatcaatataattatccaacattggtcactgagtttgttcctttgccaccctccccacttgcatgtggaaacctttttggccatattttattttagtatttcgccaaggagttttcagtcatcttaattaataacaaaaacacatcaagctggaaggagatggcctgaccatagtacattcctttaccaggactctgtagacaggtccccagctggcatacggatcaggagctcccattccctccaaggacccgtgaacagttcacacctacagtgttagattagaacagatgtgaaattcaaatgccactaggttgttataggtgttctctgaaaagaacagtggtaaaataattagtgcatctaattatcagtgtgttcacatgctttatatttttaaagggccacagcagtggccctttatatatatatataatgtgagctatatatatataatgtgagccatatatatatataaaatgtgagccatatatataattttaaagttttttagtagtcaatttaaaaatgttgaaacgtgaaattaattttaataatatatatttaatttaactgagtaggccccaaatattatcaccttgacatgtaaataatataaaaatattaatgagatattttacttgtttttgttctaagtcttagaaatctggtgtgtaatttatacttacagcctacctccttttaagctggctatatttcaagtgctcaagagctatatgtggctactggcgatcatattggccagcacaggcccaaagaaacttctagtggagtctttcttataaagatggagctacgtttgttcataggcaaaaccaaaaccaaaacaaaaaatgactctgtatgtttattggtcccatgctctgtgctaggcactagagtggggagacaaaagggtgcagtgcagcctctaccgtaaagcagtcacacgtgaaaagtgaaatcattttggttgtaatttataatgtgtccaagcacaaggcagtttttgtgattaattctcaagcaagtgattctggcagcttaggactgtgagtttaaaggagaaagtaatccctactatttgagatggtcatggaggacaggggacattggacaaagtataatatttgtctgagatggggaaagaggagaacaagcagttcatgtgggggagacagcttgaacacatctacagaagcattgtgacacagagagtagattagcttggctataactgagaattcacataaaggaaattgtggaaagaaagatgggattccttttggctgtattaaagagagttggactatatagagagatggctaagagacctcagttaacaacaggaatgaaaataataatcgcagctagcatgttcctgattagggtccagtccctgtatcaaattctttgcatttttttgtcactgaatattacaaatgagaaagtggaatctctagagaggtagaagtacttgtccaaggtcacacatccagaaagttggcctagcaaaattttgaatacagaaccttctgagttcagagcatttactttaaccatcaggagatatgctcctgagaacgttggaagcagtgatctctgtgtttgattaatgggacgccccccagccctattgacaaaggtgctgcccaagtgctgacgtaccacctcaacataggacagagaatttccaggccaaggattctctgcagtttgtgtcctctgaacagatacaaatgggccttttagcatgatgcccctgaaagttgactgaagtcactgactcaggtctttacaacccagtgttccactagttggtttcctcctttctctctcctcgtataccccagtatcatactagaatactgggatctcagagaccttttagttcaaggccctgttcttatagaacagaaaacagaggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaaggcctgaaatagctagttgctacttaatgtttgctgcttatcattgcatttgctgggacctggtgcttgtcatgcttatgcagtacaaggagggaccaaagaggcagaagacagtccctgccatagtgaagtgtagtcattttagaggacaggactaaaaaacacgaagcaatgaacaaaccccccaaaatacaatagtgtgctgaatgatgcagtgcagatacttcttagaggtatttaggtgtagctgggctagattgtttctgtattgcatcaatagattggtccatgttgactattccacttcacaatatctcagggatggacaagatggcagagttcaggccccaaatttaccaaaatagaaattttctccatcaactaatgagtggataaagaaaatgtggtatatataacccacggaatactactcagccattaaaaatgaaataatgaaataatgtcttttgcagcaacttggatggagctgaaggccattattattattattattattattattattattattttttatgaagtctcactcttgcccaggctggagtacagtggtgtgattgatatcagctgactgcaacctccacctcctgggttcaagtgatttttgtgcctcagcctcctaagtagctgggtctacaggtgggtttttttttttttttttttgtatttttagtggagacagggtttcaccatgttggccaggctggtctcgaactcccaacctcaagtgatccaccagctttggcctcccaaagtgctggctttacaggtatgagccatcgtgcctggcctagaggcattattctaagtgaagtaacataggagtgaaaaaccaaaattcatttgttctgacttataagtggaagctaagctgtgagtctacaaaggcatgcagagtgatacagtggactttagagactcagaaggaggagggtgggagtgggccagggattaaaaaaaactacacattaggtacaacatatactactcaggtgacaggtgcactgaaatctcagaattcaccactatataattcatacatataacccaaaaccacttgtaccccaaaagctattgaaataaaaaaattaaaaaaatatgtaagttccatttcagcatgagaaatacttcttagaggagtgttcataacataggttagtccccatgagatttgtgcataaagaggactccataggcaagccattccatatcttcctcttggagacttaaaagacatgttcgttcgtatattaaaggctatacagctttcaaacttttttatcaaagtcttgcagtttgtaactttgactttaacccagtattaaccaaactagtcttcctacagagcctttatttcgtagtccatgttccatgggccttgtggcagaacacacaatgggaaatgctgctttacagtggactcttggctccccagtaatggctaaatgcctgatttggttatagttctgtcagcccctgttccttccaaacgagaatcttgtgcaggaagtaagaaagagaaactagcccaagctattttgacaacaggcctctgactgaaacaacctccctgaatggttgataaacattttccctctcttaagggaaaatcatgcacagaaacaagcacatataaataatttaccaagctgtaatatgctgtaaataacaaccctgctaaataatgaattaacccaactgctgattcataggtaaatgtctcttgtaaagcagcatttttatggattttatagcttagttaatatccactcatatttcattaggacacttcaggtgaagtattggggtaataatctggatatatttgaaactgacatagcacatatcaggagtccaggcagagtttggggagctgccaggatccttttgtcttagctagagcatgaggagagattgtactgggccttactcttctccttcctccatggtcttggtttgcccagctcctcagtgcaagcctgagttgctgagcaggatgcggctctgatatcagagagggtgtcctctctgagaccacgggcagggatggaaggagaggtagctctgggccaggggaagaaagggacacagaaatcactttggcctactcgacagagccagctcttctgagtttttatgacacaggtgtgcagactctggagctgaactctggatatttgcatctttaccacttattaactttctgacttgggcaagtcacttatacactctgtggctcagtaccctcacctgttaacagggacaataaaagtacctactcctagggttattatgaagattaaatgagtttgtattgtcaagtgctggaacattgcttggcacataagcaagtgctttcatttatttattttttgagatggggtctggctctgtcacccaggctggagtgcagtggggagatctcagctcatagcaacctccacttcccagactcaagtgatcctcccacctcagcctcccgagtagctgggattacaggcgcatgccaccactctcagctaattttagtatttttagtagagatagggtttcgccatgttgcccaggctgatctcaaactcctgggctcaagcaatcctcctacctcagcctcccaaagtgttggaattataggcgtgaaccaccatgccgtgccagcaaatgctttttgagtacagtattagctgttatatttgttagaactggactcttttagattcttcattttggcattctccagctctggtgttggattctgagaacctagaccctggggattggagggcctgggtggggagggggtcaccgggatcactcagatgcctcttcttgcctctaaagaatgggaacgggggccaagtgcggtggctcacgcttgtaatcccagcactttgggaggccgaggtgggcggatcacaaggtcaggagatcaagaccatcctggctaacacggtgaaaccccgtctctactaaaaatacaaaaaattagctgggcgtggtggtgggtgcctgtagtcccagctacttgtgaggctgaggaaggagaatggcgtgaacccgggaggtggaacttgcagtgagccgagatcccgccactgcactccagcctgggcgacagagagagactctgtcttgaaaaaaaaaaaaaaaaaaagaatgggaatgggaagcaggaactatgatttcattacagtgaggaaaaactgcttttgatgatctctcagtaactataagtaagaaatattctcttatttaaaaggaatgttatctatctttgttaatgagggttttatggtggggggaggtgatgagaattatcagtcaaatcactttgagaaggaggagatctgaatttcataaataaaccctaatttgttaatgggaactgatgccaaaaacaaggagtttttcctccttgcggtgacactgaatgtcctgggctgtggagggtagaaacaggacattctcagtgttccagctcacaggggtggagttagagtaaatatcctgcccagtttgccatcacactaacactgcataccctatcatcagcctaatgacctttcaattctgattgaatggaagagcactccggcccttgatccaactcgtggttgattacagtgctcatgccccattaccccaaatattcctataaattaccagagcgagcattcacgcttatacaccatcatagatttagctcatgccggtggttctcgatagcagccatctgaagctccttttgcccacagctccctggatagctccaccattccctgcatgctagtcttgtggtttggtcttcagcctgctgtctgtactttctcacacgttgcatgggctttctccgatgcctacaagcaaaatctcttttccattcttcctttctctggctcctgggttcagaaatctctagggatcattatcagtcctctggctgccccctctcctacctacctccatctaccctagctctaggacagacctatggcgatgcccaactttctgcattttgaaataggggtgattgctttgacttgggccctatctattagggtctttcatctgtctattttggacaaagacaatagcagtgaagcagggggcctttgcattgagaggctcagactctcaaactctctcttaaaaaaaaaactgtctggcattaaggggcatagtctgcttgccttcaatagacctcaggctggggaggctcgaggtgcctactagggcagccagtttgcatagtgccttctaaaagcaggaagagccacccttgctgccttacagcctttgtccttgggccttagaatgaaacgcttcagagctcacaattaacatttggccaagcctcttcctcacccccacccccgtgaagtgggaagaaatacggtggcgtgacattcactttgacaaagctctttttcttttctctacttctcaaaaaagcctaaagaaataaaaacagttgctaagctactgggtgggctctatcggtgtgttttgttgcagtcttggcgttaaggactcatgctatcatatatgcagcagcttagactaaagggaggaagcaaagtgcttgagagggctctcttgcaagttcacttttttgtcaggtcaagtgcttggctctgggatggcaggggacatggagcatgacaactgcaattctctctccagatgggaaagtagaagggaggatttcttccaatcctcaaattcttccaaaagagaatgctgttttggaaccttgtctttctttaccatttatttcagaaaggttggatctctaggaagcatgggtcatactcttagttctctgggtattgtcttttgtacacatcacatgcagttggtgctactgatggggcctggacactagctagttctggtgagctcctagctcagtgtgccagaccgttgtactgtattgtatttaatttttttgtctccagcattttcttttcaaagctggtgaatcccaggttttgcaagttttcatttaacaacattcacataatccctaaattcagcatggtttataacttgttaggtccgtttgctatatacaaatgccatacctccaattggtactgaggaatggttccccactcctgatttaaaggcattaacactgagaatggtggaaagagagcctatttcccaacactgctttgcaacatcctctaaatctttcataatggcctaatccacccattgcgcgttggttctcagtgtggggacaatgggggcattactgattttaaacttgttttcatcaactagctcattctgtgtagagttgagtttagaaaaaaaaaacataaaaattaatgcagcctgggacaccctctgtggaggatacattgaaaatacatcttaaataaaaacccaggaaattgtcccttctgtctttcacctgtcagaatcagcaatagaattctatagaccattcagtggcatacttaattaagcaacctatctgctgaatgtgctgggggttggctgacagtgcttttcactgctgatttggatgacaaaggatatggtgagatactcaacagtctggtggaatggaaagaaactcccaattggtcacacctacctatttctcttggcatgttgcattagctctgataatacagaaaatagactggcttttatgcattgagaaagtcagtggacaccaacctcttgccttttgctcttccacagcaagccctgagttttgcacacatttccattacagatgaatacagattttagttgtaggtgagaaacatgagcttgtaattttcaagagacaaaacctccagctgctttttttaatcctagtgcagaatagttccttcctgatcatcattctatattttgatggcagttattgcctatccctaatgtatattattagtattagggacagttttgcagtgtttatctggtgccagacacatgccaaagcatcatccctcttgccaactctgtagggtaatactctattttgcagatatgaaaattgaggctcaaaaaacttaagtgacttgcctgaagtcactcaaccaaacagtaagtggtgggtcaagcttagaacatagagctcttctaccctgcagtccgtgcttttaaccgctctcttgcatcgtctctcttgaaagccgaaagagtgtcacacagtacaactattaataactaggggttggggcacacgtgtattaggattacaaaccttttgggagtctctcccacaaaattgggctcttcacctaggttttgtagagcctttcagtatccataaagcccttcaaactagatgcaaaaatatgtgtgtatattcaagggagataggccagagttttcatcaacttcttgaagaagtccatcacacacaagagggttagtaacttccacataatcctaaagtgcatgtagcacttgccaggcatgaatatgattcatgaatatgtgcatgaacttaagcaaactcatttcattctcaccatagctatcagaggtaggtatgattatcatgcccattttacagaaggggaaactgagactaagagaggttataaagctaataagtgacagcactgggatttgaggccaagcagtctagctcctgcttttaatcacttttgactgcaatttcctttttatttacttgcatatctccagcacagtgcccgacacataatgggatgtttattgatatttgttcaattgaattgatttgcacactgccggctctgtgtagatttcatcttaggaatcattctcaaaggtgtgactccgtaagtcttggctggacgaatgaaaagaatcaacatggtcaaaagataatttattagagtttctaaagacaaatggcttggcaaagcataggcattttactttcaatcagtgttccctggagggctgttacactgatttccaagcccattcttctcccaactggctcactagattgttccaattggttatgtggtgcccctgagtatgggctaggtaactctgcaggccccatgaatctatgtgatgtttcatttcctgattactatgcataatctcccctgccttttatttccaagtgaccaaccagaagccacccaaaccctctgcatattgacatgattcaaatgtaggtctctacaaggtatgccaagcttattgaggggaaggtggggggagatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacatgttccaaggtttaactttgtggcctccactgtttccctaattttacctgctgcgatcttattttacttttcattttattctctaatcaccgccaattagagccctgagtccatgctggttctgttgtctgcctctcagcctaatgggcctctttgtactgaggcacagaacccagctggcagcgagacttcctagggcccggaagcttcattactctttgttggcagtgaactctaaagttgctgtctttggagttgggttttctcaagtacagtcacttaacatttggtctcaaagttgttgtttttcagatttttttctcttttttcctaagtcaatcagatgcatgagctaattataagccagcaaatattttgagaaaacttccctccagtggagacccttgcacaaacttcagactatattcccagtaattaatatgctccttttatttcctttgaggtggaaaacagtcattgacaatcattccctacccatttggttcaaataactaattttgtacctgaagactaattacagtagtgacaccatcttttcctattaggtctctcacttgaagaactcagagcaatttataacctttgaatcttggggactagtttaatctgttcgtgggcagcatagcagtgaacattgttatcagaaatatagttaaacctctttaattgagcccctattaattcaaaaggtaataattcaaacagtgtgaagaacaaacttgaaacgtctatgacaagaagaaagtaagttggcaaaggggttatttaaactgccaagtagagcacacttttagaagtgccagttcacatgcaaagaactggtaagtacacacaaattgttccattaatagactcagaatcttaagattaaaagccctgtagtacaactgttcataactcaaaaaacatttgttgagtaatgctatgtgctggggcctggggatataatttttttgttaatagcttcattgagatataataaatacaccatataattcactcatttaaaatgtacagttcagtgatttttggtatagtcaaagagttgtgaaaccatcactacagtctattttagaacatttcatcactctagaaagaaaccctgcatcctttagccatcactttcccatccccctattactcacagccctaggcaaccactgtggggatacaaatttgactaaaacacagtacctgcctttgagaggatggcaagctattgaaagagacatcaggcaggtgaagcgtacttatcatagcatcgtagaatgttgatattgagaggcactaagaagatcatcagatataatcttctcatttcacatatgaggaaactgaggcccaaagacaagaaatgacttgcccaagaacaaaaagctaacagagccaaaattaaaactcatgtattgtgccatcttagcctgttgcaatgttaattacaatacaaacttctggagcatagtaacagttgagagcatggattctagagccagactgcgtggatttgattctcagcttaccttttataggctgtgtgacctcaggcaagttacttaacctctctcagcttcagtttcctcatttgttgtcttgaaataataattgtaactaccttataggactcttgtgaagattaaatgagtttctatatgaagtacttaaaatagtgtttggcacagaataatcgatacataaaatgattgttattattatttcattacctagttattaaatataaaaacatttcgtaatgtcctaaagtatattttaaatatttgttcttcaggttttaaatcctgactgtattcatacataatttctatttcgtttcttccaacatatatttttgagtgttaggggctaggtataaaaatgatgtttaaaacagagttcaaatgcctaagaagttcagtcaggtaaggaaggcaggtgaacagatatgtagctataaatcaaggcaagcaacaggaagtgccccaaataaagtatgtatgaagcataaagggtataagaaaggcttcaaggaggctgtggcatttgacttgggttttaaaatgtgagccagatttcaccagactgaagagggcgagagaagaagacattccaggctgaggtaacagtagaagtggagaaaagaaagtatttgccatggtttgggaaaggctaagtgttgtatgtgttcatcgcatagggttttgcaagatgtcctgggagacgagcctgaatatagatggggccgtgctcagtaggaaaagggaggagaatttatacttactgaacaccttttatataccaggttctgaggttgggcgcagtggctcactcctgtaatcccagctacttgggaggctgaggcacaagaatcgcttgatcctgggaggcagagaagtgagccgagatcgtgccactgcactccaacctgggtgacagagtgagacaatgtctaagaaaaagaaaaacaaaaacaaaaaaactatataacaggctctgtaaaataccaagtactagatatgtatgggtaactattttgattctcacaatcatcctgaggaagcagtgtagacaggtgatataaattgatcaatatcacacccaatatgtggcagactccagattcaaactgaagtctctctctgatgctaatgcttattccctctccatataccacaccaactcctgaacttctgtaccagcttggacgttatggaaaatgggagctttaaatgttcttgaaggccaggcacggtggctcacgcctataatcccagcactttgggaggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaaaagtcaattgtgaggcttttacggtaggtaaaaggcagcgaggacatgaactaggggcgtggtaatggagaggaggggacacatataagagagggattgacaagacaggacatgtgaccaatttgatgtggtcagagcaagagtcaaagagagtcaccaatgaaggcatgattttttcagcctgtatgttgtgatgggttgaactgatggactgagataagaagcctgggcatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataaggaaacggaggtcaacattgctaagcgctaaagaatggccaagttagatagactgaaaaatgtcccttggatttagtaattaagtaatttagtaattaaagaggttattgagtaataagaagcaaaccaagtagaatattatgggtggaaattatgtggcagtggtttggaaactgaatgaggaatggagacctggagacataaatgtagacaactctttctagaaacttgtctggtaaggtatagagagatgacagaatcttgaagacaaacagatcctgaataacttttttttaattatggagaaagttgagcatttattttggctgagaggagtgagtcagtgaagaaagagctagtaaaaggggagaaatcgggggataacggataaagattggagaggtagcaagaggaccaaaaggaaataggaaaccacagagagatggttagctatggacttgagcccttcctctgagatggggttttgaagcgaggatgcacaggggcacagataaactaaaggctttttccaacagagtctgaggtatttgtgattgattattttctttaatttagaattctctgcgtaagaaaccttgctctttttacactatgtaaaatccttatggaaacaagaacaacaaaaccaaacacaaaaacctactttatttaaatgtgggagaagggcttgaataatttctcccccccccaaaaaaaaaaagatatacaaatggccaataagcaaatgaaaagatgctcaacagcattaatcattagggaaatgcaaatcaaaatcacactgaaataccacttcacacccattaggatggccattattattattattttattattattattattattattattattattattattatttgagacagagtcttgctctgttgcccaggctggagtgcagtggtgcaatctcggctcactgcaacctccacctcctgggttcaagcaattctcctgcctcagcctccggagtagctgggattacaggtgtgcaccaccatgcctggataatttttgtattcttagtagagacagggtttcaccatgttggccaggctgatttcgaactcctgacctcgtgatctgcccaccttggcctctcaaagtgctgggattacaggtgtgaaccaccgcgcccggccaggatgtccattattaaaagaaaattaaaagtaagtattgttgaggatgcggagaaattgcaacctttgtgcactgctggtgggaatataaaatggtgcagctactgtggaaaacagcatggtgctttctcaaaaaaattaaaagtagaattaccatataatccagccattccacttatgaatacagaaccaaaagaactgaaagcaaggatttaaatagatatttgtgactatagtcaataataatttaattgtacattttaaaataactaaaagagtataattagattatttgtaacacaaaggataataaatacatgaggggacagatatcccattttacgtgatgtgattaatacacattgcatgcctgtatcaagactgtacaaacaaaatgtgatatatatatatatatatatatatatatatatatatatattattcagcctttaaaacaaagttctgacacagctacaccttgaagacattatggtaagtgacggatgggtgaactttgaagacattatgctaagtgaaataagccagttacaaaatcactgtatgattccccttgtatgaagtacctagagtagtcatattcatagagccagagagtagaggttgccagaggttgcgaaagggaggaatggagtatggactttcaatttggaaagatgaaaaaagttctggagatggtggtgatggttgcacaacaatgtgaatgtacttaatgccactgaactatatacttaataatacttaaaataagttttaccaccattaaaaaaaaactttctagagccaccattttagcttgactggggtctcctgggttgttcgtaacctagagtagtggctctttccactgctgacagatagcaaatccagagcagacacctcgtgtaagagctacctcttagcagaactatgattcaggtttgtgtgcattacatttaagccagctgacatatcactttctttctcactgctgtgtacacaatagtgacatgatcaaacttgaaagtgcatgagaaacaatcacttggagaacttgttaaaaatgcggattcacaaaatcatctcttccatcaaactaatgtagtaggtatatcagctagtttgtgctatataacaagccacccccaaaactaagtgatttaacataactgtttattattttatagcctatgagttggctggatggttctgctcatctgggccaggcttcgctgatcatagatgtactcagctgcagtcagccagtgggttaaccagggcttggcttttccaggatggcctcagttgggatgactttaatctgctctacgtggcctctcatcctcaaaacatcagcccaggcttgtttttgtgctgtggcaggagtctaagcaagcaagcacaataatatgagggaacaagaagaaatgcacatgagctcttcaagtttctgcttgcatcctatttgctaacgtcctattggccaaagcaagttacatggctgagtggagattcagagtgggaggggtgtacaaagagggcaatagcaaggatgtagagaggtcactgggtccactaatgcagttaatctactacagtaggtttcagtaaagcctcggaatctacatatttagcaagcttctcaaagtgatttttttctttctctctttctctctttctgtctctctctttctctctccttccttccttccttccttctttctttctcatgatctcactgtcacccaggctggagtgcaatggtgccatcacagctcactgcagcctcaaactcacaggctcaagcaatcctcccgcctcagcctcccaaatagctggaactacaggcatgcaccaccaggcctagctgtttaaaaaaaaaattacagagatgaggtgtcattatgttgccaaggctgatctcaaactcctgggctcaagcaatcctcccacctcggcctgtcaaagcactgggattacaggtgtgagccaccatgcccagcctaaagtgatactgatgcaggctatcccttaatattttcagaaatattattctagtatctcttaacaccaagattggaaccagcatcattgaacgttcagaaaacgaagactcagtggggaagggagcacttattcttctccttatttccagcttatgattcaggcctcttggtctcttagaggcagatgctgaaacgaacactctctgtctgcttttcagacaatctcatataatcatttacttgttacaaagaacaatggagttggattaaactgataaagtgttatttttcaatgcaggtcaggaaggcattgttggtttgttttgcattgctcattataatttctatttttgtcctggggaagctcatggtaatggaatgaagcatcgaggtggtttatgggccatgtgataggatcataaagttgaggttgttgcttggacaatacctttcttagaatagtaatccaagcaaagagaacatggacaggaaagaaaagaaacaataagaagaaacttcagttatttagccagttgtatgaggttttcattgctcagatccttagttaaaatgtgggatcagaggcctgcaggtaatgcctgagctcaggaaaggcagggaccatgatgcttttgcattcctgatacgaaccacagtgccaaccacattgtcagtactcaaaacgtatttgttgaatgaatttctgctaattcctgggatctattctcagagattctgattgagcaggataagtaaatagtttttcacagtgtggtccctgaaccatctgcatcagaatcacctacagggcttgtttaaaaaatgaatgccagggccgggcatggtagctcatgcctataatcccagcactttcggaggctgaggctggaggatcacctgaggtcaggagtctgagatcagcctggccaacatggggaaacccagtctctactaaaaatacaaaaattagccaggcgtggtagcacaggcctgtagtcccagctactctgtaggctgatgcaggagaatggcttgaacccaggaggtggaggttgcagtgagccaagatcacaccagtgcactccagcctgggtgacaaagtgagtgagactccatctcaaaaaacaaacaaacaaacaaaaatgaatgccaggatcccaccttctacttcttgcgtttgatgcatgagaaatcctagtttacacattttattaaatctgggactggttgtaactggcactaatgtagtcttgtgtgaaggtagtggtgcgatggtcattctctacccttgccccacctgagagcctctagagggaaggctgtggtccagtgcactgacctgaaccctcaccacatgcgtcccacacatatggaattgggagcagtcatttagcatctcttagccatttcgctctaatttctttgtttgccatttttgttgactttttccttgggaacctgaatttaaactcatgccacttttttgtcttccttattctagtgggtaggaatttgatcttgaccccaaaagcaatgataggttcctacagttctgtaaagtatccattgcttctgaaaggccttctttccccattgtctttgacaatttagattttccaagtgctaggattttggagaaagtggagccatgagcccaggcaagtggggtagcctgataatgccctcccatgacacatggggctggggatgtaaaaacttcagagtttccatgtcaaataatctcctttgccctgtggccttcggttacaggaatcatttatattacaggcacattttgaaatatcaaaacaaattggacactttttccctattaggaagaaaggcatgttaatttaagtgtggagtgtgacatttggaaatgtaaaaagaggcttttggggagtagttgggggtttgagtggaatatctccctttttgtatatctctcttgtttttattcatcctgtgtcttattcagatagtgattttcattcacctgcctgatcttctggaacagggattttagagaaagccattttctcagcagctccacaagggcgagatttccaaatgggcaaggaaaggctgcagagacacatctagcttggaagtaaatgcaccaagccagccaaattggaattgtcttatagggatccttgtgtgctgtcacagaagagttttcaggaggctttcctttgggcactaatggccaaccactgctgctgagtttctcccagccttctggagggaatgccagccagcgcactctcagctgtgacatgaccctcctaggagctgttcaatgctagcgccgttttgctctgatgcccagcaccctctgcttttagtcactttccttagcgtcctttcgcagtgcttgcatttcagccaaaatcgtgcctcgtgacttttcttttcctagagttttcgcttctcacagtgaagaatctatcagctgtttcctgaatccttctatgtcttttaaggtgttaacattttcaattttgccacattcagcatttttggcctactctgacctgagctcgataaagagcatcagaaattgagtaaagacagaaataagtccctataagcatgagccctggcactgtccacttcctcctcctcccctaccctgacagcactaatctcccttcagctctactcattggaccccctttattctttaggctctctttagtgatttatcttagtttagctatgagaagaatcaagctttttaagggcttcgctgaaaacgtaatgaaagttgtttcaactctttaaattttaagtgaattgtggccatctcaggcccactagttcatgtacctgatacaatttttatttggagccactgtattcacatcttcctgggacaggatttcacataattggggtaggttaatgagtgtggatttggcactccctttctatagagagtggtaaggagctcaggccttggagtcagtcaggtgtggttccaatcctggatctactattaggttggtccgaaagtaattgccatttcggccattaaaagtaaccgcaaatacttttgcaccaacctaatacttagtagctgtgcagtcttgggtaactcgtttcacctttcttgtgtctcaatgtcctcatttgtaaaatgggcacaatagtcccaatcacataggttgaagactaaaccaaagaccccatttcattagcttagccttatccctggcagataccatgaactcatatgtcattataattatgataatttacttaccctttcaattaggggtataagatgctacacagttttcctctaggacagggcccgcaaaccatggcctgcagcttgcctgtgagctaacaatgattttcatatttttaaaaggttgaaaaaaatcaaaagaagagtgccgtttcgtggcatagggaaattatatgaaattcaaatttcagtgtccataaataaagttttattggaacacaactgtgctcactcatttatatattgtctatggctgcttttgctctatcatagcagagttgagtggttgtgatagagattctatggcctagaaagcctaaatatttgccaccttgccgaccacttgccctaagacatttagccatgtctctggaacatcactgtgatagatagttcaggaattatttgcatattatcatcactgttattccaaaactctgactgcgtgtgtttctgtgtggagagtgatttacaaaggaagaaattatacaagtcataacaaaaagaaaaaaaaaaaattacacaggtccatgtaagacaaatgagatgaggcttttgtggcagttttagctaaggactcactttgtgccttcgagggatcagaaagaatttagaagtagtagcaatattggttaggagaatttacagattctcttgttttcttttcctctatcagtaccttctctgcaaggaggagagaatggatgttagtttctccttgtaagatgaattgaattgcttgtgttagtgtactaggactctgggttggttgtgaatgtggtataccaaggcaaagtctcatctgagcaaataccaccataacaccctgttctcccccaaaaggcaatctctgtagagaattataaaatcttagaatatcaagattggaaggagcctggagatctgagggaatgatattgatattaatatctccttgccgatgtagatacaatatcctgtttgaaggcaaaacattgtgtaataaacccagtctactcaatctattcaactaaggtggcctctagtgggtgtctgagtactggaactagatttgaatacttgtgagatattaaatttcatatgctttacaaaacgtgcagccatccgggcacacaaacaaaatgcccacttttggatgtgaaagtgggggcaggagtttttcccatttaggagctaaaagctctggagctctggtcctcagattcatcttgtgtctggcctgtggtcgcagtgagatgccttttcagtagggatgaggtatacttggggctgggagaggggggacatttggaggtctggcctcccaggggtaggtatgtgtttagccgggctatgcagatgaaccaatctgggtgtctctgtcagggaagaggctaggaaagctgctggtgagaggggtcagagactggtttgccccaagggggatgggggaggcagggaggctgtagaggagctgttgggccagatcttgttgagaaaatctctcagacccgagacttctcccctcctctcatttcctatatttgggctttcacacttaagggactggtcttaaggagagatgtactttttaacatttgatttgcccatgttgtgccccgtacttctgcgtaccaccagaagaccacaatgacaaagaccagcgaaggccaaaggtggccatgtgtgtatagaattgacactccaaggtcaccggatctgcaatctaccaaacagtcttgactcacaccctcaggtttcatatttgaacctcctttgcagggctggtcctggctcctttcaccttctagactgcctttcctttcttactgtcctctgagaggcacactgaacatctgtggacagtggcagttggtagctatatatatacatgtatatatatcagaatttcctctttgtacactgtagcagtggacttccattttgatgatattatacagggtataaatctgcctatctcaacaagttgctttaaagaagaatcagtttcaatgtccaaactaccacttcagtaaagtaacagagccaatgccctgtgtctttttcctttatttatttatttattttgacataggttcttgttctgttgctcaggctggagtgtagtggtttgatctcggctcatagcagcctcaacctcccgggctcaagcaatcctcccatctcagcctcccaagtagctgggactataggcacatagctaactaatttttaaaaattttttattttgtagaaatgaggtttcaccatgttgcccaggctggtctcaaacttctgagctcaagcgatcctcctgcctcagcctcccaaagtgctgggattacaggtgtgaaccaccatgcccacccccctttttcttatgaatgggtgaagcaggagaagagcagtgagtatggctagagatgctgacaccatgtagtatagcaacttgtgggcttctgccttcttcctcaagatgaggccaagaagagcactgggacttccagcctctggtgcatgtgtttcctctgggctaggtggtatgtggtgtccaggtatctgcacacttgctcggggcagggttctaagcagtggatggtggcaatggatatggccaacaagagacaatcatggcagtgtcactgagctgtgaactcccacagaatcttttggcctcccaagctcagagaagaagcttaagggagaaaacctgtcaacagtccttttgccatatttattcactggagtcacacttttataacaggcataggctcaaaggtgtaaataaagccaattattttagttcagcattgattttcatatataaattatcaatatagttttgatttagtaataaaaataacagcctggagttttatcccctgccatggccagtgagagctgtttttaagctgtttctttgtacagggaagcatgtgtcaaagtcacacctcctgattaataaaaacaataaccttttagtccttcctatgttccaggcattgtgcagagggctcacaaatactatttcatgtaatgctactcataattctctgaggtagattagtatttgtatacgtatgttatagacggggaagctgaggctcaggaaatcacttacccaagacagcagctggcaattctaagaaaatttttgaaattctaaaatgcatctgaggacctggcactgtggctcatgcctgtaatcccagcactttgagaggccgaggtgggtggatcacttgaggccaggagttcgagactagcctggccaacatggcgaaaccccatctctactaaaaatacaaaaattagccaggaatggtggtgggcacctgtaatcccagttactcaggaggctaaggcacgagaatcgcttgaaccagagaggtggaggctgcagtgagccgagattgtgccactgcactccagcctgggtgacaaagcaagactctgactcaaataataaaataaaataaagcacgtctgctgccttcacaccccattttctgtaccatgcatgtcaacttctatagggcccttctcttgtatgggtgtccattaggtcatatcttgcagatatggcagagctagagacctagaggtaaagcaagatactaggaaaacaagtaaaagggagctattttctgggagactaggaaaaagaagagactaggaaaagtaagtgaagaagctctaactagtagggggccaataaggggcaaacaaaggagagaagctggctgcttagctaaccaagtagagagcctcggatctggaaggaactggaccgaacatctgtaactgggcagggctggccttgggcctgtcttgacttccttgaaatgtctcttttacctggcctccttctcatggctgtcatcaagcagccctgttgatcatgttcctgaggaaggacagaatggggttggggagattaagtttattagcaaggcaatttcctctagggagaccccaaacctggcttggtaactacagtgaaaggagagcgtttgagccccttcccccttctgcttgatctcctctccttcaccaggctttcttcagacctggttccaatcattataaggcagatctaaagccactcttcctgacactgaaactttgctgagcctggaaaaatcacagaggctcagtttggtgtttttgcatgcaaaatacgagaggcagaggtgaaggtgcattcctggtgccctgcggttcccaggcagtatctgagtgcattttcacctgttatcgcttgcctttcaaatattcgttagctcccccagaagtttagccacgagtcatcttctaggggaaatagctgctctgctctgtttgtagaatctcatagtttattttggaatgaagatgtattttcctggaaaagtgttactactttacagtgtccccttcatctgcgaaactgaaaaggcaggcagccttgctgtatgagaagaccacacacttgcggacagaaaaaagatgcatccgggcttctcttcaagtccaagacaattgatgacaaaggaagtatgacacaaacttattgagatctgttattatccttgtgctgcccgggttttagacaaaaacaataagcagattacataagtgagtgtcaccacttttgcataaccaaggtttcatttttctcttctcacttggttagtcttccgtgagctaagcaacatcatggtagttttctgtagtaccacttatggctttccttgttatcatcacctgcctttgacacatgccttcattaatgagttgatatatttaattatatgttatacagatattttatattacaagcaatgttaattgcattcattcagaacagctcccaattaaaatctataaactacttagacctctataaaaatcccaccatttaccttacagcttcacattaatatttaccctggagaggataaacatctcatcctgtatttatctgttagatcatttttgttgtcataaaaaacaaaagccacatgtttaattggatcccttcggtatgaatttttaaaataatagtaggaatccttacttgggaagatggtttcatagggcatcctaaaaccatcctttgttccaaatcctttgaggatgcacacatttaatgttttccttcttactactatgctatgaacttaacagtgctacatgctaaagtacaggcagcagaagttctctgggaaagtggagatccctagcaagtaaggaacccaagagaaggccattctaagctgtagtcccttgttggaccaagggaggaaggaaacagatagcatccacctggcgctgcaattctactggcctgtggggtggtctggctttaggaagctcactgtgtaatccatcagaggacaatcctgccaagtcttcttttcaagtaaaaaatgttaatgtttctttccatactttgtctcataatcaatattcaattttcaaggcagtaaaactaatcaaagaatataaaatgaatccaacacaagagaaaggagggagaatgagtaagctgcaaatgggactgagcaagaaaataggaggatattataactatagaattttttttttttgagacagagtcttgctttgtcacccaggctggagtgcagtgacgcgatctcgactcactgcaacctctgcctcccgggttcaagcaattctcttcttcctgttggtgaatttctcccaggaggcatgagccaagatcctgtttcatgggtttctgggtataccccttgaaacaccagagtcaggagtcaggaacaacacctagtgtattagttggttttcacactgctgtaaataactgcccgagactggataatttataaagaaaagagatttaatggactcaaagttccacagggctggggaggcctcaggaaacttacaattatggctgaaggggaagcaggaacgtcttacatggcagcaggtgagagaagaaagtgaaggaggaacagccaaacacttataaaaccatcagatgtcatgagaattcactcactgtcacaagaacagcatgggagaaaccacccctatgatccaatcacttcccaccaggtttctccctcaacacctggggattacaatttgagatgagatttgggtgggggcacaaaaccaaactctgttacccagttagaaaccggccagtcagcatgtagtccctctggagctcacaattgcagatcatggtatgatggagttctccactgcacggtaggctctggggcttaggcaggcatatggggcagcagtcaacataggggatggtgggagtgaggtgctctacagcagtggtcctcgacttttttagcaccagggaccagtttcatggaaaacaatgtttccatgggcttagggggtgggagatggtttcaggatgcttcaagtgcattacatttattgtgcactttattttgataattattatgttgtaatatataatgaaataattatacaactcactataatgtggaatcagtgggagccctgagcttgttttcctgcaattagatggtcccatctggaggtgatgggagacagtgacagatcatcaggcattagattctcataaagagcacacaacttagatccctcacatgtgcagttcacaatagggtttgcactgccatgagaatctaatgccactactgatctgactggaggcagaacagagctcaggcagtaatgcaagtgatagggaatggctgtaaatacagatgaagcttagctcgctcatctaccgctcacctcctgctgtgtgacccggtccatggcctgagggttggggacccatgctctacagcactgttatggcatgttccagactcttgagaatcggtccttccttgcatctcacctcaccttcaactttattgttcacttttagttcaacctttgccagcaggtaaagaggtaaagagaacaatgtgtcctgtgaagtatttatgagagaagcagataaatcattagatttattgagaacttttgaagtgcactaggcatctcacacacattacttcattgaatcacctccataatcctatgtggttgataattatattatccccacattctggatgaagaaagtggagctcagagaggttatcatgacatacatactgctcacaaaaccattctgtggcagaagtagattcaacagctcaaaaataaaagagggctgggcacagcagctcacacctgtaatcctagcacttttggaggctaaagtgggtggattgcttgatcccaggagtttgagaccagcctgggcaacatagtgagaccctgtttctaccaaaaaatgcaaaaaacaaaaattaggcaggcgtgatggcatgcacctgtagtatagcttcttgggaggctgaggttggaggattgattaagcctggaaggttgaggctgcagtgagcagtgattgtaccactgcactccagcctggatgacagggcaagaccctgtctcaaaataattaaaaaaaaaaaaagtaaaagagaacatgatgatttatggggaaattgacactaaaaatgtcttggatgaaataaagtgacccaggcatcaggatttaggggcttacatgggataacactgttctactccatagcacctcacctgtctaattagtgtctaattagagacatttttaatcagataagtgcatttatgaacattgcaatttttcccaaagtttaaccatcagtttctctgaaaggacttctaaagcctagaaactcacctcttgttaatagtgctgctcttcctcttaaggattctgcccaggagttcaacaccagcctgggcaacataggtagaactttgtaaagtggaataatgctattctaataacttatttagcaaacatttactgagcaattaccctgggtcaggcctccttgcaaggttctggggacatagacatgagggaattctcacccttgaggccatcacagtcagctagggaagaaaagaagtaaacagatcattataaaaccctgagataagtgctactgtgaaggtatgtaactctgtcccctgggtgctttggaagtgtgagagcttgggacattgtagcaggatgttggtagctccatcagatctggagtcttttccaccttgaacttgagatcagcctaaagccaaacacttgacttttaaatgatttgattttaacagaatcaactttttattatgcaaactcaaaagatgtattctgtagagttttactgagccttttttccctttaaaataactaactatatgttttgacatgcttcaggggactttttttgtaaaatagcacaaataggacaatactggaatacatcagtgtgctgtgaagcctgaatgagtaatacacaagtgactgcactttcaaaaatgtaaagaaaagtaacatgctaaaaatcataaactacaaagaggcggcatagcttggtgagacaagcgttgacttgtgaacaggaaaaaaaggatccctgctggctattctgctgagtgaccccaggaggtccctgttcctcttgggacctcagtttcctggttggtggaatgggtattggatgagaatctcaatctgaagatctgcattccctttcaagtcgctaaaatcctggacttctacgataatgctgcatccttctgaggttccaaacaacaatatgcagtaggggccccttttgcttccttccttgcatgtatccaggcagtctcctgagagcatccagcattggggaggaatggggtgtattgaagggaaaagcaggtgccccattgggaatgggacactcccgccccccgccctacctccttctttcaacttgacttccttttttttttttttttgagacaaagtctcattctgttgcccaggctggagtgcagaggcgcgatctgggctcactgcaacctccacctcccaggttcaagcgattctcctgcctcagtctcttgagtagctgggattacaggcatgcactattatgcccagctaattttgtatttttttagtagagactggctttcaccatgttggccaggctggtcttgaactcctgacctcaggtgatccacctgcctcagcctcccaaagtgctgggattacaggcataagccaccgcacccggcctcaacttgactccctttcttgtcactgtttctagatggtcaactagatcaatactcagatcagctcttctttcagaggaacaaatgagaactttcctcttgttctccatctcctccttctcctaatgcacacacatgtgcatacacacactccactgccatcactagagagaaggaattaggtccaaacctctgttcgcactcagagtcttaaagtgacagctttacgtttacaagttaggcattaaatggaattccattctccctgtcaagtttcagacaggggaaagcccagaattccaatagtgatggtgttcttggcaagcgctttttacagggtggtaagctaatcagtctgcagttcggcagtctgaaggcttgagctttcatctgacttggaatatataaagggcttggcattgcagcttccaaccctatgacttagctttgagcttcgcatcttcccatcaacttcgtagctctctccatcaaccaagtacccactacaatcaaggagaaaggatatggcagattaattgaatctttgtgtctttttagcacctgtgggctatggacttcttgaaattggagttacttttattcctttgaattgagcccaataccccgcttcagtcagggtgcttttaccttcccagaatcctcttgctaaggacaagcaggcaggctaatcggggactactgaagttttctggctcaaagaacataatgcagtgtgtttacaaatccacctcttcgccttcaccctaaattttcctttcctttatatgattttagcactttgggtttacattaagctctcagttacttaaagtaggctgaagaaaataagaagtgtagtagtgcttcactccccagtgatgaaatagggggtaattggctccaaaaatcgttgcatgtcttgtccctttcagggactttaactgctctgttgcccttgctccatggattggggctgcatcagtagcctaatgtgaggggaatggttgaaagtaattgtcagagcccagagctccacttgccatggaaagcctattgactttaatagtgaccatctggctgggcacctctgaagatgtctcagttaaggcctatttggtgaatggacctttgcttatttgaaagctacactgctgttccaacctgatcattgcattttatgtgatgggcactggaagtccaaatgaaagtttcttagaaaacactcccattaaatttaccagtccatgtgtgattgccactttcagtgcagtcagagcacagtcattctctttttattgaaagcatatggtaggtacttagagcataccctaggccagactcagttatggtgccatcaagggcagcaagaattaaaaagaggaaaatggtatccaggtggcagtaggaattcggtaggttggatggaaaatattcatagttaacgagctttcataaggagaacagaaacaagttagatgtgatttgcagatccataggcaatcagtctctgctgagcagaggggaaacttggagaagattctcagaagtgtgcctcacccttgacccaaacctttccctgaacatgtgcaataaatattattaagctttgagaatttctttaaaataatatctgtcaatggtaagtgccacatgccaggccctatgctaccagcatcatctcatatcatcctcacatgtatcctgtgaggtggaggatactatcccaatgttacagatgagaaaactgagacttaaacattaagttgttcaaggtcatacagctaagaagtcacagagctgctttgattaaagttctgtctgaggctgggtgcggtagtgcatgcctgtaatccaagcactttgggaggccaaggtgggcggattgcttgagccctggagtttgagaccagcctgggcaacatggcaaaaccctgtccctaccaaaaaattacaaaagttagccaggcatagtggtgcacacctgtagtccaagctacttgggaggctgaggtgggagaattacctgagcctggggagcttgaggctgaagtgagccaagactataccactgcactccagcctgagggacacagtgaaactctgtttcataaaaaaaaaggtctctgtgacttcaaggcctttgttctctatactattaggaagtccagtaagtgaagaaaagtacatgtaaatttcactaaaggatcacagcttcttgtacggaagggctttgagcacgtcggctgtggctcctgtgcagccagccagatctgcctaagcagctctgggagtagggccacacaggaatctgtcacagggaggattccacattccttcagcccctatcagcacagtcaaagaatggtaagaagaatgcagagggtggctttgaaatactcacagccttccatggataaaccatggagacattacactcatttgatagaagccagacacaaaaggccatattattgtatgattccatttatatgaaatatcagaataggcaaatccatagaaacagaaagcagattcgtggttggtaggtgatgggggaaagacttcagcaccatccccttccctctcagtctcagtgaagtggaaggaaggagtagtctcagctagggaaaagaggggaaaagctgaagacgacagatttctatgtctcccagtttaattacctttccctttgctctcgcctatgaatgccactgcctgcaggttcttagggaatcaaactgggacttcagtctggaaatgtgctttcaggacaaagacccatgcatacgagacaaggtgacaatcctaaggtggcccccagtacttcggggcagtggaaaggaccttgcgatgggtgccagaaggactaacatcaaggccagctctaccatgtctgaggtgtatgactgtgggcaagtttcttcattacaacttctgcaactgcacagtgactagcataatcctttcccattaggcactgctggatcattgcaaagattaaatgagggccaggtgcagtggcttacgcctgtaatcccagaactgtgggaggccgaggtgggtggattgcttgagcccaggagttcgagaccagcctgggcaacatggcaaaacccagtctctacaaataataataataataataataataataatcatcatcatcatcatcatccaggagtggtgaaatgcacctgtagtcccagctaatcaggaaactgaggtgagaggatcgcttgagcctgggaggacagggctgcagtgagccatgatcatgccactacactccagcctgggcaacagagtaagaccctatttcaaaaataaataaataaataaggagacatatgtgaaagcatttccgaagtctaaagctccacatacacataagtgattataagaaatttaacaaagggtagtcacataattgacattgtcctttggaggagagaaaattggtgctatccccttggtggacaggttccctcatccttaaagcacatttccagagcagaaggaagccttcatctaagtccaagcgctacatttctgatatgagagctagtttgagatttaaatgaaccctgtctctcaagacacagctttgcatctattttgcattcaaatttatttatctagagacaaaattgtgcattctttaattctactcacagcgtatgcacgcagaccaaatgaggtgctgatccagcaaaacggcaagtagccttttgcttccctgaaattgctaattttacaaatggcagagtggtgaaacgtggcacggaatatctattttactagaatccggcaaaacgggcacatatggtcttgtcaagaatgaatcaaacacagtttcgggattataattaagtagttgaaattccaaaaggaagaagttaatatgaacaaagtgagatttcgattgcttttggttagcattctctcaggctccttcctttacacattatcaggaacatagctactttgatttcttgtcctgaaaaatgtttaattgtaaaatatcaaacgttttcaccccaactctaattgtacttgatttgacatctgtacaccatgctcagggtaccaaatattattaaatgtaataagtccaggcatagaagtcaagccaaatgttcctacgtaagtatttaggttgacaccttctgtcaacaaagctaaacctctgaccaattctgtagcaggccaataaagatacaggaggaagatgggaaccattagaagaaaacactctctcctcatctctctctctttcagtactgtttctacctgaaatcagggacatattccattctggtccacaagcccagcatctagcacaggggctggcatgtaaaaagagttgatttgggctgggcgcagtggctcatgctgtaatcccagtactttgggaggctgagatgggtggatcacctgaggtcaggagtttgagaccagtctgaccaacatggtgaaaccccatctctactaaaaatacaaaaattagccaggcgtggtggtgggtgcctataatcccagctactcaggaggctgaggagggaaaattgcctgaacccaggaggcggaggttgtggtgagctgagattgcgccactgcactccagcctgagtgacagagcaagactccatctcaaaaaaaaaaaaaaaaaaaaaaaaaaaaaaggagtttatttggagatttgcaacttgtcatgggaaacattcccagggtttcttctagagttgttgtggacctgattttgggtgctaagtggtaactcactatatcttaaaaacacatcagctaaaaggtggaagcaatctacatgcccatcaactgacgaaggggtaaacaacatgtggtatatccatataatggcacgctatttattcataaacaggactgatatatgctacaacatggataaactatggagacattacactaagtgatagaagccagacacaaaggccatttattgtatgattccatttatatgaaatattagaataagcaaatccatagagacagaaagcagattagtggtgggcaggtgatgggggaagagggagattggtagataatagttaaaggatatgaagtttctatttgaggtgttaaaaatgttcttaaattgattatggcaatggttgcatgactgataatatactaaaaacctcaaattttacactttaaatgggagaattgtatggtatgtgaattatatttcaataaagctgttatataaataaaagtttacttcagattattttgatgtgcacttgcagttcagaagcttgagctagattaacagttcctaaccttagttttggctcctaactcctgtctcctctcagatcttaggaccttcaggttccacacagcctaccttgctgctacctagtttttgaagttctaattcccgaaacaaagaactcccttgaagagcattgatgccatggcggaggagaggaaacaagaacttttggttttaagctgtgtctacacttaaccaccttgtgcccacttgggtaggtgctctatcattgaggatcaggacccaattattcccattctcatgtttttccaggacctgacaaatcctaattcagattgctattccctttgagagtgaaatagcttaggtacgtttcttctacaacaatgcagatattctattaatgaaaggagctgctacaaagtaatttttaatgtttatataggaaagtgtaactttttttttttctggagacaggctcttgctttgttgcccaggctgaagtgcagtggcacggttatggcttactgcagcctcaatttcctgggctcaagtgatcctcccacttcatcctctcaagtagctggaactacaagtatgtgccactacacccagctatttgtttgatttttttttttttttgtagaaatgggctctcactaggaaattgtaagaaaaaggagtagctttcttaaaaccctggtttaacatgacaaacccaaaacattgagctgtacacttcattggttaaatcttctttttgcttatttaaagaaaggacaagaaaaaagaaaagaaaaacttttttgctagttcacacctcaaggtacacccagtttctgactttaaagggaatcagtccaaagtaacaaaatattattttgacatctgaaaaagaaaatgctcgttttataaattggatagtgatttctaaccattgttgatggacatagatatcttttgttaaagcctcatcaataagctcatatttctaggagatcatattgcgatgagaattatgaagagggaactggaggtccatgctggaaagtcagtactcctttaattcaactaaaaatatttattcaatagttaaatattgactgtgatatcaagtattttgaatgttggtaaaaattaaaggttttggcaaaatagacaatggtatacttacaagttttctgagggtggttcccagaatatattacccaaaatactatacagtgagaagtgatagtcaccattccatgtctttgaccacaaacatatcttaagattttctttgaagagggttttttagctttttgagacagagtcttgctctatcacccaggctggaatgcagcggtgcagtcatgggtcactgcagcctcaaactcctgggctcaagcaatcctcctgcctcagcctcccaagtagccgggactacaagcacatgccaccacatttggctaattaaaaaaaaaaatgtagagacgggatctcaccatgttgaccagactaggctggtcttgaacttctggcctcaagtcattttcccaccccggcttcccaaagtgttgagattacaggcctgagccaccacacccagcctgaagagggtttacaaaattatttcaccaacatgtaagaaaatgtaataggcattttaaagtttaaccattgtcagtcactcttttaatgccttagtacccagaacagtgctacttttagagatacgtatgtatctattttctgaattcatttttggttgcaaagcatcattctacaaacattatgaaagagagccaaatactgtgacttcaaggattatccaatactctataattagtttcatgaccaaaatgctttgaataactgaaaagatgagtgaatgactggatacatgaatacatatcatccatttatatgaaaatacttttgaatacaggcatatcttagagatactgcgggtttcgttccagaccaccccacaataacatgaatattgcaaaacagtgagtcacatgaattttttggtttcctagtgcatatagaagttatatttacaacatactatgttctattaagtgtgaaataacattatgatgactaaaaaatgtacatgccttaatttaaaaagagtttactgctaaaaaaaagaggctatcatctaagctttcaatgagttgtcgttgttttgctggtgaagggtcttgcctcgatgtgcatggttgctgactaatcagggtggtcgttgctaaaggttggggtggctgtggcactttcttaaaataagacaacagtgaagtttgccacatcaattgactcttcctttcacaaaagatttctctgtagcatgtgatgctgtttgagaggattttacccacagtaaaacttctttcaaaattggagtccatcttctcaaactctgctgttgctttatcaactaagtttatgtaatattctaaatgttttcttgtcatttcaacacgattattcacagcatcttcaccaggagtagatcctatctcaagaaaccactttctttgctaatccttaagaagcagctactcattccttcaagtttgatcatgagattgtagcaatccagtcacatcttgctcctcctctaattctagttctcttgctgtttccaccacatctgcagtgacttcctccactgaagtcttgagcccccaaagtgattaatgagggttggaatcagcttcttccaaactcccgttaatgttgaaattttgacctcctccattgaattacaaatgttcttaatgacatctagagtggtagatcagttccagaaggtttttactttacttttcccagatccatcagaatcaatatggcagctatagccttacaaaatgtatttattaaatgataagacttgaaagttgaaattattccttgatccgtcaactgaagaatggatgttgtgttagcaggcatgaaaacaacattgatctctttgtagagctctgtgtagatctccatgagagctctcaggtgaccagatcagtgagcaacaatattttgaaaggaatcatttttctgagcagtaggtctcaatggtgggtttaaaatattcactaaatcatgctataaacagatgtgctttaatccaggttttgttgttccatttatagattactgactgagtagatttaacataattcttaatggccctaggagttttgaaatggtaaatgagcattagcttcaacttaaagtcatcagctacattagctcctaacgagagagtgatgctgttcgttgaagctttgaagccaaatatagatttctctctagctatgaaagccctagatggcatttacttccaatataagtctgattaatctacattgaaaatctgttgtttggcatagccaccttcataaatgatcttacctgtgtcttctggataactggctatagcttttaactcagtacttgctgtttcactttgaacttttatgttctggagacagcttatttccttaaacctcatgaaccaacctctgctagcttccaacttgtgttctgcagcttcctcagcactcttagcctttacagaattgaagagagttagagccttgctctggatcaggctttggcttaagggaattttgtggctgttttgatctatccagaccactaaaatgttctccatatccgcaataaggctgttttgctttcttatcatttgtgggttcaccagagtggcacttttaatttccttcaagaactcttcctgatcaatcacaacttgacaaactgtttggcacaagaggcctagcttttaccaagaggcctagttttcagactatcttggcttttaacgtgccttcctcactaagtttaatcatttccagcttttgatttaaagtgagagatgtgggactctttctttcacttgaacacttagagaccattgtagggtagttactggcctaatttcagtattgttgtgtctcaggaaatagcgaggcccaaggagagggagagagatgaaggaatggctagttagtggagcagtctgaacacgcacaacttctaccaattaagttcaccagtttatttgggtgcagtttatggtgcccgcaagtaattacaagagtaacatcaatgatcactgattacagatgaccataacagatatagtaataatgaaaaaatttgaaatattgtgaaaattaccaaaatgtaacacagagacatgaagtgagcacatgctgttggaaaaatggagccaatagacttactcaatgcagggttactacaaatcttcaatttgtaaaaatcccagtatctttgaggcacaatgaaatgaggtatgcttgtctctactttctgaatatgcttttggttgcaaagaatcattctgcaaacaacatgaaaaaagatccaaacactgagacttcaaaggttattcaataccctatcgttagtttcataaccaaacaaagagaaatgccttgaataaccaaagggatgaatgaatgaatgatggatagataaacacatgtcatcaattcatccaaaaatacctcttttttttttttgagatggagtctcgctctgtcacctaggctggagtgcagtggcttgaactctgctcactgcaatctctgcctcccgggttcaagtgattctccggcctcagcctcctgagcagctggcattacaggcatgtaccacaacgcccagctaagttttgtattcttagtagagatgggggtttcgccgtgctcaccaggctggtctcgaactcctgacctcaggtgatccacctgcctcggcctcccaaagtgcagggattacaggcgtgagcctctgtgttaaaaatactttggagtatataggccaggcacggtggctcacgcctgtaatcccagcactttgggaggccaagacaggtggatcatgaggtcaggagctcgagaccagcctggccaaaatggtgaaacccccatctctactaaaaatacaaaaattagctggacgtggtggtgggtgcctgtaatcccagctacttgggaggctgaggcaggagaatcgtttgaatctgggagatggaggttgcagtgagctgagatcgcaccactgcactccagcctgggcgacagagcaagactctgtattgaaaaaatatatatatatattatataaatataataatatattataaatatatacatatatatacatatatgtatatatatgtgtatatatatatgtgtatatatatatgtgtatatatatatgtatatatatatatatatatacatatatatatacacacacacactttggagtatatagttttaatggtggtaagtgctctaaaagaagaagcaagtgctatgagagcatatattagggacctttgacccagcttgggatttatgtttaatttgagacgtgaaaatgattaggagctaagaggggttaggctggagagagggtccaggtagagacaatatgtggatccaagaaggaagaacaaagggatcaacaaagtgatagaaataggccgggaggggtggctcacgtctgtaatcccagcactttgggaggctaaggcgagtggattgcctgaggtcaggagttcgagaccagcctgaccaacatggtgaaacctcgtctctactgaaaatacaaaaattagctgggcatggtggcaggcgcctgtaatcccagctacttgggaggctgaggtaggagagtcacttgaaaccgggagccggaggttgcagtgagctgagacagggccttggcactccatccagcctaggtaacaagagcgaaactctgtcaaaaaaaaaaaagtaatagaaacaaagacaggaagcaaagagaaagaagataatgacaaggattaaagatgcagctttgaggatggcaaaaccgcagagaggagaactattaggatggtgcaaaggtaattgccagtttcaccactaaaagtaatgacaaagctcaaggtggtggtaggagggacagctgagtgactcctgagaaaatgtaaagtgctgaacctttgtagtttggaagacttggttaaccagaatgattcattccccaattatgccacatcttcaagattttactgtaaaagcaagcaggctggccctggcattcctaccataagctggtgcttcaacttccacatctggcagaggctctagatgtcacataaattgaacatagtcatccagctcaaagggggcttggggtcattgagtccaattttcattttatagctacaaagtactgataactaaaatttacaaagtaatgcacacgtggcagccactgttctaagtgtttactgtgtattaccccatttaaccctcagaacaacccagtgaagtagaaactattatgattcccatttacagatgagggaactgagacacagagaagttaagtgacttgcctatggggtcacacagctcattagtggtgctgtagaccttgggtataatcacttgtctgtatctctcaaaaatcatacagctggatagcagcagatccaagaatggactcggctgtctcccagtgcagtgccctttctactatggtaaccagaactcgacggtgctccctcagttggttgtaaataacataatcccatagtaattgcaaggatgagaatgaacttttcagtctccctgtccccacgtttttggaatggttctacctctgagagcacatgaactcagcctagttttggggctggtctgcccccaattttaacttccatcatggcattgccatttgaacagtgagtgttttggagctggcagaaggtatttttgcgcttcaattcaattcagcgatcgtgttagaagccatcctccaagtgtccaatgatgttagtgtgtccctttgggagtgatttatagtcaaatgggctgcattatagggtgatgtgctgaacaggggaccaaagtatgaccagcaatgctagagattagatttcaaggtcgttgagtaaacctgttgtcaggatttccagggatgatttgattgggaagaaaatgcatctttgtttcatcatttcaaagcaattttatgctttggttctccccgtttctgtcttctgaacacttccaaggccacacttgagcctcagcatcagcctgaagtcttgtgtgatagagttgccatgcaaggtctctctgggggtatgttgaaagctaccagtaagacttgactttgataaaacgtttaattgttttcttttgcctcaattaagttgagaagactcaaatgtagcttttaaattgaaaagtgtaactgagtgagaaggtttatatcaaatattgaaaggctaaggagccttttaatacattgttagctgtcaatgtgtttcaacaaattgtttcagtcactgttgtgtttcagtcactattacaactggggcctgcaatctgaagtgactcaggggtccatatctctggacaaggatatccacttttctgaaccgaaccaaggacgaggtagagtgggacagaaaaggacagattctagagagctttcccaagggacacgtctggcacctggaagtggtcgagcctaatgtgtaaagatttcaaataccatctggtcatttctttaggacctcatttgacaatctgtgggattgttttttgatgtggtgccagcccgaccaaatgaagtttctttcaatggtgtggttggtgtctgctgagaaagcagaagagggggctcttgtttagctcacaaccattgtgtgttaggcattatgcttgagcattttacatgttctggaagtattctcaaccctggctgcgatttcagtcacccagggagcttttcagaaacactgaggctcacacctgtgatcccagcacgtttggaggccaaggcgggcagatcacttgaggccaggagtttgagaccagcctagctaacatagcaaaaccctgtctctactaaaaatacaaaaactagccaggcgtggtggcgtgtgcctgtaatcccagctacttgggaggctgaggcaggagaatcacttgaacctgggaggcgccggttgtggtgagccgagagtgcaccactgctctccagcctgggtgacggagcgagactgcctcaacaaacaaacaaacaaacaaacaagcaaaaagagacattgaggctcagttcccatatcctaagattctaattcattcagtcttaagtaagaatcggggcgtttgtaattttaaaggcttgtcagatgactcatgtgcaaccgaggtggagaacccctaacttagagtgtcttgttgaatttggggatatttttctgctctgctcatccatccgcttgcaacttagagggagagtcacattcttcatggtgacaagagtgagaagtgtatacgttggcctcaatactccgaatgcctgtgccaaattccttcggcaccttgctttgatggtttggattgcctccctctcctgcctgattccagctaatattgctagctttccaggcgaatatttttggcaacccttgccttctgcattcaaaagaattgcttgccttcattactttatgactctcccagtgtgcaaaagtctatggagaggagacttttaggaggccccaagcaaataaggcctcatcttccatttaaggcttcattcccaggaactttcccaatacaaacctcagtgctcctgggctggccttgctggagagggcttcctgaggcggagttattgggacctgagggaggggttcctagagtgcagcaattccagactgaaattcccaggcttggggtctccctgggaattccctcaggaggaccctgtgtgcatttgggtgaaagaaagctattgttgaggaaatttgccctgccagggaccccagggcctactttgggtgtgtgtgggtgggtagagatgaaggggaaagttccagctgcttcagatggtggcgaatgacttaaacaaacaaggactggggcttggaagaggagagactgcacgtgcctgggcaggtttcaggttcctgacaaagagacaaatctgagagagatttacagacaccctctccatctatcacacaaatctgtgtcaagattttgagtctgcaaaacagcaccagcattatttcattgtctctgtgatttaggaaatgagattgaacacttgtggaatacccactgtgtgccaagcaccaggcaccagggtattcattcacccatatgttaccctagcaaatgatttgattttcaaagtatgccctgaagtgcctatgattactatcccaattttatggatttagaaactgaggcccaggtcactgacatgatttactcaaggttacacaaactgtgtaagaacctgggttaacctgacatataattgaagttatgcttcttttacttcacctctcatgaccctcttcccctatgtctttttaaaaggatatacatattgttacttttcttctcctaaatgttgcctagatttgctttctccatagtttcacctttcattcttctttggttcctgaatctggcttctatcccagcatctccaatgaagcagtactcctgtaggtcatttgatgaccaaaccatcaaacccaaccctaatcagtccttatctaacctgccttcatagtatttagcatgaatggtctctctctctctcttgaattggactatctcattcattttcataggtgtaccagctctatgctgatcaatctcaaatctacctctgcagtcctgacctctctcctaagcttcaggcttatccatctactgcctactagacttattcatctgggatatcctacagaggctccacacactcccaaaaggaatccagcatttctcctaaccaccaccccattcaaccccctttgcaggatctatgaagccagcaacttgggtgtatcttttccctcacccactcatctaaatcagtccatcaagttctctccattctgttttgtgattatttcttaaagacgatctctctcttctctacgcccaagactccttctttaagtgaggattcttttcaagagccttctaaaaagtctctctgaatctgcttcactgcatgagtctgttttccatgccgctgacagagatcttttgaggtgctaattaaactgttccatggctctcagaacctctattttccaaagtacatttgcaacctatttttccaggatactctgtgaaaaataggaccactgtggtcaagtagctttggaaactttctgtgtactatactttttgtttccttttggagattcagatagcatattaaatgtcctgagaatcccttaagttaaaaacaggcttacatttacatacttcagcatcccaaatggatttcatcatggaatcacccctcctcccaaacactcatatttttaagcatgagtcctgctcacaaccttctgcagaacacatttgaaaccacaggatgaatgctgtgatccttggcctgccatacaaggctcttgttcatctgacctctgttcacctgttgatatggttaggctttgtgtccccacccaaatcacatcttgaattgtaatccccataatccccatgtttcaagggagagaccaggtggaggtgattgaatcatgggggcaattcccaccatgctattcttgtgatagtgagtgagttctcatgagatcggatggttttataagtagcagtttcccctgcctgtgctctgtctcctgccaccatgtaagacgtgccttgcttcccgttcaccttccacctcaattataggttccctgaggcctccccagccatgtggaactgtgagtcagttaaacctctttctttataaattgcccagtctcgggcagttctttatagcagtataaaaacggactaatacacttgtctagccacctctcccccttaaattctcactactctcaccattcttgagaatactcatcttcctcacatacctctgtgttgtggttttgtttttgttttttgcttgaaaagctattcccctcccctcaccatctcggcctgccttcaactcatcattgaagacccagctcaactgtcttcccctctatgaagctttctcttattttctgcaagggagaagtagacaccccttctttttacttagaatcttcctttataccttgaatattacacttaggacatacgaagttattctatgtctacctagccttttaacctttcaaaccaattgggttattgtcttatatcttttcatgttatgactacctttatctcctgtcagaagtttggactcatcactgacccaacagaaaacagtcttatcctttctagtttttggtaagacagtgtatgtgagaaaccttacagttaggtatgggtggaggacatgtcaatccagagtgtttgctaatgtgttcagctacagtccacaatagcatgtgccacagtatgctgtctcacctagatggtgtgtagattggcttgattgtaggtatatggtggataataacatcttggcacagaaacaaaacccaaaggcaccttatcccctgctcctaagacaggctcaaggctcagcttcagctagttagcctggatctgtattcagttttccagtcatcttgaggctgggggctcggagtagcagcccacctcatgaatcctgctcgtcagtaaggggaatattcattgtcaagggcttactctgttcaggcactgtgctaagtctttgcctgcattatctcatgtcattctcacaacaactccattaggtggaaactcttattttcatcatgtaacagatgagtgagcgcactgaggctgggcaagtaaaatgacctgtcaacgagccatagcttcaggccctaatccagcctgtggcactgccctgatgggttaccttgggcaaatcaattgatctaactgagactcaatgtcgtcatctgtaaaataggaacaatactagtgtctatctcatggaatagttatgagggttcaatgataggatgcatgcaaagtgcctggcatagtgcctgacacttggtaagtgctctataaatggtagctattatgcgctcacatcagagacgttgttttcagccaggatgaagggaggcatgagggcagttttatactgaaggagagggtaggtctaaaaattatttggatgatgaaaaggtcacaatcctttgggaggcaaaggaggaaaaatttatcttaaacacagggagggagatggcagccaggtaccagaactcttgatgtgtaaagggctggccatatggagactgaacaaagtcagtgaagcttggctcctgtgcaaatcagagatgggctcaacatgtattccatgtagctgatcttgcatgtgcacggtggtttctgatgcctcccccgtaagggcagcttcatccactcctgtgagaaatgcagctcacagatgtggaggaccatctggagaagggatgtgagtgaaggtgggtgactgacagtgggtggagctggagctagggactcaggcggcagacctactgggttagaattacgactgtgccacttgctagctgtgtgggtttgggctatccactatctctctgagtctcagtttccttatctgtaaactggcaatagtaagggtaccaaccttatagggttattgggaggaacaggggaatttattcctgtgaactacttagcacagaccaggcacatggtaaaggttcaagaaatgctgatttttcatcattattatgtgttctggacgtggcaggggagatggggccaatgtggaggatcatagggcttgctgaaacagtcccaaatgaatcttcttcaaattaacctctgcaaatattgcctctgcctccattaatttagagaagctttgcattcttttctcttaagtttattttgcagctcatgtcttaatgagctaaaaaaaaaactatagaggttttgatccaatttcagactaccctgtaagatatcagcatctgacagttctgctgtactctttcaggcattttacttgaaatgatagtaatgtgatatttgcatccagtgcaaattatgaattttcactaattcttagattagatggggcttaactgctaggatgcagcttgcacatttaatctacttcagagcagcttcacttactagatggtcctcatgggtctggggaaaggatgtaaaatatcatcaatgaggtatgaagcatgttttaaaagatggagtcttgttttcagagtggattgaactgctgctaaatcacagccattacccaagcacacatagcatgtattccagcctgagttgccaccagtttttccttgtgacttgatccagtcctccattccctgctggcagtttgtgcacccctttgcttttccctgtgctgctcaggcaggtggttgctgcctaattaaacacccacacagcaattctctctgttttcttcctccattccaggatactgtttattcttgtttttacatttttttggaaaaatgttttgaagcaccttttgaaaaaagaaacatagtgctgatgatcagctaaatgtttttatagcttttcaggaagtgtgaaatgttctgatagctggcagccaagtgtcaagaaggccttggagaaaaagaaaaggccaattccaactcctttaaggcaacttttagaaaagatttagggctttaaattcagcttcacatactacctcccaagtcctctctaattagtagaaggtaaaaacattttggccgggcctgtaatcctagcactttgggaggctgaggcgggcagatcacgagctcaggagtttgagaccagtctgaccaacatggtgaaaccccatctctactaaaaatacaaaaaaaaaaattagctgggtgtggtggcacgcacctgtaatcccagctactcaggaggctgagacaggagaatcacttgaacctgggaggcggaagttgcagtgagccaagattatgccactgcactccagcctgtgcaacagagtgagactccatctcaaaaacaaaaaacaaaaaaacaaaacaaaacaaaacaaaacaacgttttttgctcaatccagcatctgatatacattttaactactttattgagttgaatttatatttaatagagttgtattctgcatgttgaatacatacatcattgtatccagaggccattgtttatttaaagaacttatagaacaattgtctattttaatttattatagaagctacactataatttggttgtgattgcctttatgttacatgcatagtcgtatctgtgatatacttggagcctaatctctggtcaagattgcagcattattttcatgggaaaatgtatgccatgacagtgacatgacttctggcctgcagcaataaatgcatcataccaaaactggagaagtgagcatagcccggtgtctgctgcataatcggaattcattcaaagtctgctgaatgagtgaattaattgtctatattctgttcagacacaactacgtggaacatgaaagactgagaactgttctctcaagttccatcataatcgacaacttcagacaagcccctcaactactcgctgtccccatttccttagtaagggctatccatctcataaagatcttaagaagaaaggacatggagcattagtctaaaatgccattctttaaaagtgatatttaggccgggtgtggtggctcaggcctgtaatcccagcactttgggaggcctaggtgggtggatcacctgaggtcagaagtttgagaccagcctggccaacatggtgaaacctcgtctctactgaaaatccaaaaaaaaaaaaaaaaaaaattagccgggtgtggtggtggcatgcctgtaatctcagctactcgggaggctgaggcaggagaatcgcctgaatcctagaggcagaggttgcagtgagccaagatcgtgccactgcactccagcctgggcaacagagtgagactctgtctcaaaaaataaataaataaaataaaataaaagtgatatttaaacttcattaaaagtagaagaaagccaaatgcatcattttaacttattttttttctttttactcaaccagatagttggtgacatataatcaacacacatttatcgagggatgctattgtaggtactcagcaccgtgctagacacagggaatgccaatgttcctgctcagacagcttccaatcctgttgaagagacaacccttctcaacactggttctattgacattctgagctagataattctttgttgtagggggttgccctgtgcattgtaggaagtttagcagcatccctggcctggccctggcctactagatgccagttgtacccccttcctagttgtaacaatgagaaatgtctagacatttccacggccttccatttcctctgtgatgcaaaatcgcctcctactgcaaaccactggtgtaaaaagtgatctgtcatgcaaattagtatgagacagtcaaatgaggaagtaatagggagtggaattcactggcgtgaatgagctggagtaatcagagacttaaactggacctttaaaaaactgagtgggattttgataagtggcaagattattgcaggtatagaaaattgcatgtgctatggttctaagactgcggtgctgcaatttggtgggtttgtgggatggcctagtgactaactgactggcttgagtgaatggagaggaatgcagatagtggacaatgaggcgaataaggtaggctggttgccacaatgtcagtttaaaagagcggcaggatgcagggggggtttggatagtgactctgccagtagtgtgtaggatggtttggagtgaggatggatgggggaagggctgtaactccccttatccatgcttttacaaagagagaggggaaaacaagttgaaatagtgaacacagattcctaatgcagcaatagcatctcctaagctttgtgtgcactagacatcacatcgctcatgtcatagggtagattctgcagatttgtttttctttcttctttttgcctgtgatttggagatcagaagatgtagatgccacagatttgtctttgaaagtaattgtcttgttcttcacattaatatacttcattaggtcttttagattagctcctgggactaaaatccatattcttcagacagctctctttgcaactgtgtcttgcgacaattctcttttcaattatgttgtgccactttcatatttctttcaaaatgttctcaatcaattttgccggcactttctctcctccaataatatggcaatgtattatcttattcgccatccaccccatgatcatacaattgttgcaagcacctggaaaaaacttttttttcattttgtcaaacttcatagtatttacattgatgagtttaacaactacatggcatgtagaatgtccatgaagaactccacataatcagcatctaaatttgagtatttgaatgtttagggcaacaacatgatctcaggacttctttttttcaggacctaagacaaacaaaaatggctgcaaaacatgagccttgtactgtggctgatatcattgaagcacgagttagctgcaagaggaaaattcacttggtttagtagcggaaaggtgatagagaagatctctagcacaactaatctgaaaattattaaaatctaaaaattaaggtagaaaatggcatgagaacagttttaaaagtcccatagttctgttcagtgaatctgagctcaatcggcttgccatttggtaatacaatgatgtggccttggcagatggtgagtcagtggaaggctcagtattattcaagctcagtttatataggaaagaagcagaaacaacacccccgttttcttgcattatgtctcataaagaaatctttttagtaatttcacttagaaaaggaaatactcaatgtaccctttcacatatctgaggtaggataagctcgcagaatcagtactagccctgaagcttctacatgcctcttattgtgtgagaggaactggaggaagagcggcaaaccatatgatcgctgacctcaaggagctcacgactgagctgaggtaattgagtagctgtgtgtggcacacctaaggtcactatggtctggagaactgtagaaagtttcctggaggaggttgaatttatacttggttttgaaaagtaatgtagagagaaaggtatgggcattttgagtaacatgagaacagaactagcgtggtgtctatagggaaaagctaggtgctctgctcagctggtggagggaagcagagaagctgtatatttagggaaagagtggaagtaaggctgatggacaggatgcccctggctgtgatgagagtgttttggaaaacaggctacttagtgtcgtcagcagtggtaaccactgcagtccatggagcagagatggatcatgaagaaaacggtactttgggccgggcacagtggctcacgcttgtaatcccagcaattttggaggccgaggtgggaagatctcttgaggtcagaagctcgagaccagcctggccaacatggtgaaaccccatctctactaaaactacccaaattagctgggtgtggttgtgcacacctgtaatccccactactctggaggctgaggcaggagaatcacttgaactcagaaggcagaggttgcagtgagccaggaccacgggactgcactccagcctgggcgacagagcgagactccagatcaaaaaagaaaaaaaagctactttgaaggggaaactcctttaaaactggagcagtcctaaagtgttcaacaacccaagtttacataaaatgaattgtgatgattcctgtaaatctgtaaatataggtcatgctgatctgttccctgaaggtgcttaaaccaacctcaacttcagtcgtccatgcctttcatgactcactctggctttccccagatagataaggtctctctgcatgagaagctgggatttagcttcatagcagttttgagacacggtctgtaggagcaatttttcaagaagcaagactatttgcacttcgtcctaaaaataaatgtttggggtggagagcagaaaacagcaaatagcactgttttataaatgaacaaggaggttcaggagcttttctctcaaccccctaaaccttcttctgggagttcctccaaacctaaagtcacacccatctgccagattgtgtaaagctgagtcctcggaatgtgaaatttatgagggcagggactttgttatgtccattctttattcccagcccttaaaacagtgtctggaacacagtagatgttctacatttccccctttaaatcatatgctgtggaattcataaactttccatttttgacacagacattatttgaataatcatctttattttcagttcatccatttcatattgagtttttaaaatagcagctttattgaagtacaattcctaagatacacaattcacccttttaaggcatacagttgggtggtttttagtttattcagagttgtgccaccatcactactaattctggagcagttttcacacctccataggaaatcccataattgtcagcaggcactccacatttccttttccctccagcttttggtggtcacaaatctgcttactatctctatggatttacctatattgaacatttcatgtaaacagaatcacacactatgtgatcttttgtgtctggcttttttcatttagctaaatgttttcaaggtgcatccctgctctagcactatcagagcttcacttcttttttgtgaccaataacattcccttgtatgagttaatcacattttatttatctatttatccattgatggacatttgggttatttccatttctcagctattatgaatggagctgctatgagcattcatatagaggtttttgggtggacaggtgatttcagttctcttggatatatacctaggagtggaattgctgggtcatatgatgatttcaaatttaactttttgagggactgtcagactgtattgcaaaatggctgcaacattttgcacttctaccagtagtgcatgagggttccaatttctccacatctttgtcaacactggttattcctggtcttttttatataaccatcctataatgttaatgagttaatgttgacttttggattataaatatattatatgtatatattatattataaatatataatacatatttattatatattacatatttataatatgcattaatatatattatatagtatatataatcaatatattcacatgattaatatattaatatctttaatattatatatttataatctatttatagattgtaaatctataaatatgaaagtttatgttaatacattataatatataaacatatatataatctattatttttatatctttacataaatatataaatataaaagattacattaatatattatatattaatatataatctaaattatatattaatataattggattatataaaatatattatattttatattacataatatataatatatgttatattttatattatagactatattatatgttatattttatattatagaatatataatataatatatattatattttatattatatcatatataaaataatatatatattatatattatattaagtatatattatattaataatgtagttctatatttttatatattgtatattaatcattacagttaattatattgtatacaatataattatattgcatacaattatattgtgtacaatatcattatatagaatacaattatttatattgtgtacaatatcattatatagaatacaattatttttattgtgtacaatataattatattgcatacaattatttatattgtatgcaatatatacatatattaattatatatatattaacaagtgtgaaagtcttatactttgcctcagaaatggccttgccagcacaatatttcccttcttgcatctttagtttgatgtgttgttgttttatttcctcataaagcaaatgaaaaagagggattggggatctgctaaaccagatgttagcactttttaaatttagagtgtggtggtcacaagaaaacacaactgggccttgagacggcatggaaaattctagaaatgtgtcatttcacagcatctgtgcagaaactgcttctgtgccagcatgttacatttgaaaccacattttgtgtgtgttcaacttttacacagatctcgagaaaagtgaaattgaattttatgcatctgtaatttgatttcagtccatgaccaggccatttctttataataattataagaatgtatccaatatatgactttcatcttctggtaattacaacaatttaccatttatagaacacatagtttaagacaccataagtaacatttcatgctaattgcttttctgaaaataaagggctctgttgtacacatccaagaacaatggtaggagaaaagaaaattgattgatacatcacatcaaagaggagatcaaaatgaagtcatccaatatatgccaaaggctctcataaattacaaattttgaactcactccaaactttatttttaggcaaatacagtatcttcaagtctcattatgaaagttacttcaaagatgatttgatgtgacagtatttttcccaaggctttgcctgttttctattcctaaggcttcccatgcgagcagggattcctggggcccaagctcaagcaaccaacttatactttgaatttgaactcaaaggacaagaagcccatttttgtgatgtgcttccccatttccttcttttgagcctaattgaagaattaaaagttgtcttcatttctaaagttatatgccgaacacaaaggggggtttcaacagctgcttcttgtcatgctgtgggaaaaaaataacatctcatctgaaaaatacctccaggttctccagatagttcttgcttttctcactcacatttttctctttacatgaacagatttggctcctcttcttcttttgtaggtagtatccattcagtaagatatttttcagatattgagagtaatacattgttcattagaaaacaaagttaaacatccataaaatactaaaaagaaaataaagatcacctgcagtgtcacaacccaaagtgtatcattttgctttagtttcttacactgtttgtttgcttgcattcattctttctttcactcgttgcatatttactgagcacctactatgtgccttgcattgtggtaagatacaaattgtgatcctaattttctttataataattaggtttataattgttggcatagtccatgcctcctctcctagactttagtgtctgggaccatcttactcaccatacatcgtattatgaccatttaccaggtcattaaatattatctgaaaataaaaagtttaatggctgcataagacttcactttcagcatctactagaatttactatttccttattgatcatttaagatattttctttttattctgctatttttgataattataattaattaattccattttgaacatcatttgtaagggtatacacatttttatggcttgtgttgtattagccacactgcccaccagaagagccctactaatttaagcatttaccgcagtaggtgaatatttctcaaatgaagttgaaggaagttccaaaatggcagacccaaggaactgaaagacttacccaatacatccctttgcctccaaggagagacagaatgaccactaccaccagaggggaagccagtttgtttaagagaattgaaaaacaccagggagagctctctcaatataatagtactgggatttgggggcaagaataagcagtggtgcaggttgtttatttacatacgtttataaattatctttacagggctaagagtgaactggatgaatggtgttggcataacctcagagaggcaatccaaattttattaattctctgttatgtgtcagagcttgagttaggtgctatgagtgatgcatggatgaactaaacacagttcttggcctcccagaatgttaaaatccagtagcagggaaaagtgtgtgcgagctggaatttgaatgacctgggttccaattctgattcttctacccattatagcagtgactttggagaggttacctgatgtctctgatcttctgttttctcatgtgtaaaacagggtgaataacagagttcttgtaagaaggaaatgagataatgtgtataatgttcttaggagagtgtgtggcacataacactatagcagcactcaggagatgataactaccattgctttggtaatgatgtttcctatcttccaagggttttgtgatgattcaatgaagtaacaaatgcaaaacacttagtgctactacagtctcaaattaagatgacgatctgatgataatgacaacctttttggtgaagaacatatcacaagcgagttgtaccaaacataaatgagtaacaaaagggtagcttgccccttgtctcagagaaagtgagtctcggcatgggttgctgcagaagacagtgttggctctccacatcctgtgacaccaagacttattaaaaccagacattcaaagcaattgcaagttctgatctacacaactgttggtcacttccgcttttgcgcctacctcatttgaggcacctggagtgtgttttttcttggtagaaccgtgacaacatgcctattgctggcctggaattgtctaccaagcccaaagctttttagcagtgggtgatatttgtttcttgtgccatcgctgaataatgacttttgtagtctgaaattaaacaagcattcaagggctctaagtgtctggcaaaaaaagttagtggctggaaaagctgcagaggatgtctatgaaatgcaattgatgaacacacttttccccctgagctgctttcctgttaggtggtggaaactggtctatttcggtgatgtgtgctgacttcttcccttctggagcccatgcattgggtgcctccaggtttcaaaagaatgaggacaaattaactgttcttctaaagtactaatgctgcaggcccttctgaaataaaacctttgcagaatggaaaatattattgtcttcttgctttcaaaagttacttgtttacctgttgctcataaaatgcaggataatttgtggttgggaaaaggtattctttgcctgatgggtttaatttcagcaccgtagacttccctgaagattacaaagctattctattgctacacatttatagagctcaccccgaggaaagggaattagtgtctggcattaccttcctgcctgccaattttacctcactgattcaacctttgaaactgatttaatcaatggatcagcacattattcaaaggtggaaatgttattacagagaagctttcaggagggtggatgattcgtacaggcactacacaggacttttaatcacaccacataaaagaagcaaatttgaatgttgcttatgcccagaattttgatgaaaagtaaaattttgatgaaacgtgaaaaggagtactaggagaagcccatggcttggatttatgttggcagacatttcttctgagaaagaaaactcagtatgttctaatgtaaagatccacaaaatccaaaaaccacaccaatgggtaagcctattgaaagtaagagagatgagaggttgaacatgataaggaagctgaaaagccaagcctgttcccaatagtcactacactccagtggaagaattctcagtttttgtgcagagtcctgcattttgcatagctcagttgctggacaagtgaatgatcattttcctcatctgtcaaatgggaatagtaatacttctcaaggtgtttgtgaggatcatcagatactaaggattttacaggtttttattttccttatatgatgtacacgttctttacattgaaaaaattatttctccaaactagaatcttaagttccatgggtatgatgggtctgataaagtatttggcatctcttttactaggtagatcccactcaccctgagttttttttttttttttttttgagacagagtctcactctgtcacccaggctggagtacaatggcatgatcttggctcactgcagcctccacctctggggttcaagtgattctcccaccctagcccccgagtagctgggactaaaggtgtccaccaccacacctggctaatttttgtatttttagtagagatggggtttcaccatgttggccaggctggtctcaaactcctgaccccaagtgatctgcctgcctcagcctcccaaagtgctgccaccctgagatttgacttaatggagcccatgggagatatagataccttgggtcattagcaaaaccttcaacgtaaagatgtatcaactctgagagaccctggctaggtctactaagttaagtggaagcaccacaacatcatggttaaaaggaaagcctttgtgttgagccaggtgttgttttgaatctcagccctcctgcttaggaattatgatcttgggcaagttacttaacctctctgtggttcaggttcatcattcaaaaagtaacaagcatcatactacccacctcaaaggggagcagaaattaaatgagattaagcatgcaaagcataggagcaccatgccgagcatagaggcacaataaagggcagttgagaggagtggcggcctggcagggtggctcatgcctgcaatctcagcattttgggaggccgaggtgggaggatcacttggttactttatcaaacccaccatacccatggaacttagattctagtttggagaaataattttttttcaatgtaaacaatgtgtacatcatataaggaaaataaaaacaagtaaaatccttagtatctgatgatcctcgcaaacaccttggaaattattactattcccatttgacagtgatcacttgatcacttcaagaccagcttgggcaaaacagcgagacctcttcactactaaaaatttaaaaaatcactgggcatggtgatgtgcgcctgtagtcccagctactcaggatgctgaggtgggaggattgcttgagcactggaagtcgaggctacagtgagctgtgattacgccactgcactccagcctgggtgacagagcgagaccttgtctcaaaaagagaaaagggagaggagtagcaggattgacagcagcggtggcgttgccccttgaggatggaaggtctcagtcatcttgaagtctgctggagcattagttccattgaacctctctttgagggagactatgttctttgtccttggccttttttgcctacctagaactggctgatcttgcatggactgctatagaagtcctttgtaatcaggtcgttgaggtcagataatcgagttccaatccaagctctgtcatttgccagctgtgtgacactgggcaagttgagttactcaacctcgcagagccccttgttctcagctgcaaaatgataatacaataattatttgctgcatagggttattgagagaatgaaataggataatccatgtaaaagtacctcaaccattcactggaacatggtaagtgcctaataaagatatcttctgagtatggaagcaagacttcattacatgtggtattgatttacaattgagtgcatttcatgatattaaaattaggtgagaattggtggtatgaaaatgcaaccacatcaccacaggcctcacacccatgcttcctgtgcagtctgtggaactgtgcatcaattaaacctctcttcttcataaattacccagtctcacgtatgtctttatagcagtgtgagtacagactaatatacctggaaaagttgagtgctctaggtcaactggcctgtttagtggcagggctaggattagactgtcaggaccccaagattccactttgtgacattgtcctccagagccattgccttcgcatactgattcaccttcctttctatagtttctgccctccatttaaccacttcttttgttcccctcaaatcccagatggccagccttttaggcctgcctttcttagatatgatatcaatcatatcatttcaaaatataaaatgaatttgttattttagttagttaaattaatggtgaaagattcatttaccaataattttgactgctcttcatttgttctgggatccctgtagtaatattctagctttctccatgcaagtgaatgctgtactacagtgattttcaaacattagttgaattagtttcaccttggggtctggttgaaaatacaaattcctgtgccccatataacaggattctggttcctgagtctgggccgaggctcagaatctgcacttttaacaggctttgccacgtgagtctaaggctagtggtatatgcagcccacacctttagaaaactgcttggctttgagtcagactgcctggcttgaaatccaggctctgccattgactagctggaagtccttgggccttggtttcctaaacttaaaaaggagaataatacatactagtccatgtaaggttgctatgatgattacatgagataataaatgtggagcacttagtattgtgctgaacctacagttggcactcaagaaatgttaagtaatattattttaaaatctagggccgggtgcagtggctcatgcctctaatcccagcactttgggaggccaaggcgggaggattgcttgagcccaggagttgaagaccagcctgggcaacaatatgagaccgtgtctttacaaaaaacattagctgggcatggtggtgcatgcccgtggtgccagctactcgggagactgaggtgggaggatcacttgagcccaggaggttgaggcttcagcaagatatgttcataccactgcactccagtctgggagacagtgcaagaccatgtgtcaaaaaaataaaaataaaaaatagaaataaatctattgaaacacacacacacacacatgcacacacacaaagtctacaatgtgtttttctggttattaaatggtaattagtgttaacagaagattctccttgcattaacacacgtgtgtctccacacgcattctttaaagcttagtgctaatgttctcttgtccttgaggtgtttgtgatcttcctcttcactggaataattgttcattttatatctctcccacttgtgcctcccatagaaggcattttgttctgcaacaaattctagtgagaattttgcatctctctcttccaggcttgcaagctgctgaaggacaggggagcagttgtagccatcctgcaccccaactcatacaccgtggcccaggtcttacccagtgcttagcactctgtagtacttaaaaccacacttgctatattcacctgaagttctggaagtgagaagcctcaaatgaaatactcaagaccagaatctctttactctttctggtctgagcaagtgggaggtgagagaataaaactgggaagtgttggatcttctctggcttgtttgttctgcagtacgattgggagaaaatgtccaaaaatgtagaattgagaagaacacccccaaaaccaccccagcaattactgttgttttaaaaaatcgtaaccagatggaagacatttcctgaaatcacacctttgtttcttggagaaagaaaaagcccattcctgtgagtgggtgttcattaacttggtaagtagggaagattgagcttggcctggaaggaggtggatttttgcaggggcactcaacagacaattaaataaggaggggcatttcccatcagaacacatgaaacaagaggctggttgaattttctgcaactgtctgcttgaaggtttatattcaatgggtgtcaccacaacttacacctcatagaacagggatttggtccccaagagatgtaatgcaaatgtcacatcataaactcccagactgccaatactgaagggattttaggaatcgtctagaataagaagtacagaccacccaccattgttttgttagtgttaccaaaatgtcaatggttgttcaaatgcctttagttgctgttttactgcatattttctgattccaaaatgattagtatttcttggatttatactctggctctgccactgactggctgtgtgaccttgggcatgtcagttgcccttttgggacttcatttccttttataaaaggagcaaactaggttgaaagatcttaaggttctttttagctctaaatatgggagagtctcccagaaatagaaatgcaccactcctttttttggaaaattcattctttcctaatgttgaaatgctggcagtccagtgagtcaggtaaccatgttacaagaattgtctcacaaattctgtaaggaggtagggaacaaagatacattctgatgtatgtttcttctattaaatctattttggtattccaagtgacatttgttcttgcacagcttatgcttcacaccaacatgctatctgtcagggcacacactgattaagacctattctgagaaaacatattctctgtgattgaaatccaaacgtattgattgttttatttccatcaggagagattgctttctatttggtgatggatgacaactcttcacacctctctgtctgccagctggacagaggatgacacaagcagcctctaagtcttgtgtgggctgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcccagctcggtgcagagagaacatctcgagtctgcactgtctgctgtttctccgtaccacggtgtgctagcaggaaagccttcaaaggattaaaacccaagtatttatgagctaaacataatgtttccctctctctgggaatgcccagtgagaataccacttacatctgcacagaatgattgcatttcgcaaagtactttcacatgcgttagctcattaaattcttaaaacttttactcgtgggaaatagatagacactacatttttaccatgttacaaatgagtaactaggtatgccctttaatctctgatccctgaccccacaagccactcttcaaggcttgaacccatggcttctagtccggtctttccatcatcctgaggtgctcagttattcgagcctgtagctaatgactgcaggacacataatcatagcaactcacatttattgaactcttactatgtcccagacacttcacataattttaatttaatcttcacaacaacctagtgaggatcatatcattattgtcatcggcattttacagaggaggaaaatgacattcagagaggttaagaaacttacccagggtcacatgatagtaagtgacagagttaagactgaagctgagtcaattgaaaagtagaaaaattcttaaccatgatgctctgttgctggcaactccctgtcccttaccctttccaaaaacattaagaataggaaaaaaaagaagagtgagttttccctcttgggctatgctagcaacagaggcccaaggggaaatgctgttttaagccaacctcttggaaagggtcattagcagctgacatgatgccaatatggaccaatatgtctgaaagcttgtttctgggtcttttgtggtctctgccattcttgtccctgtccctggcctccacattcctttccctctggatcctcagtaacattgtcatcctactttggacatgcaccactctccattttaggtgagatatgtagggttattgtaaataaatatttcagaatcagtattatttattccccacctatttctgaaaaggatctgaataaaatctgtctattaagtaatttgaagtttacaaaaagatctgaaaccttgtggaagaaagtcaagggagaagaagacatgaacaatggttctatcaagaacttggggtggaagtcatctcacacatttcataagcactgtgaacctggccctgggattgccactaaaaatacagagctgagtaaaacatggctcctgccctcaaagagctcaatatctagtagcattagaattactgaatttgaacattcaatttgactttgagttcaaaccaagacaataagtgaaacatgatggattatctagtactcatctgataaatggagtagtgtctgttcttcagaagacacaagctgcttataatgctgaataataatgatgaattatttcatatcagtaatagctaatattctttgagagctcatcatgcgccagctattgcactaagcaatagctgcattatcccatttgcatgcattatcccatttaatcctcacaaatgtcttcatgatgtatgcatataattacccccattgtacagatgaagtaattagggtaaggaggaattaccttgtggatccataagtaatacaaggggtgaaaacttcaatggagtttttacagaagattcagacccgtatttcataaggccagtgcacacatttctcggccatttctgtcttccctgtcactctacgggaagtggctatgaatatactgtctccaaaggctgtgactgtagccattgtgcttcggtattgccatttgggacctaacggttcagaagatgtaataactctccttgcatggaccaattacagaaaaactccctttgtaaagcaacagcatgagccagaacaggcacttcattatctgcctctgcccacagggaagtagagacgctggcgagaggatgattgacctgggaaatggcagggcttgggatccatgctttcagggtcaaaggccttcgtgcccacttccaggattggcttctcaggatgccctggtgctggctcgccccctgctggggtgggctcctggggtttctctctcagtgggatcccattggcagtctctcccctcccacagcagcaggcccattgacttctgggcactcacttcccaggacccttttcagtccctgagaatcagaagttcttttcactctgagagtttgcagacggtgttgcaccaagaatggatgtactttgcctgtagagggctttaatctagtgaattgtgctcagacagataaagggtaattttgcttcattttctgtacctttctgaaagtttccagggtcagttagccaggtctctgcaggcttctcagctccaaagcagaggcaaaagtctttttccaccatttattccttgcatatatggaagattcttaggcaaaaagtgattttttttcacccatatcttatcccagaaaacaatgccctctttttagttaaactgaatgactacaaatcatatcaccccaaattgagtaattgcaagtcttgttagttatcaaggttttattgagccttatttcagttgcttacatatgtttttgtttttaaagaaaaaaaaagtgtaacgcctttggcccgggcctcaaattcctttttttccctcaggcaagcacgcttacaagtgagggattcccagcctacaagggtgagttatgtgtgttgagagcagagtggaaaggtgggcatttactcgccctgccccctccactgaactcgaagtgctcattctctcccatgcctgtgtcctctctctcttcacacatggtcatgtatacacacagttgtacatgcacactttctccttgctaaaacttttctttgctctgagtagatgcagtccgttctcacactgctacaaagaaatagccgagactggataatctataaagggaagaagtttaattgactcacagtttcgcagggctgaagaggcctcaggaaacttacaattatggtggaaggggaagcaaatatgtccttcttcacatggtggcaggaaggagaagaatgagcaaaaggggaaaagttccttataaaaacatcagatgtcgtgagaactcactgtcacaagaacagcatgggggtaaccgcctccatgattcaattacctcccaccaagtccctcccatgacacatggggattataggaactgcaactcaagatgagattttggtggggacacagccaaaccatatcatctactctctccctggcctcaccccacattactgctctggtggccaatgctgtagtcacgaattctgccttttctcatgtctgccatttcaaggagctcaccccactcacctcaaaaaccgagcttttatagacgcagaaaactcttcctcctatatgcacactgattgatcacctacacatgccatcaagagcatgtactctggaattagatagtagtgagttggagccatgtctttacttattagccatgtgaccttgaggatactacttaacttctctgagcctctacttcctcagtgaatcataaatagaacctacctcataggattgttgtgtggggattcagtgaaatagggcatgtaatttagtacagtgcctggcccatgtgatcaataaatgtttgctattatcattaagcgtggtgatcttagctgattgtattgttgttgttgttgttgctgttgaagattttgcatcttctaggttatgtttctttgctgctcaggaggcagaacaagtttctccattgccaaattgtttgcttttttttattggggtgaaattcacataacataacattcactatttaaaattatactattcagtggcatttagtgacactcattatgttgtgaaattatcaccactatctagtttcaaaacattttcagcaccccaaaatgagacccgtatgcattaaacaatcactccccatcacccccacctaccaaatctttttttaatgttgctttcagatcatatgccattccataaatctgagaagttcaggaaggctagatagtgagcttttttccaaaaatcaatcagaaacatattcctaaataaaagaaatatactctgatattctgggactgccttatcagagagtgaagtgaaaaatcagaagtgatatagtctcattcaggccaacacagaaattactcctttaatacttattgcccatatttcacattattttctttgcctggtagctgagagagaaaaggagcttgaaactttgagtaaggggagggaaagattttctaaaccccctataaacaaatgatggtaaagcctaggaagaggttagcaggtcagcctctttgcatttaatttccatcttgccacattccaaggaaggaattttagtcttgggaggcaccaaataaccctcaggggaaatgtgaccctttgaagctcctggttgtctatttctgcagctgcccatctactcacaccacccaggttggaggggcccagctcttcagcactcaaatacagtggagctggccacttctttgcacggggatggtttataggctttctatatcaggctgtgtgcagacgagacaggcttgatgagtcagctgaaaaggggaaaggaggggaactccagttggcttgatgctcaagtgagaagtgggaagaaggaccaacagttaagaggactcggtgaaaatactacgggatttggcaaatgtatgtgaaggcttttgtaggtcagccagtttgcccttggagctgtgggcctgcctgagaaggcttttgttggccttgggagctgaaagggagaccctttctttaggctctgcaggctacttggcaatcaatgttgaggcaggttttctgcttctgtggggtgcaaagctttggtcaatgtcatcaagagcatcctcttcttaggaaaccatgaccttgccttgggcaacttttctgtagcctttaagaccagaaaagtgagtagagaagactaacgtaattggacaaaccttgctttgatgggtggtgattgggactctcatatgaattccagaaggaaatatatgaagagtgtctgtaacttgaatgtgcttcctctgttgggtcttgcattaaatcactgatctgcacactttagcctgcagcagaatcacctggcgaggaggtgcctgttgaaaaagataagaagtttcattcagaaaagatgaccctgaagtaagtcttctcactcatttctatttattcacagttcctactttactaagaaagtttttaattattggccattatccgtgactgaaaatacattaagtaaagttgcaggatgagttttaacatttatgagttaacttcatccacatcagtaaatttgacaagtatttttgaagacccatctttgggttttattaaatagaaatttctgaaagttgtatgcccaagggtattttgtttttctcatgtgtgttcaaatttgggaagaatgaattttgcctcctattcactcggtaggagatttagtgtctccttctgaattagccctttctgttcctgaaggaaagtatttatgaaaaatcagactccattctggaaactgaatgatttttgtattttgctgcagttagatggagtcctataaatgagcccaaaacatgctggctaaatctctcataaaaggcaaatatcacaaagaggaatggcccaagtcttattttggcccctggcctgtgtttgtctaaaaagacttttagaagtgtcacaaaacactaaagcactgcctaaatcatcccttcctaactttttgcttatgggggtgcaagggaagttgcacgtggtgggtgggggtgctgagagagagagagagagaacacaaagggccagctcccacttggagctcccctcgtttctctccattttgctcttcaggatgtccccaccccactctgcattctcaccacacccacacatgaacccagcatctgcccaggtgccacgaatcatattacaactttgctccctggcagagagtggccagagagaagtttctggaggtgaggaagtgagcctgcctgactgctttggtggcagaaaccaggggcttaaccagtgactctgtgctcgaggcttgtttgtgaaatcctttagcaactcttcagaagcctctcctctctgacttctcagagatgctggctcttctactttgggaagttcctttgctagtaacacatttgaggtgagttaaatgtcttcctccttcagcctcagcttcctgtgcctaagggtgagttaagcaattagtcctaaatagccccagctgttagggtttctccagaggatgctccttgtgactttgattgcttctaatgaggctattggctttatctgtaatagacaatgttagattacacatctatgtcttttacagcaccttttacccccagggctttacgttttctgagaccactcttgagaaccttggatccagtggcatttttcttcttgtgaataaaaaattattatctttcctgttctccctgtgagatcagccttgttcttgttctgctctggggtactctgtatttagggaaattactcatgactctcgggtactgaaaagacacacacacacacacacacacacacacacacacaccatgcacaggggaatgggagagcaagaacgtgtgagagagagccacttgaagagagacagggagaaagaaagagagtaggagaaagcaataaagaaagcgagatcacagtcaggcctgagaaggtgacagcaagccagtgttttagaggtagggaaagagcccaagatggatggagaaagctcatgcaggagcaagagagcacacatgggagtgccagcaaccttgaaaaaaagcaccagtgacagcaaagggaatctatgaggccaggaggctgggcgagcaaaagcaagagagtgcaagagatcaagaaagggggaaaggaggtgggagagggagagcgagccttcagggcaaaggagtcaatgagagagatcagcacattatttgtgggcagatgaagagaaagtctaaatgaggagctgctttcccctcatcttgttgagttggtggaagaggaagagaagatgcacagggcacagactccagctttcattaatccaaaatggaatttctgggacatacatgctcaggatcaatgtcatctttaaagacccagattccaattagaaccacaagtacacctccccatccttcagtattatttgaaattttagaacaactgccattattctacacaaagtaaaggatgatcattttggagtatgtttttatcaaaccacctccctatccacagacctgtgttagacagcttaccttagtggttgccaaacaccagaagtagatcattgtcatgattttggagggctgggccgaggcctggaattctatggctttaatacgtggctccattgggagattccattgcccaggaagacactggccttaagctacaccctttttcagaaagcagtaacaaattcagttggaccactgacctgaagccagattgctttccaacaaggcccaaactaaagggggtaccaaaaaatcagtaatcaacataaataacattttaatgatatgattttttaaaagagaagtttctacttatgttgcccaggctggagtgcagtgtctattcataggcgcgatcatggaactcttgagctcaagtgatcctcctgccttggtttcctgagtagctgtaatgatatgttttaaagacttaaaattaatgtagacaaatccaaaatgaacaaatatcaaaattttaaatacagtttccaactctgcccttgcacacccctgcctctcttgacccaccctaacaccatccttggttccagttaaactttatatacagaatcaggcagccatcctgtgggccatattttcttgacttaaaaaaaaaaaaccattgccttaaatatcatttattcaagtagaatccaaatcttgtttgttttctaatactgtttttcaataaaagcaaccagggctccttggagaaatgaccgattccaggactgaggcagaaaatacacaagataagcctggaacatcttgtattgccagaaagtaaggaagtgttaacaaatacacaaacaaaaacaaaaagcagaacatcacaggagccaactaaaagagctaccaacagccaaaggtataaaaacttgagaaaatatactagtattattggactataacccaaagtataaaataaacatccaagagtccatactgatataattaaatggttaaataaatggatgatagacacatcttttgtgcagggtaattccaaataatttgtgtagattctctgccctcaaggaggtggagtgtaactcctcactccttaagtatgaactgcgaatagtgacttccttgtaaaagagtatagtatgggccaggcatggtgccgcatgccggaaatcccagcactttaggaggttgaggcaggaggattgcttgagaccaggagtttgagaccagcctgggcaacatagtgagactccctctctacaaaaaaattaaaaattagccaggcatggtggcatgtgcctgtagtcccagctactcttgaggctgacatgggaggatcacttgggcctgggaggttgaggctgcagtgagtcctgatcatgccactgcactccagcctgggcagcagagcaagatcctgtcaaaaaaaaagggtgcaggccgggtgtggtggctcacatctgtaatcccagcactttgggaggccgaggtgggcagatcatgaggtcagagatcaagaccatcctggctaacatggtgaaacccagtctctactaaaaatataaaaaaattagatgggcgtggtggcaggcacctgtagtcccagctactcaggaggctgaggcaggagaatggcgtgaaccaggggggcggaggttgcagtgagtcaagattgctccactgcactccaacctgggcgacagagcaagactccgtttcaaaaaaaaaaaaaaaagtgcagtatggaaagggaaagacaagtatccttaccatggattaacctgacaaatactgcctcagccaggtgatcaatgtgaacatcaccaatcataaatcatgctgattgtatgtgtctttggatatgatgagatgcgaatggcactttatctctgtggtcttcttccctataatccataaccacagcctacttatgagaaaaacatcagaaaaattccaatagaatgggattctacaaaatagttgaccagtactcctcaaaattatcaagtcatcaaaatccagaaaagtctgagaaattgtcacagccaagaggagctcaaggatatgtgacaactagatgtaatgtgggatcctgcaaccgaaaaaagtaaaaactaaggaaatctaaataaagcatagactttagttaataacaaattgatattagctcattaattgtgacaaaggtaccttattaatcaagagatgtttatgtgggaaactgggtgtggggcttatgggaactcattgtactatttcacaatttttctagaaatccaaaactattctaaaatacaaaacattctttgaaaaagtatcttgatggctgaatgttttggtgcccccttaaattttacacacaaggtgagcaccttgcttgcctcaccttcatcctggccctgctgtctgagtgcaaaatacatttgtagcactggatttcctaggagacacctgttgtattagtctgttctcatgctgctaataaagacatacccgaaactgggtaatttataaagtaaagtggtttaatgaactcacagttccacatggctagggaggtctcacagtcgtggcagaaggcaaaggagaagcaaagtcacaccttacatggtggcaggcaagagagcttgtgcaggggaactcccatttataaaaccatcagatctcatgagacttattcactaccacgagaacagtatggggggaacggcccccatgagtcaattatctccacctctccccatgttgacatgggggattattacaatcaaggtgagatttgggtggggacacagccaaaccctatcacctgtacacactgcattctctttatttgtatataaataaatccatagtattctttcctccacaaccttctccttagcataagctgaattacattccttggcttctgacaaggaatgaatttagatgaagctcagtgtgcacttcccaaagttgcagttgtacagccctgtgaagagaagaggcagtggttggaagcctaagccacagaaacagagtatagtccaagaaaggttataatgctgtgcccagcagccagagcttctcctgcagctgctttattcctgccaagcaaagccatgagcttctcctgcagctgatttattcctgccaagcaaagccatcctcgcaaagagcattggcccctctgctgcctgggcctgcctctcagatagagctctggaagcctggacctttgtcctagaaaatgacatgactaaagtgggttttgtctttcctgttgctctctttcctcctttccctcttttcacatcaataccaattagagaggacaagtgttcaatcaagacataatgtcataggcacggacttctcctcactgtcttcctcagggcgaagaagctgccagcctggagcagaaagctgggtagagacactgctttaactttattccctcagggaaaactgcagccatgaaagtacaacattgagctgacttgacttggcagaaagatgtgttttgcgaggaattgggatctgggagaaggtgattctgatactaactcacagagcataccatcccatttctgatcagcgtctgcgtgagaagatcgttcaaagctaggcagtctgagtctcattggaagaagtggctaaatctaaatctggtgtcagttctttttttttttttttttttgagacggagtctcactatgtcacccaggctggagtgcagtgatgcaatcttggctcattgcaacctccgcctcccagattcaagcaattctcctgcttcagtcacccaagtagttgtgaccacagatgtgcgccaccacacccggctaaattttgtgtttttagtagagatggggattcaccatgttggccaggctggtctcgaactcctgacctcaggcgatctgcccacctcggccttccaaagtgctgggattacaggcatgagccaccatgccaggcctggtgtcagttctttaacagttccaccacatgggatttagcaggggaaatgctgcagagtgaatgccagagactttgtccagtttcatgtatatgaccattggctctggtttcagagagacttgggtttgggtcccagaatttcttaattgtgtgacctgggcaagtcatgtagcccccacagagccacagtgtctttatctataaaatgaggatgctggtagagttgctgtgagattaaaggagctaattcaaacactcatcccattgcctggtgcaggaaaggtgcctactggatgatagctctcatcgttgaaactctgaagcttgggactggggtaggggacacttccactagagtacagacccaggaataactctggagacatgttgcaggaggcctgccagctttgttggagtgtgtccttcgtgctggttaatacatgggaaatggctcaggaacaatagcttgctcttgggagaatcccggaagtgacagtgtgaaaaatgatggttttccaaggtggtattccctagggctgagatttcttgtccttccttttccatgctcacaggaagaaggggaggtatttggtcaagaaagggtttccagaagaaagtggctcagagtcttgctcctccttcctcccctgtctgtaaattctttgcatttggaatgtgtgatgacccctgtctgggctttgcactcagatccctgggagctaggagcagccctgagaatgggcagcatcctgcatctgccttcccaggtgcagtcctgagaatgtgctgatggagtttagttttaatgacaatcataactccagaggcctgctctttactgtttttgattgtgcagctgaagactagatgacctcattgaaaagtgggagacagaagcagctgttgccacaggaaataagcccccccgccccgccccacctcaggagacacactgcttctaagagttctttggagtgggggtggatccagaatggcagctgtcctctacccagatctttctttgtgtacccagaggttgggctgagctgtgggtgactagactgtggattaagaaaccatgaatagcgtttccagaacaaattcttggcctgtgaaatctccatttagcttgctctaccaggaccacatgtgtctatgatttgcctcctttctctttttggattagagtctgtgccctgcacctcatcccctggttaagctaccatccctcccactgtcggcttggagctggtttgctatgctgtcaaagatctgagtagcaacagatcacgcagcctggtgtttgtggcttattacatactccccaccttggctgagtaaaacatcaagagagatgtactaagcttccaagcacaggggtgaatactgaagccgaaggcttggtgtactaatggtgtaatttgaggtcccagctacaggttagaggtggtggggatttagagacaggggaatttcctgggtatttgttaaattgcagtatcctgagagctcctttatcttctgtagacaacattatgcctgtttggggaacttcacacatatatatccacgtgattctacccagttcccatacccttggcccatcacaccacaaaataaagtgctggagccaaagaaactctaaacagatgtctttagatgaaaacaaagctagcagcactactgtacagcccacatattgttgtagttttaaaagtagattgttgtggcttttggtttacttgctcactccttaccccatttcctgttggtgtgatactgaccagcaaagtcgcctttgcagcgtttccttggatctcttttttttttttttttttttcttgatgggcatctttcacttctaggaaaaccaaacaaaaatttcctccaaaaattcaagtcagtcaacatttattgagcacctaacaggttcatggtgttgtaccaggcactgcaattggagaagaatgttacaagtacacatgcccaaactcgactgtgtccagtctggagagaaggctggatctggccccacagattgtggtgggagactggctggggatgaggctgttggctcttggtgttttgcaggaaacttcaagaaggaagctggggggtgtgtcctccctaggccccccaccccggttaatttgctttgtttctgaaacacactgaccagtagctaaatgggcctagctcatgttcagggctgcgtgctgaaacttcattagctcttttcaaagccctttcctattggtatagaggttcctcttaacactgccagcttccttgaaaggtttttcagctgctccttatagaatcacttcgaattaaaatgcttcattccaggggagattttatttacagccaagcaactgtaactagtagcactccccccaccaggctgcagtgactatagatctttgatactgctgaatgactctgtcaagggttccaatttgcttttatacaagtgcatcacccaattcaaaataaatgcatccagactcccttgtcctctcccaacccccacacactattccatttcccataagcacgtggcctgcggctcaggggtgtcagtcacttagccagctgtctgttgcctgacacagacatatcaagttggttcaccttaactaagtgattgagcttgattgccaaccatctggtgagtttagttaagggaattgtgatttctagaccagtctaacacggccaaatatgtacctccccaagcccccaaaacaagtgtgtctgtgggaccacattttatttgtacagttacagaattttatggctggggaggactgctttccaacttcattgctgaagtctgaatttaccccttcaattcaagctctgaaaattttatgggctgagcccaaggctaattgttccaatattagatgaagcccctgtcctcaagaagctcacagtcactcagaggtaaaaggcagtcaccacttggctctaatgtaatgtaataagtgccatggtagcggcaagaacaaagtgtgctgtgagaatccgaaggaaggatggattactctgcctgtgaggggagagggtcaggaaaggctgctcagaggaggtgatatttgagctgggtcaggtgggaaggctattccaagcgaggagaactgtgtgagcaatggcatgcatgcatttgccatatttggggaatctcggtttagagatgagaggcctcccatgggcacaggttttccagagaataaatgaaatcaagagtgtctgaggctgggaacagtggcccacgcttgtaaccccagcactttgggaggcttgcctgtgttatatgcctttggcaggtggattgcttgagcccaggagttcaagaccagcctgagtaacactgcaaagccctgtctctacaaataatagtaataataataaatcatctgcatgtggtggcacacacctgtggtcctagattcttgggcagctgaggtaggaggattgtttgagcccaggagatcaaggctgcagtgagccatgattgcaccactgcactccagcctgggtgacagagtgagaccccgtctcaaaaaaagagcatctggctgtagaaaggtttttcccaagtatgatccaagcgttaggactcagctccatcctggtcagcattcgtagatggccaagtgtgtgtcattgtggatggctcctccctgggcaccaaaggttggtatgtagccaccttcctttaaattgtggcaacagtggtggcagccaaggacagctgctttgtgggagagaggagttaaatgtgagaagatttattttggttctattaccagcggtccttttctgagtgaggcttaacaagaggcaaacgcctaatgacctcctgagtatcaccaaagtgttcaagataggcttgaaaagccaaagaagatgaaaagaaagaaagaaatcaaagggtccttcaaaagaaaagaagtagacagtaacggctataggatttgggatcactttttccctgcttggcaggttggaattgcagcttaggtatgttgaagggtagttcccctctaatggtattattgatactagactctctgttcccacagagagagctatgttggggaagaaagaaaatatttgatgtctgattcatgaacacgctaactggcccatgcattgtggcagagaagtaacagctttattttgaaaaatgtcaaccttttaaaaaaaaatcaaagaaaataacataggatttttgtcactcatggcatgccttccacatggctttgttttccaaacctggccagcctgcagtttccttcccatagtggggaggagaatgagcctcccacctggagagtgtggagccccaagaagcagcatcctctggtggtcccaacatctgcaaatagatgagacagctgactcctctctggctggacttttgtttttgccctgtgcctgtctaaccttgggcaagcaaaagatctgagagcattagggctggaaggggccttggagaacattgagcccaacctccctcccccttgtacaaatgggaaaactgaggcccacagagagggagggacttgctcatggtcacacagccatggagatagagccaagatttgaactcagggttctttcttctagtctttgcaactatgggctgcagtctctctcagcagtcccaagcagcagattagtctcctggagaggcaggggcatgctttaattgctgccaatagggaaagttatagaaaagagggacagacctacttgctgctctcctcccttaggtaaacagccttgtctatttctagtcacatttcccttccagcgagctttcctatgttatatgccttgtaagtagagaatcaatgaagttcctcagttacagaggagattcaggtggacaaagccatgttatagacctaagtccccttgtggcacaggttttgtcctcaaaccatcatactgaggcacagttcatgcatcacctcctccagggagcatttcctgatttccaagactgagttgcacaacccctcctcaccttagcctttatcaactgtctgtcatggttgactcatctgtctctttctctgggctttgaacttcttgaggacagggaccttgtcttctccatgtcccaagtggatagcacggggtccagcccaaagtagacaatcagtgttttttaaatgaccgaggactcagattcccatggtaacaaaagtttgactcttgtttcctcggtgaattgaaaaaccaaccactgtaggtagggaaatgggaaatccaaacgagttgtttgttattcactgggcaggatacttcatgggactctgctagctcaagtcctgaagagccctgctctgtggtggtatgtctgccataggcccacctgtgcaatccctggtgggtccatgggattgtttcgcttggatgtctgtgactgtagacttcaggaacaggatacaggttgttcaatagatttcagttagactgaaaggccatggctgaattctgttgtccttcacctaaacattattggagggaggcatcttcctaggcagagggagtgaggtggggattggctgattatgaggaggccagagcttcaggtcagaatgttttttctcatctaaatgtattaggttggtgcaaaagtaattgtggtttttgcccttaccttttttttttgagacggagtctcgctctgttgctggagtgcagtggcgcgattttggctcactgcaagctctgcctcctgggttcacgccattctcctgcctcagcctcccaagtagctgggactacaggcgcccgccaccacgcccggctaatttttttgtatttttagtagagacgggttttcaccgtgttagccaggatggtctcgatctcctgacctcatgatccgcctgcctcagcctcccaaagtgctgggattacaccgtgcccggccgcccttacttttaatggcaaaaaccacattaacttttgcaccaatctatagcttggttttcattctctggccttggagtaagccctacaggtttacatgcaaagatattcccattcctaaaagccgtgtaccgtaggatcctgggtcattggaggcagtatcttttacttagactcatttgctccaggaaagtgagcaaaacatctctttttttgtactgtagccaaggctgttgtaggaagcgttgtctgtcattctcaatgctgactgcacattcaaacctttttatgtaaagttgaaaattcacctaagattttaagtaagaaaaaaacagaaactgataccagagttaataagaaaaacaattgttgctcaggccctactcataccaattgcgtcagaatctcatgggtcagccttggaaacactctctagatgttttttaatatgcagccagaattgagaaccactgatctaagtagaaggtgataatgtgttctcttcttgttctcagttactttctaagggattctaaagccagtgacccttgaaaccagaactctcaggattttccccaactctgtgaaggtttgagacacaacagattttgagagaaatactcattctgctctcacctagagctttgcttcagtctaagttgtgtctgggtccacatcaagcacatgggtaagggtacaaagtatttggggaaggcaattctcttcccactatgctttataaggccccagacactcataattttgacttcgatttcattgcttgggcagagtatctagtcctttctcacagattacagaatttcaggtcttaaaaaaaaaactatcggggctgggcgcggtggctcacgcctgtaatcccagcacttcgggaggctaaggcaggcagatcctttgaggtcagaagttggagacagcctggccaatatggtgaaaccctgtttccaccaaaaatacgaaaattagctgggcacagtgatgtgctcctgtagtcccagctattcaggaggctgaggcaggaggattgcttgaacctgggaggcagaggttacagtgagccaagattgtgccactgcactccagcctgggtgacacagcaagactctgtctcaaaaaaataataataaaaaaacctgtggatattttgctcagtacctgggtgatgggatcattcttaccccaaacctcagcaattacacaatatacccaggtaacaaacctgtacatgtaacgcctgaatctaaactaaaagttaaaacaaacaaacaaaaaaacccaaatcataaaaaagttacctccaaagtacattcataatagtatagccagagcagttctaagtaattttaaacggtgagtgagagaatgtttgatacctggcttccattcattcattttctttggtctgaatgtgtagtgggcacatggtggaaacagatctttgactttggggcttttgaggtttgaggcttacagagagagccctcagtaggaggaggggtgtgtttacataaccctggggcaccctgtcaatgtattctgtgcagccaaacagatcaatagagtgaaaaaaacaattcagctgagtgaactgataggctgataggttatttgattgactgggctggtggagccactcaagaagaaactacagtgctataacttgggaggccagataaacagctgatgccaaaagcatctgcttagcaatcactggagcccagttgacacaagctattggaaccacatttgagtaaaaaagatataaagtgcactggggtaccatgactatgggtgaatcttcttcctcatcatactgtagtccttcagatctcaggggccgtgtagcttattacctccaagtttcttcttaaggagagaagagagcacagctctgtagtgactctaaagcttctcagctgtgtggacttgagcaagtgatttgacctctctgagcctcagttgcttcctccagccataggagtaaatatattatgtacttcatagggttgatgggagagttcagtgaggttagacacagaaaatgcttagaaaaatgcttgatgcatatacataggaagcatctaataaatggtagcattgatgattcttataaaatagaatgctgcaggccaggcatggtggctcatgcctgtaatccaagcactttgggaggccaaggcaggagatcacttgaggccaggagtttgagatcaacctgggcaacatggcaagacccgtttctccacacacacacacacacagacaaaattagccaagcatggcagcacacctttgctcagtacctgggtgtcacagctactcaggagggtgaggtgagagaattctttaagcccaggagattgaggctgcagtaagccatgttcacatcattgcattccagcctgggcaacagagtgagaccttgtctcaaaaaacaaacaaacaaacaaacaaaaaacgctgcaattggtgcagtggataggacacagactttggtgtcagatgatctgggttcaaattctggctctaccacttcctagctgggtgcctagggcaagtcagtataaaatctcttggtaggtcccacttccctcgccctctctcatagctgaagggtgaggtgaggtaagcctttagcaatgggcttggtatgtaagtggtcaataaatgctggtttttatgattatcaatcgccatcaatatgatagttactgggaaattgccctagttcttcagtcactcctcagtaggacgcaatttccttagtgctagtcattgcagtcccctttttttggttgtgttttggtttgccatttactcccatgtggagtgtgggatacaaaatgaaccctagatccatgccctggggcctagccttttcataaccctgccccactcattcctgtttgcttatgcagagcttcccgtcaatgaaagccccaaggtcctattgtaaggcctgctgtgaaaccaggtctcccccagcttctagctaattgatattctaaaaccttggattgcagcttgacctttatccttgtcaaatatctcttgggttttggcccatgattccagccagtcattggctctttgtatcccactttcttgattattttggttgcgttttttaattaggcgttgtgtgttgcagagacacatgatggtgcttaatcatgccaccatctccctcattgctctttgtggttttgtgagtcttgaattgacatgtgtgctcctcatttagccttcctgaaaaccctacctgctgcacctatactttcaaacatgcactgctggtcatctggaggcatttacctgaaatgttaccatggtgcctagacaggactctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaagatttggctggttacaataaggctagatgggctagatgaggatacacaacaatggctcaccccaatttggggaagtcctttttggcctttatgcaatgggctctctaaaggactagccatgtggtagcctgtctaggggtggggtacacagtgggaggagcccttattgatggtcttggggtctggaacccatttcctgctaggcaactgactcatcctgtgacttagggaagcaagccattgcccatctctgggtttcagtttccagagggtgttagattggaaggtttcttccagatttgaactttgactattttagtgacttaagagaaacagctgaatccaagtgcaaacgtctgtcttgcacctttaaaaagaaccaaaaccacattgtaggcaaacgatccccagtttgaaatagcagcttccgtctttggattgtgtcctgctgcccattctttctcagacctgcctggttccacacactggctgaccatacaagaccttttcatctcagcactagatgtgcacgtcttttttcttgactgtgctctcagaatactgggagagattttttacaatactgttactactgccatgaatagcacctaccaatgactgtgtcttgtgtgacaggcactgtgctgtatgctttgtgtacattttctcttttgatccttataatatcctatggagttggcattgttattaatcccttttacagatagagaggagggatgactcatggaagtgacacacagctagtaagttgcagacttagtactgccagatcccagggtcttaatgagtattataagtatgctttttgcatccctgggtggaacttggatgtattaataataacaacagtggcagtatctcttatacgcagtgaggtaggtgctgttatcctccattttatagaggaagacagcaaggctgagagagatgtggtaacttgcccaaaactgcataactataagaatccaagctgaaacgaatctgaggctaattgccctcaaacccatgctgttggccaggcatggtggctcatgcctgtaatcccagcactttgggatactgaggtgggcggatcacttgaggtcaggagttcgagaccagcctgaccaacatggtgaaatccaatctctactaaaaatacacaagttagccaggcatggtggcgtgcttgggatgctgaggcaggagaattgcttggacctgggaggcagaggcttcagtgagccaagatcacaccactgtactccagcttgggcaacagagcaagactctgtctcaaaaaaaaaaaaaaacaaaaccaaaaacaaaacccgtgctgtttcttctacaccatgctgcctttagggctagaacaagtcttaaagaggctgtgggtttgctttctattctctgctcccaggaactgtggcactgcttttctgaatggctttgccggcgcagctggccaggcttgggcaattcagggttcccatagtgcaagagcagcatccacccgactccatctcccagaagcatgcagtacttactgacaattgtatgcccaaagtaggtaattttgccttttcaagcacaaaaaggtaaatcaaattatacccaatatagagcagaggaaaagaaggaacaaatgaagtaggaagaaatgcattcccttctgtgactctcctcagccactgtctgtgtcactgtctataatatatactccttgcttttcatttccttgcatatcagtgatccatgttcccagtggtgtctaaaggccacctgtattcaactgttagctgccttgcatgtgcctatctctcagtttcagcagctgcttcctcagtttccctagtcttggcaggtaggagctttttacctaaccaatagaggattgccatccagtggtacatattgggaactgcatggctgaaaaaaaaaaagtcctgaatttttttccccctttctaaaggcaaacaccacccattcctcaatcctacttaagggattaactatgccctttcttctcttttttcttagtcttttgtcagctttgctgctcattagctcttatacaagaagcagagcaggagaagtaaatgcagggaaatacaaatcactgccggatttcagcacccccacacccccgctattgtgaatggtttgctgggagagaagctctaggaactgatggggttcagctcattcagaaaatcctgttctcctttggtattgatggctgaaaactctgattacatctgcagagcagtgtgaatagtaggttctaaaaggggctgatacaaaggacaattcacaacagattacgtacaagtaggtaataaacaaaaggcaaaaaatcaacttcacttgtaatcaatgaactgtaaattaaaactaacaagagaaattatttttgcatataaaattggctgagaaatgttaaaatcaaaattcccagggttgacgaagatttcgtgaaatggttgtttttctacactactgctgggagtcataaattactcagcctttatggagaacatgttgacaatgtaatcaagagaattaaaaatgtctatgcgctttgaccccatagctttgttactagatttcacataaagaattcatcagacactactgtttatgtctacaaatcttaactttccctattataatagaaaaaaacaagactctgaatgtctaaaaagtgtttcttaaactaaggcataatcataggctagaatattacatagcaatttatccaaaatcatgttcttagcaaatatttaaggatttaaggttttaggaaaacgcttatggcataatattttttaaaaaattctctcagggtacaaaactaatcatatctcctctttgtacgatataccttttttttttttttttgaaatggagtcttgctctgtcacccaggctggagtgcagtgatgtgatcttggctcactgcaacctctgccccctgggttcaagcaattatcgtgcctcagcctcaggagtagctgagattacaggcacccagcaccacacctgactaatttttgtatttttagtagaaacggagtttaaccatgttggccaggctggtctcgatctcctgacctcaagtgatccgtctgcctcggcctcccaaagtgctgcgattacaggcatgagccacaatttatagaataaaaaatgaggctaagggaatgatagtccagcttaaacacacagtcactactaagaaaatgattaaaagcctgtacattctggactcatggagttagaacttaaaaggaccttggagtacatctagtgtcagccccaccaatgccactgaaatcccctcggtgactacctgacacactggttcaggcagtctctctttaaatactgtggttaaggaacttgctcaccgcctctggcaaccgcttcttcaaagtaaatgatagtgataatcccatccctggtgcgcgtctagtgatttatagtctgtgaagcttctaaaggcacattttcctctcacgaaccctgggaggcagggagaacaagtacatttatctgcattttccagatgaggatcctgagttgaagtgactcccagtggtaaagtgacttgtgtagctggtggataagataggactgcagtccaggtttcctgactcccactctgaggcttgttccagccctccacaaaatccagggtctagtttcattcaagtatctccttttattgagtttatgttggtcttgctatagctgtgacccctcccatgatacctcatacatcgtctcttagaccttgaaagatgtgcttggatgtggggccacatgctagctagctaaggtccagagtagggtgaacatggaaagagctcagggggagaatgaagaaaccaatgagtccaccttgctgcaaattctagcagtctccacacaggaatctgcaaccatatttatgaaacgttgttttcataaactgctgcttgttcaataaggcataaaatagccagtataagatagttatttgctctacaatatcgtttctgcaacacagcttcaatgtcatagcagttactgcattttgtttagtttcttaagagatgtgacacagtagattaaccattgacatcaaaatgcagaggttcccttagagctgtcagcaatcttgttccattcttttcccacaactctgcatcccgccttgggaaagcatttgtacacttccactgcaaggtctagtcacagacccactcggatttgtcaatgtcatgggaaagcaacaggcaggaagacaactttctatgaccttgggatgctatctgtgagttaggcaaaggaagctgagattcagtccattactggttatccctgtacacggatggtccacatcccattccagggactatgaagaagggcaaggaagacacagtagagttttccttctcacagaggtggcaagagaaatacacaggaaaggaagaacaagccagaaaagacaggataggctgactcttccaagtgcagtgagagctctaagagggaggtgactcactgagggctgccggttcaggtcaggactaggtcagaaacctgctctggcctagacccaagggttggcagagaacagaaacagctcagtgggtttgagaacaggatgggcactggccacgggagccaacaccatgaggtcctgatcaaaccctgcaggcgtcttctctggtgcagaggcacctacttccaggaactcagtctcagaactcagcaggaagtcacaccagccctcccacgcctaatctgccagctgctgcagcgggcacttgcctgccctggctttggagccttcattcttgccctagtgggggcagggtatgttctaactagagaaatgccaaacacctatgcttgccccttccgctggtttgactgttttcccggaatggacctgagaaattcagtgaaatgattcaaagaaacaattagttgattccattagaaagttagtcaaactggtatttaagctgaatttattctggcagatgggcttgcaggggtagactcctgccatagttcctgaccatctctccccaccgtgttgctaaaggtgggaggaactagaagataaagggagggccccagtgggaacgaatggaaataccaaaagctttgtgcgtgtctgcttccatccagctgctaactgttgtcccactccattagcccaatcttgcccagtaagttctcatgacagcagtgcacatcccttcccaagagcaccagaaactgttgtctagcagatgttaggatacgtaaggggccaagtgagttaccacgaagggactctcaggtccatacattgatatgaagactaggtttgaagccatttttcactatgttcttcagtttgtccaggttcccaaagcccaggttattctcagtctaagatttttttgctcgactccccacagggtcgagctatgtgatctatgtcaagtggtacctcccttctgagcctcagggtctccatgtgtaaaatgagatcgttaagtcagatgagctcagtggtaccttacagctcaagcattcattctgtgaattcaggtttgtcctcttttggtccaaactgaaattgccttcatgggatgacccaagtgtcttgttcctaccaatattcttataaactcaattcttttctatctttttaattccctaccaatgtgggcatatgggtccactttgttcctttcacaaagaaaatggtctgcattgaggtttcttttcaagaggggcaaggaggaatctcgtatttatataagatactcaggcccatcacctgataccacccttccatcttaggtgtgtttgatcattcattcatgtatatatttattcattctctcattcagcaatatcaacggtgtgactacctcatgcatagtatcatggtgggcaatgcatatgcataagaatatacagcatgatcacttttgtaagatgggaggtgattcacaatgaaccctgctgccatcctgagctgtcaccctactggagtcactctgcgctactacataccacccctggcagagaccctgaaacttacaccatatcattagaaagacaagctacctgtgtttaagagtattgcaaatgatcaattcataggctaagcaatctagaatagagagtacttaaaagacgttaaacctaaaagaaaagaggaaaaattgtgcaaactaacagaagctatatgtgtgtgttttcattcctttgatgggacactcaggagactttgagtatcagacctagtgttaagagggctattcttaagacctttgattaaatcagtcaaacttggagtcagatgctttcaatgatactcttgtataattcttacccctttacctgttttacagaaagggaaactgaggccctatgtggccttcactataatgtctggttgcttagaacacagttgcagttgtccgggcacggtagctcacacctgtaatcccagcactttgggaggccgaggcgggtggatcacttgaggtcaggagttcgagaccagcctggacaacatggtgaaaccccgtctctactaaaaatacaaaaattagccgggcctggtggtgcacgcatggcatgtaatcccagctactcaggaggctgaggcaggacaatcacttgaacccaggaggtggagtttgtagtgagccaggatcgcattactgcactccactctgggtaacagagtgaaactccaactcaaaaaaataaataaataaataaataaaagcacacagttgcagtgctgcaaaattcctctttctttaagggagaagatgaatagtgctcaatcctgatatcaggaaaagtcacaaggccctgggtctccagctccaacagttctttctctgtggcgtcctcgggccaaagcccagctatatcccagctccatgtgggcatccagagaaagcagaactggagaaagccttgagaccagccttcctgtttaagctgtagtgattgacaccaggaactttcctcacacacctttatttcagattactggcctactcagacctttgcaaccttcctgaccccacaggcatgattaactgcctgaattttttgtcacgggtcggttttcccacctggtgtcttgcgtgcttttttccttggaatttcttggaatctttacacgtttttgacacctgctttgaccttctagatcctggagcttttgcccaaaaggctctgaaacatgcatcttgcctatggagcccgcatcctagcctgccttacttgggctgccttgataccatcccccatcagtgtgacaatgatgattctgggcacgtacaagcctctttcccaggaagctggagcaccaaatgacagctgtgtttgagggatggctccgttgacaactgattcagaatattgacaagacttcattatgtttttgctcttgtgtttacatctttcaagtgtgtttgaaaaatcaagaaaacaatacaatttggtttcccaaattgaaatgacaatgaaactgcctttttatttatttaatttttgttattctcatatttctctaggcctcttctcacacacaccaccagccaccaccccccatccccatctccccaccaactttctttctggaaaagacacatcccattgtagctgtactgatctctagtcacatactgtatctttgcagatctctctgtcattgctctttctgttctcattcatagatgacacagctaaagacggtatccaggcctatgcaggtttggctgaaagggccaacatggcattttcttttcctaaagatggtgctttggtttgtagctgtttgctcctgcctttctgtttttcgggaagcctgttggctttgcttgtaaagagacagcctgtaaggctatggtgattgaaaccagtcagcccagtgcaattcaattcggtggaagaacactgagtgcctattacaaccaggaatctaaaggaagggggagattcacccttaccttgggagcccatgtggggaaatgcatatcttcagagaggggaaaaggctgtgagagttcacaagtgggagtgacttggctctctcacctagttttcaccaactctgaccactttatttcacctcccattttaaaatgctatcttgtcttggcttgattgatatgttatttctgtgattttttttcctgcttttcttcgttgctaggtcttctttctccctctctctaactgggatttcttagatttcttaaagacctcatggacattcctataagtatgtgttgccaaccttctagacccaccaatcagaaaccaaactcatcatcatgccttcccgttttgttaatgaagtgccacttttttgtccaagatagaaacatcactgtcatcttgagctattccgtcaccatcctttctctgccgtctgcatattaattgcaagttttcttgattctattaagaataaagaaatttgagagctgccagtaacctaagaggtgatctagtatggagttttcattgtctcagggagtcagaggattagtagttaagctgagactagaactcaagtctaagattcctagactgttgcttttttttttacttcacatgaccctaaaatataggtaaagttcatagactttagaaagaaatgactaagttcaagtctccactcatctctaccatttgctagctttgatcgtgggtaagtagcttaatctctgtgcttcatctgtaaaatgaaatgaaaataccttatgtaaaggaatggttgttagaatcacatgagaaaatagcataaaacacttagcatcagatggactctacatgagatcacctcagttccagatctactgctaacactcttctagacctttccatgcttactgttaaatcttatctttctaatatggaacatttagactctaaagctttttgctgttctgaatcctatggtcttaactatgtaaggaattcaaattgaagtagagtttcaacatcttttgaaaaagagagtttctgcaaatgttaatacctcagattagctcaaagaaagataaaacagagagctcattagtaagtacttgtgaggtacttccaaaattctgctttgttaactttgagaggcaagcaaaagagacccgtagctagtctagacttaagccatgtccagaaagagtggctgattggtttacttgtgaggtttgggtagggggaatagtatcatactagatatcctgtttaatagcctgttcttattttcacttaacaatatatcttggtcatgtattgtcaatgagcaaataactccttatgagccctagtgtacatgcacatttagtaggggaaccctaagagattggaaaatgcatgagaggaagagatttctggaactgcagggctgtctaaaggagtgggaatatccttggagccattgagaaagggacagagacagctgacatctttctgagagtagaggacaaagggaggaaaggtagaggaagaaggttgcctaagaactcatggctctaatgtccttggtgattgcttggcctaaaacacttcaagccttacaaactgctttttaagacaaaccagtgtcatttaaaatcactgctagggatagcctttctatgtctagttaccttagattatcagagctgaaagaacttcagagatctctttaaatgtaatatgaggaaactgaggcccagagagcagaggaatagttcaaagccctcccaatggtttgatccttggtagcataatgagcagcatattagctcattttcatgctgctaataaagacatagccgagactgggtaatttataaaggaaagacatttaatggactcacagttccacatggctggggagccctcacaatcatggcagaaggtaaaggagaagcaaagtcacatattacatggcagcaggtaagagagcttgtgcagaggaactcccatttataaaaccatcaaatctagtgagacttaccaccacaacaacagcataggggaaaccagccccatgattcaattatctccacctggcctcgcctttgacaagtggggattattacaattcaaggtgagatttggatgggaacacggccaaacggtatcaagcagtatttaactggttttgtgtgtgtggagagggaacagatgaatcatttgtattattattcctatgcctaacgaaactaagtcatatgtgtacttaagacagagaaccaaaaccttgatttttctcttgtagggggtggctaaactggagttagaagcctactttgcctgacctttttagctttgataaaggcaaccttgattcatgatgcatgagcctgggtctttgaaaccaataagaaatggtttgttcattgaacgtgcaaacaaattactttccaaagactaaaatttaaactgacattaagctccaagagcatctatatttaattatacgtaaaggccagaaaacaatttgtaaccttaacatagtaaaattaaaagagaaatcccacctatgcaaataatttatttcagtgcaacactaccctttaggattgccatcgtttgcctgtattagcagtgctggctttaccaatatttccagggcggccctgaaatatgagtttagattggaaaaaaagcagtcagagtagctcccagggcaggctgatgctatagaaccacggagtgtgctggcttccccaatttccttttttttttccttttcttctgagacggagtctcactctgtcacccaggctggagtgcagtggcgcgatctccactcactgcaagctccgcctcccaggttcacaccattctcctgcctcagcctcccgagtagctgggactacaggtgcccgccaccacactcagctaattttttgtatttttagtagagacggggtttcaccgtgttagccaggatggtctcgatctcctgacctcgtgatccgcccaccttggcttcccaaagtgctgggattataggcgtgagccactgcgcctggcctgagtgtgctggcttctaacaagatttgcctcttggtaggaggaataataatgaaataccgtctatgataatatatttctctcgggatgtatcttaggggtcaaaatgtagtagaaggaacacaggcaagaaagcacagagatctgggtcctaaattggatccagagcaactcccatctccactctggccctcaggctcttcatctataaactatgaggcttggacccagtcagtgattacattggaagaaaagggagagaatgtgaaatgaagaggatgaatcaaataaaagtggcttcgttatttctgaatgctccctcaccttcctccactccttgacatacacacatgcatgcatacactagttttcccctcagttgagcatgagagtcagttcccctcagttgagcatgggagcatgagagtcaggatatctgggttctcatcccagctgtttcttgaactctctgtgtatcctaaagtaaatctcttgccctctatctctgttccccatctgtaggatgaggagagggtgttgggttttcattggtacccaccaggagtgtgtatatatgtacacacacacacagagtccatccccagctaactaaagcagggcttcccctggggcagggctctgcaggtctgtgtgtttcaatggcttcccaggtcactctgatgtgtacttctagcttagttccctggctggccagtctctgtgggccttcccagctctgccattctggaagacgaatgggcaattttaggggccttttcaggaactgtgtgtcctgctgctgtattctggtggcacagggattagctcaactgcattttcagctcaccccttccgagcagagtgatttcacaggatgggagctgtgcagagggcaggaggcacaaagaaacactctgtggagtcacaatgtggcaagccgccatgacgctgctcttaacctcccagttgttgcccacgtgggcttttcttgaactatgcaggaacctgattaaattaattgattcctggcttttcgaaaatccctctctggtgggttgcatgctgcttatcaagatgttctcgggaagctgatgccaggttaaattccttgcactgagaaggccagagccggcttgattcagacatggatatggtagaggagggagggcagcctgttgcctgcttttctttccttgtcgctttagcaaacatggagcattacaggccaaatgtgcttgctgagtggaaaccaggaggcactgagcgggtggctcagtctggaacgcacagggcgtagtgcttcttagcacagcttctgagcacagaggagactgcaacaaatgatagctgctgtgttattgtagtggcagcgcagtgtaagggaagagaagctccctgaagaagacttggatgtaaccccagctcttctgctcttcttgacttgcagatccaaaattctcagcttccttaagtttcttggtctctaaaatgaggaggctggactcaatcaattattttcaaacttggactctcagggttctgaggaggcaccctgagggctgcctcaggggtatggaaggtggaagaggaggctgagcaggcagaacccagaccctctaactgaccacctagagcctcaagaacaaactgccattcacatcatagtctatgtcaccagttctcaaacttttccatctcaggactcctttatactcttaaaaatgactgaggacctcaaagagctttggttcatgtgggatttatctattgatattgactgcattagaatttaaaactgagaaattttcaaaaatatgtattaatccatttaaaagaacaatagtacctattgcatattaacatatttttattaaaaataacctatttccaaagtaaaaaaaaataactgagtggcattgttttatattttgcaaatgtctttgatatctggctccatagatgatacatggattctcatatcagcttctacatttgatctgttgtgatatgttgtttcggttgaagtatatgaagaaaatccagcctcacacagacatatatttggaaaagagaggcccttacggactccctgaatgattctggggaccaccagtgtctttataccacactttgagaactgcttctctacctgaattgcactccctggagatgtacagtgcccatcctgctgggcaatgaatggcagctcttctctcactccctcccccttcactgtatcccctctttatttaaagcagctcagtttttctattttatataatggagatcctggaagattttatttgaaaaaaggagtctgcttctaaaagtgtttgaaattcacccaccttaatcttaggttactgaagatataaggatttggaagctgattgagatcctatcactcggatttttctcccctaaggatgcaaactcttgggctttgaggagggtcctttggcattgtgcctcagctcttcctggacagtgactggcatgtcatcttgacagtgacagtcttagcacatgaaaatgccactgaatgacttgaaagatttaatgccacttcacaatgggactgacctgcccagggagtgatacaggctgaaggtggaggggattcaatatttgttgagctgtctgatcactgaagcagagagatgggccataagggcaagtttcagtgatatacttctatgtcgtcatctttagagctagacattcatcatcattatttatttcctagatttatgtcgaactttcattccaagggacaggagccagtgttgaataccatgggatctaagtgccttcacaacccattgaagcttcctccaatttcttgtttaataaagaaggccgtgctcttctttcccttattgccagagtcattattgatttcatgttattccttttataaaatcacctcctgggttttcctaggcttggctcttatagccgagaatgttctctcctcagccttctgctgggcctgatgctgtgaatcccatctatgtgggtcaggggacaattccacagccatcttgccaacatgcccgcgttaggctgtgagcatgcgcagaagtactctcagagctgtggaggaggggaggctcccacacccgctgccttgtccttatttgttttgtttctcccaccagcctaggcattaattaagaggcccagactcaaaagcccaccgttagggtcaatcatttgggctaattgagtgtttccaatttagtggaactcttctctgaaagtaagaaataaaactgaatccctgggagaaaccggaacccttgtccattgctggtgggaatgtaaaatgttgcagctgctatggaaaacactttggcagtttctcagaaagttagagtattatatgatccggcaattctactcttaggtatatatctaagagaaatgaaaacacatgttcacatagaaacttgtacattaacattcatagcagcattaatcatgatagtgaaaaaatgaaaacaaccccaatgcccatcagtggatgaatggataaacaaaacgtgctgtgttcatacaatggaatattgtttagctgtaaaaaagactgacatgatgattggtacatgctacaacatgcatgaacctcagaaacttgatgccctaagtgaaagaagccagacaaaaaagaccacatactgtatgattccatttatatgaataatccacaatagacaaatccatagagacagaaaacagatgattgccaggagctgaggggagggtggaagggagagtgactactttacttaatgggtacaaggttttcttctagggtgatgaactagatagaggtgacagctgcacaacatgtactaaattccactgaattacacactttaaaatggttcattttgtgttacatgaatttctcctcaataaaaaattcaaaacaaatgaacaacaaaacaaaacaaaacacctgaatccgtggctgctaccctctttcgagctagtttctcttatgaatgtgtgtggaataaggaacccaagcctgggccgtgaactcttccagagtgggaaatgggcttccaataactcgtagacactcaatagttatatactattgagtatataactattatcatgtatggagatatcatatatggtttcccatattgctgtcttcactgtaggctcatggaaagcagggaccatgtcttattcacccttgaattccaagcgcctaagcaccattcccagcacataggagacaatagatgtttgctgaatgaatgaatgaatatgtttgtgactcctctttattcatctctatgcccccccccccaataatgctagtaatagttctaccacagctggtgctcagaacagatctatggatttgtcaagtgagtggggatgagattgttttagttttagtttttttttaaggttatttatttcaaatgaaccttaaagtaaacttaagttccataaagagtcatattggggttttgattagcgtttcattactattcactaaaaacacttttttcaaaaatgagatataaaaattggacaggatgtagaaaaataggagatttggcctatggagattcaaaaagagtaagagagagatctcagctttaataaggggatgagactgattagatgcattttactttaaaaaaaaattgtggatatctataaaatggaacattatccaggccatgaaatggaatgaagtactgataaatgctacaatatggatgaaccttgaaaacattatgtgagtgaaaaaaaagccagatacaaaaggtcactgttatatgattacatttatttgaaatgtccagaataggaaaatccactgagatggaaagtagatgactggtagtaggggctggaaggaatagccagataggccagggacagctaaagggtacagggtttctttggaggtgactgaagatgttcagaaatggactggtggtgatggttgcacatgtctgtgaatatactaaaacccattgtatactttaattggatgaattgcatggtatgtgagttataccttcataaagctgttagaaatttagataaatgtcagaaaagtaaagaatacaatttgaatcaaaaacaagtgtgactgtgttttgggagagatcttcatctaaaatataaaataactgcctggctagattcaaagggtttctctaggaaaagattcctttactttttattttttattattttttcatttttaattttaattttttgtgggtacatagtaggtgtatatatttctggggtacttgagatgttttggcataggcatgcaatgcataataatcacatcatggaaaatggggtatccatcccctcaagtatttatcctttgtgttacaaacagcctgattacacacctagttattttaaagggtacaattaaattattattgactatagtcaccgtgttgttgagatatcaaatactaggtcttattcattctttctatttttgtattcattaaccatccccaccttccccctacccccctccactacccttcccatcctctggtaactatccctccactttctatctttatgagttcaattgttttgatttttagatcccacaaataagtgagaacatgtgatgtttgttcttctatgcctggcttatttcccttagcataatggcccagttccacccatttgttgcaatgacacggtctcattcttttttatggctgaatagtactccattgtatataagtaccacattttctttatccatccatctgttgatggacaccttaggttgcttccagattttagctattgtgaacagtgctgcaacaaacatgggagtgcagatatcttttccatatactgatttcctttctcttgcatatatactcagcagtggaattgctggatcatatggtagctctatttttagtttttgaggaacctccaaactgttctccatggcagtcatactaatttacattcccatcggcagtgtatgagggttctcttttctccacattcttgccagcatttgttattgcctgtcttttagatataagccattttaactggggtgagatgagatcttattgtagtttttatttctctgataatcagtgatgttgagcaccttttcatatacctgtttgccatttgcatgtcttcttttgagaaatgtctgtttaaatcttttgcccattgcttaatcagattattagatttttctgtaaacttgtttgagctccttatgtattatgtttattaatcacttgtaatgtcagtagtttaaaaatattttcccttcactttattatattattatattatattatttctctcttcactttatttattatatcctttgctctgcagaagctttttaacttgatgtgagcccatttgtccattttgctttggttgcctgtgcgtgtagggtattgctcaagaaatctttgcccaaacaaatgtcctggaaactttccctaatgttttcttgtagtagttttagagtttgatgtcttagatttaagtctttaatctattttgatttgattttcatatggcaagaaataggggtctagtttcattcttttgcatatggatattcaggttttccagcaccacttattgaaaggactgtcttttccccagtgtatgttcttggcaattttatcaaaaatcagttcaatgtccatgtatggatttgtgttggggtcctctattctgttccattgacctgtctgtttttatgccagtgccatgctgttttggttgctatagctctgtagtataacttgaaatcaagtagtgtgattcctccagttttgttctttttgcttaggatagttttggctattctgggtcttttgtggttccgtagaaattttaggatgatttttttgctatttctgtgaaggatatcactgttattttgatagggattgcatcaaatctgtagattgctttggtagtatggacgttttaacaatactgattcttccaatccagggacatggaatatctttccattttttggtgtcctcttcaatttccttcatcagtgtttcatagtttttttatagagatctttttctttgactaagttgattcctagatatttgattatatttgtggctattgtaaatgggattactttttaaatttcttttttagattgttcgctgttggcatatagaaatgctactgatttttgtatgttgattttgtaattgcaattttactgaatttgtttaccagttctaatagttttttggtggagtctttaggttttaccaatataagatcatatcatctgcaaacaaggccaatttgatttcttctttttcaatttggatgccatcatttgtttctttcttttcttttcttttcttttcttttcttttctttttgaaatggagtcttgctttgtcaccaggctggagtgcagtggcacgatctcagccgcagccacgcgtgatcccaggttcacgccattctcctgcctcagcctcccaagtagctggggctacaggcgcccgccaccacacctggctaattttttttttgtatttttagtagagatggggtttcactgtgttaaccaggatggtctcaatctcctgaccttgtgatccgcctgcctcggcctcccaaagtgctgggattacaggcatgagccactgtgcttggccaaaactacaagtttcattctcttgtctgattatgctagctaggactttcagtactatattggttaacagtggtgacagcaggcatccttgtcatgttccagatcttaggggaaagactttcaatttttcctcatttagtatgatactagctgtggctctgtcatacatagcttttattatgttgagctatgttccttgtatacccagttttttgagggtttttatcatggagagattgaattttatgagatgtgttttcagcgttaattgaaatgatcatatagtttttgtccttcattctgctgatacgatgtatcacattggttgatttgtgtatgttgaaccattctagcatccacaggatatttctcacttggtcatgatgaatgatctttttaatatattgttgaattcagtttgctagtgttttgttgaggatttctgcatcaatattcattagcgatattggcctgtagttttctttttttgatgtgtctttggttttggtatcagggtaatactggcctggtagaatgagtttggaagtattccctcttcctctatttcccagaatagtttgagtaggattggtattagctcttctttaaatgtttggtagaattcagcagtgaggccatgaggtccagggcttttctttactaggagtcttttattacagctttgatctcatgacttgctattggtctgttcaggtttaggatttcctcatggttcagtcttggtaggttgtatgtgtctaggaatttgtccatttcttctggattttccaattttttggcatatacttgctcatactggccactaatgatcctttgaatttttccactatcagttggaatgtctcctttttcatttctgattttttatttatttggatcttttctcttttcccttagtaagaaaaaccaactttttggtttttttgtttgctttttgtttttttttttttgtttttttatttttaacataattttattttaatacacctatatgtttgaatatttgaaatctcaatcaccttcacagcacaatgattctacaaagcattctttcctttagcctcactgtatattttatcaaatgacatgactgttcctaattcataattgggacctaaacctaatggaaaatactatttcatgtattcaaaaatatttgtggtctttttctactatgtatatctggcattgttctcaggactggactctattagttttattatgaaaatgttaacatttctccatagagttgttttacaaaaacacctgtttttcaaaaacattctggggaacaacctgaaaacttttaaataacatttagagcatggatttattttaaaaattacctgatcccttttttaatgcatattgtgactttctttaatcatgaaaagttttcaacattattttggcatacctgaaagcttttaactgtccttaaaaaccccaactttgcaatagtaaattatttcatgcatcacaaaatagtcttataaaccaactttttgtttcactgatcttttgtattgttttcttcatttacattgcatttatttctgctctgatcttcgttatttcttttcttctactgttttgggtttggtttgctcttgtttctctggttcttttttttttttttttttttttgagacggagtctcgctgtgtctcccaggttggagtgcagtggcgcgatctccactcattgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgtttctctggttctttaagatgcattgttaggttgcttatttgaagtttttcctcttttttgcaagaagggtaataagccatatttattttaaaacataaatttaaaagtacctacatcaattattattaaattgaaccagcaatatataaaataaataatgcattgagtccaatttcagttgggttcacactagaaaacctaattagtataattcaaccacttcagcaaaaggaaagaaataaatatttcaatggatgggggaaatgaatttttattattccaaaataattcatgattttgaagaactcttagcaaataaaaattaaaatgaactttcttaacctgataagcagaatctaatgaaagcttacaacagtcaccccaaatggcaagaagttagatcattccctttgaagacaggtttttcctcttttttgatgtaggcacttatagctataaacttatctcttagtactgcttttactgtatcccataggctttgggatgttgtgcttctactatcatttgtttcaagacgtttttcaattccttcttaatttcttcattatccactcttcattcatgagcatattgtttagtttttatatatttttgtagttccccaaattcttctcattttttatttctagctttattccattgcagacagaaaagatgcttgatactatttcaggcttttaaaatgttttatggctggttttctgacctaacatatggtctatccttgagaatgatccatgtgctgaggaaaataaagtgtattctgcagccattggatgaaatgttctgtaagtatctattagatccatttagtctatagtgcagattaagtctggtgtctctttcttggttttctgtctggaagatagatccaatgctgaaagtgggtgttggaatctctgattattatcgtattgggacctatctctctctttcactctaatggtatttgctttatatatctaggtgctccagtgttgggtgcatatatatttaaaattattatatcctctttctgaattgacccctttatcattatatagtgaccttctttttctcttcttattgtttttgtcttgaaatctattttgtctgatacaagtatagctagtcctactcttttttttttttggtttccattggcatggaatatctttttccatccctttattttcagtctatttgtgtctttataagtgcaatgtgtttcttgtaggcaacaaatcattgggtcattttttttttaaataaactcagccactctatgtcttttgattgaagagtttagtccatttatattcaatgttattattgatgagtaaggacttactccttccattttgttatttattttctggttgttttggaaagatccctttaaattgggctttcctttcagcagcaattcatgtgagtttccagatcattacctacttgatgaggggctaggggcagagtagcttaaaggcagagtatgaagggcaactgccaactgttgggcagttggagattgatcagaatgtatgtcagtgggaaactaggattcgatttacacaaacccagctgcctgatgatttctgcactgcctgtaggatatatggggtgtccacattttcatgaggaggaatgagcaagcagtctaatgatgtgccacttatacaattagcaattcagcaagttcaacttcaaataagcagttctgaattcttcttcctactccaggggccgtccccactacttcagtgtctatcagcttttctgaaagaagagacaccatggctacagggaaaccatggtggggctgtgtgtggaggcaagtactgcctagtgttggatgcagactgcagctgtatcctttgcccttaggcaggaagaaactcccacagcatcatcccagctagagagtagcttggatgtcacagtcagacaggcagccccagcaaccttaggtggtacagcagtttctgtggggagattataaagccctctgtggttacgaaggagttgacaagctattctgatggctttctgcctgttttccttggatcctgaagacaagagcagtccaaagttattcctgggaagtgagaatcaggcatcagccaaggctttgtcagatctgggtttgcagatgagggctcattcaatgttccttacaattgcaaaaaaatggacatgtgaaaactcacttgtaacttgaaggggcatcatttctaattgggagatagccacagagaaacgaaggggccaaaacattgctagtgtgaaaagcacataggctttggagtcagatcaacctgcaagtcccattctttatgtcttagatgcatgaccttgtccaaggccttcacctctgagccttgatttcctcacgtgtaaaaggagataggaaagagcatcctacaggggctattcttctaattaaacaatgtccagtcctcatgcctggatctccgccactggctctcaactcacctttttcctcctatctctctagcatagattgctgcgttcattttattgtagagggaccttggtacttttaagattcctgaactggaattcacaaggtctgagagatggttttgaccctgttatgactgtgtgaccttggttgagtccctttctctctcaggacctataaaatgcagagtttgggcttgatggtctttaagggtaccttccaactttgataggtttctaaacgatgtcaaggtcaaattctgaatggcctggttcactgtgctagaggatggccctgatcatttggcaagcacaactctttcccaaggcgacattgcccttcttaccattgtagttacatgggccctgctggaatgagtcacatactctagcttcttccagtttcttcccccccttggttaacttggcttggacattttggattctgtctatatgtaatttgattgcattttcctatagataagaaatataggtataatagcaaggagcacctcaccccccactgcttcaaagagagagagagagagagagagacctgatctgtctgccaacttctctttccctgtgggtccctggcctatccactgctacctgatttatgtcctaggggagcagcatagctatggtgaagatttataccaggttttcatcttcaaatgagctactacctctgttccttgtgtattcaagtgcttggcactcatagccaagcacttgaattctggaattcaaaatgaaaaatagtcccatgagaggcctaaagagaggcaaacaggaagcacttcagagtgtgctgcagccttgtacagtaagtaggatgcagtccccagctctcagtggaggtgtgatatgcccagagagattatatacagtgatccctctccacattagtgccttgtgtaggcatggtacacaatgcattagaattagacaaggcgtaggatttggagacaggaaatattgaatattcccatctcagcgccttcacttattaactgtatgaccttgagcaaatttctctttgagcctctctgacttccctgtaaagtgagaagaatgccgcctacctcacagggttgctgtgaaggcaaaatgaaatacagttagtacagctgagtggctcatgagcttggtcccagcaccctacaactctggatttgaatccagactctaccacttatcatgcaagtccgtctgagcctcagttttctcatttaggcaatgagtatagacttttgttcaggatgaaatgagataattcctatagtgtgtggcatctggcatatagtaagcactcattaaatgttagctaatggtatgattgttattgtttgtcatttaggtaaaatttccaataattctagaaaagatattttgtgtactgtgccagatggtttggcaaacttggtccatattttatatgcttggggaaaaagcactgggtatttttttggtcctggttttgaaactacaggtaagacatgaaactgagactcttccaataaaaggatacctgtttcctcatggaaagcaagtttgcgctcacaatggtgctacaccttcatgtagacagttgtctgcagcccacaaaactgttgaagtggtcatgatatttcaaaagtagcacctccatcgggagcagcagtgttaatccagttatgaatattacacctgccaaacagaaagaatcctttagccacgggtctcaagcacagccctggatgtgtggatttgccacagtgacaaagactactagcaaggtgcatggggacaagaacagcaatggcttaaagcctttttcatggatttttgacaatgaagttaattatccagatgtttcatgtacttgaccccggacactcagatctttggaaacatctggacaatgtgggggtagttttcatatctttcatcaaaaccgttggttgtattaaattcagcaggtttcattaatcacctggtttgtgccctgttaggtattattgatcacaaggaagtcacagttttattgagaaaaattagactaacaggtttgaagtgaccaatgaaaagtaggagagctgggatatgaacatagttccatcaactcctatgcttgtgctcacttcactctagcacatggcctcttttcatttggggctggctgaaaggaagtttcagaccaaatccagtggttcccaccatgccttgacttcagcagcgacctaagctcctttgctgaaagcaggtgacatatatccaaatggaccatttcatgtgtctccattgtctgatccttttagtgacttggtggaatattccctgagaattatcttgatccttattttagcactagccaaatcattacttgttagggagtttttcgttctctgtgttttaaatgtgtaaaaatgtgaatgaagcagttatatcttgtgttggcagcttgccatccttggtctgtgtcagcataaaatattttggattccatagagtagcagccccttgcgaagctgtgtaaaagatacaatgaaaaccttccttctgatttgaaacagtgctgaaatagcatcatttgtggaccttccagacccaacgatctgaaacatggaaatgaaatgggataaaataactcccagtacacatatatatacttaccttgtaaatgaaacttttcggcctttattaacagaaagcaggccctgttatacccagaaaatttctaagagattccttattcgttctttctttcctttaagtcaaaaatactgtatgtatatgatcaaactgaaatgcatcactggaacctaccatacaaatacaggtgcttgcgtttggagaattccaaaacacatatgaaaatcattgtcaagtttcagttgaagaagtcagcctgtacctatgcacattttttttataactcaactagctcccccacatcatgagtggaaaggcttctcagaagggaaaacaagccaggttttattttatggccttcaattttgttttatttcgttttactttgtttgttcaatggcaaaacatccttttcactgctttctgaaagactaaattgtcaaataggtgctgtggtaatgttttcagaaacaatgtatcctgccatagccaaggacaagttatagacaaacccgttttccacggaaacaagaatccttcagtgtctagattgttaattagatcagcactagagggcactcttatgatgccaaaatgggaaatttttactaaaatctgctgggcaggggtgtgagagaggagatgaggagggggcagtttctgtaaggactgcagaccacagacaaacagcttagacaagacatgtgcaactgagaattgactggatcgccaacagataaaacactatttgaaaagggctgtttggcagtgttccctatcagatccacttggtttccaaaatgcagtcggtgctttggcaatacacgatccaggtataaggcattatttctcaaaatgaaagagatataagaagctctgattgttaccatgtgatgtagtaaaagcacatttaggcagaaaacaaaatgtggagagaagcataggagaatgtgtttacaacttaacagctactgagaaagaagaatttcaaatccttggggtcttttatggttgttttccccatcttttgcagcccttgctctgtgaattgttctgaagggttgtgtgattgagtctgggagagcaggtgcttgcttgtctgctgcccctaggcaggctctgatggacacagggtggatgatgtgctgtcaagtaaagggacaaatggacttggttttgtctctggcattgatgtgctctgtgatctgtggcaagtccctgccctctcaaagtctcagggtcagggaagagttgggtgacactagaggtctctaaaagatcactagaagacatatccccgagtttgtgatttatgattgcggaaataacttttgttttgttttggttttagagacagtgttactctgttgcccaagctggagtgcagtgacatgatcatggctcactgcagccttgaactcctgggctcaagccgctcctcctgcctcagcctccagagtagctgggaccacaggcacatgacaacatgcccagctatttttcgtattttttgtagagatggggtgtcactatgttatccaggttggtcttgaactcctgggctcaagagttcctcccaccttggcttcccaaagtgttgggaatacagacatgagccactgtgttctgccagaacttcccatatcagtcatttatagcagccacttgagttctgaatcgaacaagatatggtaggcaccctggggtagaaggtgactctatgctgtcagtaggatggtaccgaaatgatttgccagcacagaggggcttatttgcctgtattagtcattgctttaggtttatggctcagtccaaatataacctcagagagtgaccacactaagccgtcagtaggtcccctcaaattcgctcattatgtccaagttaagcctgatccctcacttgtgtgctaggcaccagccagaatctcaggcatgcccatgtgtccttccctgaggagccagtgtggggcaggggctctgggcacttgatgggaagagtggcacactgaagacagacttatctactctgactttggccccagtgtttgctagagaaatgcatgagtgtttttgtttaagtctctgcttgtaagaacccaggctatccttcataggaatgttcctgattgagtcaaattcattataaagtcttagaatgttattggccgggcacggtggcttatgcctgtaatcccaacactttgggaggctgaggcaggtggataacttgaggtcaggagtttgagaccagaccagcctggccaatatggcaaaaccttatctctactaaaaatacaaaaaattagccgggtgtggtggcaggcacctgtagtcccagctactcaggaggctgaggcaggagaatcgcttgatcctgggaggcagaggttgcagtgagctgagatcatgccgctgcacagcctgggcaacagagggagactccctctaaaaaaaaaatgttatcatgaacagggacctttgggaaatcagctagtccaacaccatcactgtagagatagggaaacggggagccatcttcatttgggaatggggttgcctagggtttcacagccagttaatggcagagctggcattggggtatcagttttttatttctattccaggcctctttctgttaccttgtgctatatttttctctctcctgcaatgtccattctagggaataagtgaccaatggctctgaacctaagggtttttgacatagctagaatagctccgtgtttatggattgtgtcatttaaggtagtacaagtggaaagatatgaggacacatccctatcaaaaatatgtcctgtttaaatgtcataggactggagatcaaaccaatataggatcattcctctggatctagaaggctctgaagtcttgagatgctcttgcccaaaagcaaggatcaggttggaatccttgtcagctggcagggaacgaaaggatgggagggtaggtctggaaaccaggtttagtatctcgggggagggcagacactgtgaaaagagcagtcaagacaacctcagggaacttcacagttgtgccaaaggctattccttgggaggttaaaacaaatactcaaagaatacatatttgaaagaatattctgggttccagtattctcatgccaaacataaggagctccctctcatgaggtatgcatgatttccagtggacttggcatggaacaaggaggaattaagagcggtcaaacagtagaacacagatgcaggggacaaccctctcccatatcagtgatgtggttactttccgcatggcctttaactgcacgtgtctttgagctctgcttttgaaaagctggttcctttcccagggcaacaagatggctcaggtacagggggctgcgagctgtgtggcaggcctgccgcagactcactatgcctctagacaattctctgattggtcttcctccctaggtgacagtaataatgcctaaaacgtattgtatgatgactgtggacctgacattctgctacatgatttacaggcatgatcacatctaatcctcccaagtactttaggaactacccttctagactgaaacacatgggcctacctacccatgtcgtttgctgttggtttctcctctgatagggctgtcttttcttctgattggtcagttccgataccatatctgttgttaaagatggtgatcatcaccagtgtaggcattatacttgtccccactttgttttttgctgttttttttgttttgttttgctttgttgagacagagtctcaccctgtcacctaggctgcagtgcagtggcataatctcggcttactgcaacctcctcctcccgggttcaagtgattctcctgcctcagcctcctttgtagctgggaatacaggcgcctgccaccacgccaggctaatttttgtatttttagtagagacgaggtttctccatgttggccaggctgatctcgaactcctgacctcaggtgatccatctgctccgcctcccaaagtgctgggattacaggcgtgagctaccatgccccaccttgtccccattttctaggtgaggaaatcagggctgagagattaagttgccttttcagtgtcatgcagttggtaagtgaaagagctttaggaccagattccagtctgtgtgactaatggacttatttcatggtcccacaccacctctcaggactgtgcataagcaaaaggctgaggtcaagcattttaacactttgcaagtaaaaaagaccagcagcttgttttgcatagggccttaagaaacacccaggccctttgcctggctcctccattcacctccaccagtttgagcaacagtccttagcctgggactttgggggcaccacacccctttccatttagggaaataaaatttagcatgtattaacataaggcattttttgctaggatatactactgtatttggccttcagagatcaaatgaggaaggtggcttgagatacaaaaggaagtggtgggtttctgagcagcaatagagtaggtgaagaccagaatgatggtggaagggcattctacatgggagaacgtggaaattctaaaacacgtcagctcttggtgtggcagttaaagggagggtgagcacaccagttcagtgtcagaaagcagagaggttgaatggaccatttgcttggcagctctggaacagtggtaggcagttatttatcatagagtgtactatctgctgcagatttgcaatctgacccaaacagtgttggtgtgggtttcttaacaacttccttctctctagctgttatatggaagtgtgtggctgtggaggtctctgctgttgaacagccatcaccaatatcccaggctcctggcagatgaagaacctgcatgaacagaaagagaaatgtggagggtggtggcggtgcaagagggtcaattgttcatcaattcgatttttcttgtttttctcaattaagtttccttctataatttttccatcataaagaatctgccactctatgtttcaaattaacaaagctgtttctctggacagaatgatgttcagctgcatttaaatttggccattatgattttggacatactctcatttactcataaactcttcgaaggctgtgctctgggctctgtgaactactaatagcatgttgtactgagaaaatgactagggattggtatacttctaagtaacatcaagggaaagctattagagaatgaaagaatattggaactgggggaattttagaaaccatcttgtcaagctcgttcatgtcatacagcccactgggagagtggagaagagaatttgcccaagatcaaatgagtcattggtaaaacctggattaaaaaccagggatcctgattctcagtcaagggctcttggatttttacctcatcctgggttttccaagtcttaatttggatccttcatacaaaagtgaatcgtttcactttcatttctcaagccctaagcacccaccctgagaatgtaaatgccaagcataagtgtcatggtctgaggttcctgattaggatgaatccacatctggagcttttggattcccaagtctcccgctattcccattactccagtgctatatatgtgttctcttcattttcatcttttgccttccctgcttattggatgcttagtcagttgcctaagtaccatttgagtgacatttagtcacatcttctggaacctggctcagaggaaggttattcctatggctttttctccagccagtgtctgggtcatgggcatggtaaccacagctccttttgtccttccagtgctgctgctttcccaggatgtggcttgctgagggctgatgaatcccatcttagagtgtcagccaggccagctgttaaagaacatgacagcaacaaatgagaaagactctgttgggatgtgggactacagtattatgaaactgccacttagaggcttcctgtttttacagtatttcaaggtgcaagcaagtggcattctctgggcagcaaatggcccagctgaaaagaaacctgatttacagcctgttgggagggctttccacaaggagaaattatgaatttgtaacgtcccttccaatccaaaagagaattctttctaatgcaaatgtttaatctgatgccatcgagtatgttctccatacataaacaaaggcataaataaaacagggagaaactctttcctagaattgataatatacagtatatttctgtagaactcttttccaagcagatggcctaaaaatattccacaagattgtaaactctgtagagtcagggatttttgtctgttttattcactactcagtacctctaacctcagtacctctaacaatggctagcacataatagataataaatattttttaataaaacatcatgattaaagggcctttttaaaggatttcattaaacaaccttcccaaagagagtgtgtgtgtgtatgcataaaatgggttcttaaaattaattcattctcttctaattagtatgtatcttttgttttaccttttccctatgaactttggctcacttctgatgactggccacccttttgattgatgcacctgtaacgtcttcatggatcgtcactcaatactccacctcttcccacctgggctcccaggtaaggcaatgagcttccaaaagtcttctcagtgcaatcaccaggcaaattttataaggcagtcaagaagtttacctagaaataaaaaaactcaagagacaataatagtgattaaagttaaatttgatcccgttcccatataaatcaattatttatacacttaacatcatttgagaatttctgttagtacagtgaaataaaaattatggctttggaaactgctgcatacttaactttggaattttctgatcctaggaatcaatatatggctttatgttttccttctaaaaatattttcttgtgtgtgtgtgtgtgtgtgtgtgtgtgttttgtcttttcacccaaagttgtgttgtttttgttcacaaggccaaattttgtggaagggatcatagcctctcttcactgtgtagggactctaaatcatggggtaggtcagtacattgtagattacttatttcttgcggctggagtagaagacgagcacattgggctctggatggtaagtccactaataggagtgtcttgtctaacagatttgatgttaggcctcaccaagtatatcgcttttgtttctcatgacatttgcttccccagcagtcttaacagctcagaaacagggaaagggggcttaaccgcaccagagactgataataaaagagccatgtattgcttctcaaatgatgattcaaaggctctgctgctagccatgctattaaaaaaggctctcttaactcacttctaaggcctgcaaagcgtatttgctgtaaagaaacatttctcccaagaaaatgcacaggctatatagcccacttcgggcataaaagaagtgttgctacattgtaaaattccttgttctggcataataaaaaacaaaaggctaactgagcccatttgaaccctcaaattagcaactgacctgtgtataacttcacagtctccgcctgctaataatatcagtaattcacacagtggaatgagtgttttgtgacccttaagacatacattataaaaacagctgagcatgttttttgaatggggagacattgcttactttgatggatgtcttgtgtttgggtggaagggactagagagatgatttatatatcaccttatgtgtgctttgaattttcatctttttaaagagcatcagtaaagtttaattgttctttattttccttttgttatttgtgtttcgtatattcctgataatatgaaaaatccctgccaattcctcctaggacctttcaatcagtcatttccatttcagtgatgccacagggttgggtttggtttgggttttgttttattggcttttgtttttttacctagattcccattgctctctgtgaaggggaatggaattagcatgagtgagtggtagatccatcattcccagaccacagcactccagggatctggctctcagtgcagccttgccccttttagccttctgattgggaatctccccattacttgagaggagccagtggggaacaaagtggagaagccatctatgagctgtttccctaaggtttgggaagctggagaaatatgctcttaaagcacaatggaaaacttttattattttatctcctctcctaccaagctcttgctagcgactggttttactgttcctttaacaggtggaggatttttcagattctagatgcagcaaggtaagtaacaatgtatttttagtttgactgaacccaagtaagctagaaaaaagagactctgcagttgcctgtccgtttaatttcagtacaacaaatagttaagtttttggcttggacaaattctttccagggctttttttttttttttttttttttttttttagtttaaaacagctgaaactacccaggcttggagtctcagttctgaaggctgacttagttcagaagggggatgaatgttcagggcgaccaccccagacaggtgtgcagtaggtcattagctctttttcctctttttgctgaaataggatgacacagtagagtgtgttgttgagaagaccccaaccgttggcaaagtgttctttacagtgcttcaggcacgtctgcctgtccctaggctggattgtgatttagagaacaagtaggtcagcatttccttgaagggaaatcaattatttgaaaatatcagggcttttaacgtatgtaaatacgtagacttgcatatttacaagtaatcccataggccagaggcctttttgacatgaagcctgcaggagagcaaatctaatcaaatacaagaaagttcctctctgtggggaagacggacgctgagaatgctcccagatgatgcccctgcaggcaacaactgttgctaagagctgtaccatcatattgccaccagaaccggagagtctagcaagaaccataagtcattttggaaatgtgtgctctagtcgcttggcacattgttttctaaggtcatgatgctcaccagtactgtctttggctttttgtaggcttattggctccagaaatatttactagtgcctctgttttttcttaatacccacctacaatccaccctgtgctccctggccaaataggttagcaagagcaaagactgtagctctggcatttctccacaaggacagactcccattaaaatagactacttgagccattttggggatgcccagtttagctttctgtagctgggcttccatactcccattagagcctcaatggatttacttgacagctgagaatagtaaatttagtgtttaattttgtagtcagattataatttattgagctaaatggcacagacacacatagacacctaatcacacagtattagtatgggagaacatttaaatatcatagattgggtgtgtcatggaggcaaagtaccaagttctgttactaatgaggtgacttttgtcaagcactagctccactctgagccttaatttcctcgcctgtaaaataaaatggagcggatgaccattaagacaatggtcaataacataggtaccactatccctataatagcttttatggggaagtcttgagaattttgttttctttttgctttaaaattgctagatgataggaccatctctttaaaacagttttgctgtataacaaagcaaatcctgacacactctttatttttactatggtgttgattagttggaccagattattgccagagcaactaatacctggtcttaatgagagaaaacaagaggagtacagatggtgagatgggaaagaaacggttttggtaaatatcaatggggccctttttgaattttggtgagctgaatgatgtatgaaaactatttgcaaggctagcatatttttcaaccactagtaaagcaataaaacaaataacatttttggtaatccccattgtatatgcagtttcataaatatacaagattatgattatcgctgcctcataattaacaatttgcataagtacttgctattttttagttgtctgaatagatttttgtaatccagagaaagaagggaacaatcagtggaagccatcccaaatgcctagtattattgctacacacttgcacaattaacagcgatactaattgcttcagaccagaacctcatttgtttttctaaggacagcaaaaacattaatagccagagtgcctgtcaatctctctctctttttcctatagccaactgtatcatagggtctgcagttgactgtaagcaaattattttgttggattttcagtgtatcatcttgtaatggagtttccaagtttcagttagcaatcaatgccttgaacagccagacttatttttataatattttaacaatagacctctataaagttaatgaataaaaggatgctgacatgccaatcagttctgctgctgcatttacattctactacatatttcatatctttaaaattattggcattagacctgcatataagaatcatagaaagtccaggctggaggggagctttaagatcatcccgtcacactccctcctttttcagatgagtatgattgtcagtaatttgaatcttgataacaaccaccaaatcaatgatgccacacttttttttttttgtacctttcaaacgttgggaactattatagtaagtttgaatgataactggttgtttgggaatcatatagtttcaacttattttcaaaacaactgaatcagaattttaaaaatatgccctcataaggcttacctaaacatagccataatgttgatggtatatgtgtgaaaggagatgttctatgcaaatcacctggcaatgagacactcaaccaatatcagctctctttccttcatgcatagattacctaattaacattactatagtggaaacattacatcagtgactgacagtctaggcgtttagagtcaaactgacctcgggtccaatcctggcgctgctactttccagctgtgtgacgttgggtaatttagttcatctctgttggcttcaggtagttttcttatatgtgaaatgtagccagtatataggcttgttttgaggattaaaatgagatcgtgcatatcaagtgcttagcactgttcctgtcacatagtaaacagtcgataatggtggttattaccatcgttttttggcatacccagcggcagcctcactcaatagtatatttaatcttacagtgatttggggtacttacacatacacctgtacacatgcatatttgggcacacaagttcataagatttgcatcagaaagactgctttcccaaaggttacctgtgaccaccatgtttcacaattcaatggcctcttccctggcctcagtcttcttgacctctttggagattctggcacttttgcacatattctcttgcttgaaagggttcataatctatcttgatgtcttctctacattccttaggtttcctttgttgggatctcttttccacacgtacacacacacacacacacacacacacacgcgtgcccacatcttctccctcccccactgcccctttaaatagagcaattcccaaggtcctgtcattgatctgcttctcttctgttgctatattttctccctgggtaacttcacctcctcacatagcttcacctttaacctctacactaatgattcccaaattgacctctccaacccttaattcattccggagccccaggctaactccaatttccaattgcctgctgagaatctccagggcaggatgtcctaggagactgaaagcgtagtctggcttttgtcatccttctcaggaatgcagatggaggaatctagcttcagaagtattaagggttgaaaacaaggcacaagtatggagcattagtctgagcagaagtaacagtggtctaagttagcaaagtgcttcaaactgagctttccaggggaggcataacagataaactgtgaatttctgttattatgcactggagatgtcaattggcagttggaactttaaaaggtttatattttctagggataagggaacagcttcctaagatgaaaattgagttcagtttttaggtgctggaagattggcatgtttggaagaagtgttaattaaaatcatctttcttttcttttctttttttttgagacgagtttttttcgctcttgttacccagactggagttcaatggcgcgatctcagttcactgcaacctccgcctcctgggttcaagcaattctcctgcctcagcctcccaagtagctgggatttcaggcatgtgccaccacacctggctaattttgtatttttagtagagacagagtttcactatgttggtcaggctggtcttggactcctgacctcaggtgatccacccaccttggcctcccaaagtactgggattaccggcgtgagccaccatgcctggccaaaatcgtctttctttggacacttattatcattaatcttgtttcagtgttttgtttaagaaacgcacgtgccaaggggaaagatgatgtactgaacttgaatgatgagcaggtgggaattttgtgagagcaaatgtgtgtgtagacacatacacatatgctgggtcaggtgtgcctgagattttgaatgtgtgcaaataattctatcagtgatagatttttttctttcattcattctgcagatatttacagaacatgccaagctctctgtggagcaacacagctgtgaatatagaacatatagggtctctgtccttaagtgtctaatacatttttttttgttatatgcaggtacattgacaatttaatttagtttagaaatatctgcaacatgtcacaaattgttcaatggccataatcttgctgacaatcttaatgaccaaagaggaacttaagggaaataagacagtgttaaagtgggaaaggaatgtacataaatctgaattagaaattgattacttcctttaaatttagtaaatattgaattgctttggggttttacatttcaagttggcttgccagtgttccaggccagggtaagaatgattatgtctaaccctaaaacttaattagagtaaaggaatagacaactcctggttaatgtgtgtactattgtcaggagaattagttgtaaatgagttatttctacagaaactgcaggctcagggctgatatctttagcacagaggacaatatccctttttgcagaagaatggtcccattctctaccttctcaaaatgcagtacagtcactcctgtttgagctactaccatatggcatatttgaagaccattttgtcctccaagtgggaatcatctacttgtgagttccttgacttcatggttgcatgccattctccccttcagaaatttggcatgggcctttgtctgtaagtctcaattccaagtgttcttggtcccagctgtcagtttcaaagtccccttcatggtccctctcaggtcccaaggatccctcattgcatcagtaaacctagagatctacttggatgcccagagctcctgtcagagctatgtagatggcagccaccctctgttccactatgctagcttctccttcagatctctcacggcacaaaacctctcattataatgatgtgcacattggccagtgcttctatttcctttgccttgcgtgagttagagacattctgttattctcactggaggtaagaatgattaaaaacatccttgaatttagagtctcaaatgcctttattctcatggttttcatcaatcataatataacttctctttcctttcttagatttattcattcaatatgtatctattgagcacttattatgatccaggcactgttctagacatgggggacaatacgacagacaaggtcccttctcttgtgtttcttaaagtgtgtgtgtgtgtgtgtgttggagggaaattgaaaacaaagtacacaagtaaatgaacaagattatcatagggagtggtaagtgccatgaagaaatcaaacacattggacagagaatggtcagacagttggagagtgatcagagaaggcctccctaaggaggtgaattttgctctttgcttttgttgattttgtacagacttcagttacactttgggtcctttggtttcctccatttcatgatatcctggactcggtatgcattctcattttgttgcttcttgccactgtactattaggacaacctcccttcagctagtcctgaagagtaaactaatgtagcctcctgtcaaatatgtgttccacacttttcttgtcgtagtcagtattagaattcagcatgttcacgctcttccctgttatagaatataaatggatgctaatcctttaaggatattttacttgattactcagtgcatttttgttactcaaggcaaactacctattgaaagaaaaacgcaagcattaagagttagtaagcatttggctttgcctatttctgtaaagggaaaagctattgttaaaattagtgttcaaagttaaatagatgatcctggaggttctctttagttcgaaagtagtacaattagttgttttcagagacggagccaaaatctcttttcaatatgctgtttaattttgtaaagtggatatgcaggaacattttccagtgtatcagaagtgcttagattaagcatacattttccgacaaaagctagctttacaattcttgtaaatgtcacaggaacttaaaacattgtgtcttgttttaacctctgccagctagagcagcaattcagcacagcagattcaattgtcagtttcttaaatgtgaatatctgaaagttcattgtcttttcagcttgaccacagggaatcttcaaaaaactaaaaagccaaacaccactaaaatgtttggtggtttcaaaatgctatggcataggtgttgcttgctagtgagttaggtgccaagaaaagcatgttaactcttagaaggccattcggattcttccagccatcattttgttgtcttcctcagcacctagttaaagccccaggtaggaactgaggtaggagttagaaagtttgccttccctaactcctctcacacctcccgtcctgtcccattgagctctgtgggagaagatggggaagcaggtggggtgggtttggagaaggtgcaccagaatgttgccaatatcccaagtacccttgcatctcccttctttaaaacttctgtgtcgtcacttactattccacttatcactcagatacttggctgtgttctaaatacaacaatcaactccatgactagattttgggaaagcagttttttaaaaatccagagaaaagctgagcatgattctgtggtaaaggaatcttcaggagaagaggaaccaagagagtttggaaactcctagaaatgcaactctgatttacagtcacagagattcttgacatagaaaaggagtggggtatagagaaagaagtgaggaaggcacacagcacagtgagtccttgtatgattttaattgaaaaggctgttattttctgcaggtgagaaaatagatgcacatcaaggcaatgacttatctaagtacgtgcagctaattagtggcagatgcaagagaagaacacaagtcaactgaatcctatccagtatcttgattggtaattaactaaactcgctgaatttttggcttgcttttgccgtttaattcttagcgctacgtttgttgccagcacttttaattcattatgctcaaaggactttatcaacaaaggtggacaaaatcccttagaaacaggtaaaaggaattttgttttggaggggttggggccagctgacagatagtacaggatcgcatagaggtgagagtggttggattggaaataaagcctaaaactcaagatttagcttaaaataaaatgaagaaagagaggattgcggctatagactggggatccatatttaaaggtacacatcatctctttaatgctcattcttaatgacagctgtagcccattctccatctgaagattgaaatgtcttttgtttagggttctcagtactttgagtctctttccaggcatatttgtggccttctccttgtctttctgtttttctattctgtatggtttttcatctctaatgttttccattagtttggtctcacggtcttgaccagggcactcatggcacaaccatatatatatatatatatatgatcttatgtgcacataaaatggagaacactatttaacaagttagaaactattagattatttctgttcctctttcggaactgaaagatttcctcttgacaaatggctcttctccaaaatcttaaaattgcacctcagaaaaaaatgacggtcactgtgctaccatgaagcttcctgtcccttcactttcattggcttactattcaatgagctccattgattttccagacctccattgattttctcaaccttgcctcatcagccagacactagaattacaagggagcttcatcaatatcttgtgtggtttcaaaacttttccacttttctaatttgggcaatgggtatggtacaaaccatccgtaaacggcatttggtggtgcattggtctttcttctcatggcttctacaattctaacttgatttctgctcaccacagggcacagtttgccttctcttccctgggagctcttgttcatttgtcaggagacctaaaagaaggctactatgtacagtggtggaatgtcagagtcatcctaaactggcataaataggtctttaatggcctttactgattgtttctatattgacatataaatccacatgaggctgtgtgaggagactgtgcatagtctttctcccgttttttcatatgaattgatttgacaatgtcatagatgatgcatgagacaaagtaaagtgtttcttaagctcactgctgcttgtttgcatgaaaaggaataaaagctacagggaagaaatggacattgtgtgatgctttaggcaggagccattttctgactcacaccttttagaccataatccactttctgaacctgtgcaggggaaagtggtcactgtgatattcttttgctggaaaacctcctaattaatagaggttttctgaaattcataagagatgaaatacagagtctcaaaaaacgaattagttgtaattataaatgcttgcatcttatatgagaaaatgaaatgggataagagctttttgaggaagagtctctgaaaataacacaatgttttattgttgaagagccatgtgatttaatactcagtgatcatgaaatcacatgtaaagcaatccaccaggagagtccagaaagcctcatttattcctctctatatgagcagattcagtgtctcctttacaatgctatcaaaatatgtataaataaaacaacactcttggggctgattttaaatttaacccacagtaactgtaatttaacatgagtacctgaatatttccctatttggagtcaaagtgggataactggggtaggggttggggagaggcccctagctttctgtcctacaacaatctcaagcacaggatctctgatttccccttctcatgcaggaggtattttatgtcttggcaatgggtacttttgttcactaattttcatggcctacaatcataggtcaattggctctgggtcattctggggctgagggaaaacaggtagtgtccttcaatagatttggagaaactggagggggcctcttaacttggtgattttccagtaatgtgattgaaaatgtactactacattaattaattcagtcattacagatacacttattgagcacctaccataattcagcacgattcttaatgctagagatatgacaattgaataagacaaatatagttccttctctcagggagcttatattctggtggcagatatagataatttggaggaagcaagtcaacaaaatgtgtccatattgtgatgaatgttatgaaagaattaagtggagtgctagataggggatatgtagcctttggaataacctcattgtggggcaaacttatcctttgtggatggatttgatttttggaaacatcaaaaatgatatggggccaggtcttataaatatataatggaagatcaaattgattgataaaagttttgcccccaaatgagggtatatatgtaattactgtaatatttttgagtgtcagtaaaaatatatactacactaactagtgataagcacgcccatgtttttaaaggcagtgaaagggctccagcaatgggtgttatcctttggcaagcatttaggcatctatagctaccaacagcactgtctccagttctctgcctctcctcaattctggtcaacccttgtcatcattggcaaatgtactttagctgttatattggtacataaaataaacattcagagacattccaaactatgtagtacagcagtaacatgtgaaatttgattctgtcacaattataatttagttctctcatttcattagtccaaataaagtggagtttcatttatgctattttgtatcaaataaatctgtagaatgctaatacaccacttcgatgagatacaatcaatttgagtctaggaaaggcaagaatgttataagctagaatgtcaagatgaagatgaacagacaaaggaagccatgataggagaattgaggaccccttgtgtgctccttcttgtactaacttaagtgatatctaccatgtccgtttagtgatcgttctagacatgtccccattaaaggatatctaatagagatggttttgtaaaatgagaagaagccaatgatagccatttaattacatctttagtgtgacgttagctccctgtcttgagaagcattgatattctccatgggtgtttacttgagcaactactctgccaggcactgggagtacagaggtgaattagagagagatcctgtctttatggagctcacattgaatttgggagatagaactaaccgttgtggtagaatatggttcatactaatatgtataaacgtagatacttggtacttcaaggagtctgctctaggttgagtcgttgggtcagaaactactaagggaactattctatggtttgctaaagctagtgatggggcaggtatgttcatttcttcacctcatataaatatctttggactcttggcatgattcacatgcatacactttcaatctatctgccagttttaaaggcaggtataatggtgaggtctagtttcaaaataagtagcttttataggtaatattctgtggtttcttcttgaatgtagaaccagaccgattcagaataactctcatgtgacctgttgtgaagagccggccttaatttttctttctctttttttctttttgcaacaccagctccatttctagtagcaaatctgagccaaaagcacagattcattgactgtttgcataagacactaaatagacactgaacagaggattaatgtagccctgtcttctgggagcttatagtctaaaacagacaacaaactggaaagaatatccaacacacctgatatgctcatttcccttctcatataaatccaaagaaaacagaaagtggcaagtcacattctacaggattgggaaaatcccctagagagtattttctttttgtgacttttcaagttaaaaggtattttgtatatgacatgtaatagattacagtgttatttgatgaaaatgcaagcaatgttcttcctttcttttttactatcaacaagttacattggaaggtgtggatcaaattaaaagtgaattcttgatttgccatggggaaatatgtgcagtattttaaatactctaaggtaagggtcaacttgtgggaagaagaggtatcataaaaattaatttaagaaactagccttgagatatttcctaataatcccacagggaaagcaacatctgtgtcataataaaggcgcttagtgtgacctttttgcaaaagggaatattaccgaaacatgaccaaagtttggagctgaggtactgcagtaaaataatgggagtctactaaatatttataaggatgtattcatttgtaagaaagtagtgaaacagtagaacatctgccaaaccaaggttaatttcccaaagctcatgtgtttgtgagagacacagagacaggcacaggaatagaaatgcagagataaagagacacagagagagaaagtagcaagaggctgagccagaggtggacagagaccaagaactgaaaatcagccaccctattgattaccttccaactctgtcatgaaatttactgagagaccttggtcaggtcactgctctctgggccttggtttcttcatgtgtaagatgaagggatggactagaatatgactctatagaacttaccaactccctggttctactcttagctgcaaggtaaatgaaaaggcaggcaggtgggtaggtaaagatatacacgggcaggcatggagacagacagactggccacatacatgcatacacaagtttcacaaaaatagaacaaagcccaaatcatggtagaccagtgaactgtgaatcacagagagcagcagccagatccacaaaatcgtctcatcgcttttgatactgccatggtgaaaacttggcagatttccttttacctagcacttgcccagcttcctggaggccagcattcagaccttttctgactggcttggccgaccctttcctccaccgactcagaggattagttatgtcaggatctgcaaatgacctctgatgcccaaatggaagaactcagcctactcttctaactcttaacacttgaggatgaaaaaactcacataacctaccatgcatattcttgtccaactttctgtctggatatctgtctggttgtaatgttctatggataattttaagcacgctgtgttcaccaggctttcaaaggtaaccacttttaaacttttgtgagtcttgtttgcaggggcatggaaatgaagagaataattagtacttgtcgagctcccagccagcgaatgactttagtaaggtgctaacaatgcactcaagtgagtgcagcaaaatgatgaggacttacagatggattttagtatctggtttatttcacttccattggtttttgcaagatgtaatatagtgtgatttttcttactttgactgcttataatttatcagccttccccaaaataatacccccatagtttaatctgagggcacatgagctgatagtaggtacccctttgggaaaatctgattaagcatttgtttctcaagaaactcctttggtatctgggacaccattttgaatacatctagagcttcacattttgatgctagtacattttataagaatctatgaaaagcaactccatcaaaattgtgtttccttagagaaagatagtgcattaggataacaatctgtattgcacccattaccatagtactttcttaagaggtttttgccatcactggaagccttactcttccaggacaagtgagccctgagaacacaggctagggtgggcatgatgtgtgaggatgaagaagccaggctggctgcagtcaagcttgctcttataccaagtggcggatgggtttggttgagtcattgtagctagcgagagaggatgctgaaagacacaagagaggcttggcttccacatatatctccagcgccacctcgtccctggggtccagactcctgcaactctcacaccactcctgtctctactgggaggtttagttgggatctcaaacttcacctgcccccagacaaactcctgacatttccccagaacgtggtcctctcccaatcttccccgcctcagtgagtggcatctctgtccttaccagttgctcaggggaaaatcttcaaggtatcttttgcatatctttttctcccccaggccatgtctaatccactagcaaattctgtctacttcacctgcataatatatctggaatttgaccgcctctcgccaccatcagctctgtcatcctagtccaagccgccatcatttcttacatgggcttctgtaaaagcctactagctggctcccctgcttcctttattggacccctacagtcttgtctaaccacagtgataacccttttaaaatgttaattgagatgttgtcattcctcttttcccagcccagcagtggctctccatctccttcaacaaccaaccctgcaaggttcctgcaagctccatctctgactttatattttattaccctgcctcaggcccatttttctctaatcacactggtctccttgctttaccttaaatataccaggcctcttgctgcctcagggcctttgtatttgctcctctttctacctggaatgctcttcccctagatatctgcagggctgggtccttatgttcattccagtctttcttgaaatgtcataggaataggattgccaaggagtccaattcttaaaaagaggtcactggtcttggccagcaggaagtcactgatgactttttagagggcagctgcagtcaagtggtagaagaggagccacattgtttttgaatcatctgtatcccttaccaggctgtgcaccgctcgagtctggtgctgttgtctcattcatttttgtctgtctagtaccctccacagtgcctggcaccagtaggcactcagtgtttgtgggatgagggcacgagtcttattttcaaacaattggttatgttaaaacacgttaaattgctgaatgtttgtgattgctttctcagtttttctcagggaatatgtttgaaaaacaaaatctgtgcatttattgtagacccattccctgagtattgacgggtgacatggtgctgtacatgtgatttagaggttttcagtgcacacaggttgtgggggaggctgagaccatcctcagtgtcttagggagataagaaagttcaatctctgcttgtgtatttactagctcacttcccttttaaaatcccctttctagactggaagggctatttaaattcaaaagctatccttgggttcaagcaaaatcttaatgactttagggacagatatttaacaggtggtttagatagttaacactcggctggtggtgaaaaaccacattgaaccacattgaacatggggttccctaataattttaactgagctcaaccttcatctcctttatcgcctctcctttatttaactatctactggagttcaaaacaccactgtaggaatggcttttcttcttgtatcttgccccccttccaggctctgccctctgagatctttccctagacaccagttagagaaggttggccttccctgaaactctttattcctagatccttttgacaccactagtaaatcctgctttctttgctgtctgagaattttatgaaggtcacttctgcagcatcggcctctacaccaatggctaggaagccgtggcaggactctgatcccatttctagtattgctcttaaaccagctctgcctgcaaatgtcagagttttagacctcaagccctctatctcctgaaagtaattgtgacttgtagcctatcacctgggtcagtccacagggtctgctctgcctgtcctgatatctaccatattcgtcatatgagacatttacctatgtgggagggaaaatggtatcacgagtgtggccaagaataggtagctatttctaccgggagtggaggaggtcatttcatacccctacaaaagaggatttttctgttaccccctctgctataaatcaaatacacacttaacagttatatgccatccaggctcattcaacaaacatttgccgagaaccacacagcctgggtgtaaaggagttgggggaaatagggacatgagacatggtccatatgccctcaaaaagcctgcaatccacagaaggtggaaatagtgagaaaggtacagacagagcctatgaatcagtgcaatataatcaggtctgagcaaagtggagccaagaggaagcaatttgttgttgcctgaggctgtagagaagactattcaacaggaaaggcagatgtgggttttcaaagagaagcaggattttgtggagaggagaagatggggaagtgctatcctgttagagaaagtggctttgtaaaggcccagaggcaaggaccagcatggaggatctgggaagggttgtggtgtggcatttagaaaatatgtaaggccaggttccatctcggagggtattgaaagccatgctgagacatagacctgattaagtaggcaataaggagctgcgtacggttgtcaagcaggggaaggagaaaacagctgtttcttccaaagataatagtagcttaactgtggagcaaagaagggagcgggttggcgctgtgatggataaataccatactctcaccatcactgcactgaccacactgagcaaacaactctcagtgtgaaagcggggaagtgatagtcctaagggctgtgtcacccgggcggaagaactgcagttgcatcacttgtcctgatcattgttaaactgagcgtgggctgggagctccttgttcctaggcaaaagtcctcagtaggagactgtaatcatgcctaaaattacttcattattggaaccagtgtttgatctgtgattaagagctggatgaagaaatcaagtaatcagccattgaaattgtaaccataaattgttctataaacaactaacttcccctgtctcccggactccaagcaacaaacttgaaaacagatacttttcctgttgtttcttcacccgatgggttttagccagtgcttttgagccttgcagaagtcagagggtaacacctgccagccacagtgcccctttgtccctcacatatggatcactcatgatgttgtaccttgtcagactaagacaagatacccaaggagtgtggagctgttaaaaatatgcaacttattaagatttgtctagtgagggtaaagagatttatttttaacagaactggggagaaactgcctggatttcaagataaagaatagagaaagccctcagcggttgttgccttttcaatgatgtgttagaagtagcttttgtcctgaagggttttattttgcccaaagcattcaaatactacagcccatagagacatttctgtaaaacaacattagggcttattgactttttcttgtttggggttgcgctgtgcttaaccttccagatatgtaataaatagtaacaaattttaagaaagatctaaactttgttttggggaagaccatggcagcaaccaggcaatcttgacacatgaagtaactgactgtggaaccacaacctgctttgctcctataatgcctagggacaaccagacaagagcggttaagggagttatttcatgtgatcatttttctgacgttaagaggtagcacctagtagttgctcagcaaggttcattttcctcctctgttgtcatttacagcccaaacccttagagatcataacatggaagagcccttaagggtctgcccaaacctttccattttgcaagataagtaggaaggctcacagaagttaatgacttaccctttgtcctcgactggtccttagcagaagcagagctagaatcgggtctacaatccagctgctttgccttcttcgatgggagcagtacttcatctgtctcttgggaataactccagtagcccagtgaaaacattgcctctttcacaaaaattcactttcacaagttagcatccttggcacttggcataataatgcgaccaacgataacatagataccactttatagtctgcatagtgcttttcaccataacatcttgtgttgaactcccattgttatccatggctctactggtggcattttaaaggacagtgtgttgtagactgggatcccttacccaaagaggagtttgaactccttttttaaaaagagggctgagaaaggtttcactttatgttcctgtaatttcttaaaggatttatagataaaaacattaaaatattctgggtgtaaaataaaattgtctcagaatgggaatagacttaaggtacagtgaggagatataggagacaaatcaatggaagatttaaagtcaggaataaatgctgataatggatttctagatacttctcttgaattccaaaaacacgaaaaataaactgttgttactggggtggagacaaaacagaagaagataaagagaacaggctaaggagaaaggaagaggttaagggagaaacctctgtatgaggaacaaaccaaagttgactcttttttcaaaattcctacattctctgggataaacagctaatgtttgaacataaaacagctgaatctcccagagcttcaactactttctgttttggaagttagtactttgggaaattgaagactctttccatttcctagggaagttgccaatttagggttttacatcagaggttggcaaattatgtccccaggccaaatccagtccattacatgtttgtttgtttgtttttggtatggccagtaagctaataatagtttttatattctcaaacaggtgaaaaaattaagaacaatgttttgtgacatttgaaaaatatatgcaattcgcatttcaatgtctgtaaataaagttttgttggaacacagccatgcattcatttacatgttgtgtatgactgcttttgtactgtaacagcagagtctgcaactctgaaaagatttactatctggccatttacataaagagtttgtcaaccgttgctttaagccaatcttttggtttccctgggtcacattggaagaaggataattgtcttgggctacacataaaacacacgaacacaaatgattgctgataagcttaaaaaaaaaagcgaaaaaaatctcataatgttttaagaaagcttacgaatttgtgttgggctgcattcaaagccattctgggctgcatgcagcctgcaggctgcggtttgtacaagcttgcttcaaactgaagtatcttcatgatctgaaagtgttaaataactttctctagagcccagctcttaaccagaggggagtttagacattgggataatctggttcaatataacttaattcaatgacttgtacttagaatcaagttacaaaagtggaatattatgcttcctgtctaactataaattgtattccatagaggtacgtcaaatatttcaattttctaaaatgtaatattaagcttcccagtaattcaaaatgagattaaggggaattttttttcatttgctctttgtaacaaccagcttcatataaccagcagcaaacaatggggtccccagactgtttgaggacacttttgtatcgattagctgtagttaaagcctgaatggttaagtcagcaatttgacttaaaaaaatgctgtagattctaatttataatacctctacagcaacagacttcctatcaggcagattgtggagacaagcagttgtttgtaccgatttctggctaattacttatctatttgatatggcatctcccaccaaaatgccataccaagctgtgctttccaagggcatttttgaataatgggattcaaacaggaatttaaatgttcacccgaaccttctctctcgatctgtgcactaggatgaaggagggttgattccagcttgggacagatgaccaggaggtatgggacagatgaccaggaggtaaatgaaggggttgaggatcagtattggaaggtcaggaaggacacattttacaagttgggacattcaacctatgaatcatttcttatgcagtttcaagatatattttgcattgattagctgtctttgaagcccatacagttaaggcagttttctgccttctgcctcttcactgagcacctgtattagctagagcttagatctaagaattctgtgacttgctgaaatttattctgctagctaagaggaccaagggcctttaagcttcagatttgcatcactgtctcttcaaactagattactttaatgagtacttgatatggtttggctgtgtccccacccaaatctcatcttgaattgtagtttccataatccccacttgttgtggaagggacctggtgggaggtaatttaatcatgggggtggttaaccccatgctgttctcatgatagggggtgagttctcaggaggtctgatggtttcataaggggcttttcccccttttgctcagcacttctccttgctgccaccatgcaaagaaggatgtgtttgcttccccttccaccatgcttgtaagtttcctgaggcctccccagtcatgctgaactgtgagtcaattgaacctctttcctttataaattacccagtcttgggtatgtctttattagcagcatgagaatggactaatgcagtactgtacttttgtaattttcataattgtttcttacattttgaatcaatagtttcataccattatgaccatatattttcaattacatgttattttggagaccatgtcatttttcatgggttttcatagctctcttacttttggctctgtggagcctaggagaaaggttcctgtcatccccatcccctggcttttctgctctgctaaaatcattataactagcttaaatttatatttcaggaaccttctgtaaaatcacaacagagttatcttctgatgagtctggttgctagactaaagatttgtatgaggattgtcagaaatgttggctgggcatggtggctcacgcctgtaatcccagtactttgggaggccgaggcgggtggatcacctgatgtcaggagttcgagagcagcctggcgaacatgatgaaaccccgtctctactaaaaatacaaaaattagctgggcgtggtggtgggcacctgtaatcccaactactggggaggctgaggcaggagaatcacttgcacctgggaggcagaggttgcagtgagccgagattgcgccattgcactcagcctgggggacaagagcaagactttgtctcaaaaaaaaaacaaatgttgactagtgtcttctgtttgggctggttatagacaacacagcttttgtcatgatttcttgtagggccactggtttaagttccaaatgttgcacctgaatactctagaaactatcgtttagctgataaccttgaataatttccagtcagcccttttttattccaaaggggtgtcacttaagatcaaattcattcagagaagtattgatccgccagctgccactctccattaactctcccctcccccagcggctgaaagagtgcccttcttggggccaataaatgtttatattgcccctaggtacgattgttcctccagcaagagccttcattaagcccagcaacatgataaggtaatgaggcttctgctttaacatagcagaacatatatatccaaatgagcatggttccctggctctccttttttattatcctgccttctcccaggagaaagtagtgcattgaggggaccatcaaaactcctcctcccttccccttctgctgagttccccaagacacctggtctcaactcctattccaaattgcccagagaaagagagatgataagtggacagaagacatacaggcggcatggcaaagaagctcaagactggcaaagaacgaaaagcgctgaatacaatggtcacaacagaggactcatattggtctagaagggatgcagaaagccagactggtgtggactaattatttctttatttcttctaaacattctatgactgagcttgaagggtcaaggaagatggctcattggagtgtcctagaattccatattacaattcagtagttttctttgaaagtatggaacacataatagatatatctttgtatcactagcattttgcccgtagcaggtggtaagtgggttgttattgcaacaacagtagatctgagctgtgaacttatacaataaggcctatactgccataatgagtatagcaccagaatcatcaccacattttaattataaaaaatattattgtactctgccatttcccacttataagcatcatgactctgtgaagtcaggtggcaagcttggattatttttatcctatttttcatttgtgtgaaccaaggcataccaatcacttggggggactggtgtgatggcttagaataagagctccaggttttcagctctgcatgtggcactcttctcaacaatctggatgaaatcaggagctagcatcacacactgttgctatttacaaaagcctaattaatacctctcattccctaatgagatactttttctgactccacagacaagcagagccaagcaagtgatgtcagaatgccagagtgaattattgggcttgtgtcaacccaagcagagatgaaaaatcacccctgtgaacttgctccaggagcaatcaaagggccaaagttttaattagtgagggttgtgatttacatttgcattcagcatcctaagaatctacattagtcttcaagctcctgcacttccctagttgttgtctgacactggttaggatagttaatatgcttttaaataacattatatttaatggacctttgaaagcactgacatatgaatccattttctcacctgtcagcagaactgttttcattaaagaagtcagtgaaagaccacatgctgagaggagctaaaagttggtggcagggaacatttcagcttggtatcttgtcctttcacctatatctactgtgaaaattaatgaacagttatctaggaatactaatattaggattgatttctaatcaaagggaaaatgatgtcaaagcactatagtgaataaaggaatgcaatggatttatttttaacaaacatagcagaactgacataatggaaaagggtgctgatttcttcaacatattcaacatttgcatgttgctgtattggttagtacatttgacagctgtagcatgttctcttgactctgcttggttgagagatatctttgtcctttgagagtggattgaattttgggaatcagtcaaatgtcctgagaaggtaatgatgatgtactaattggatgatcagactgggtcctatggttgggggccagaagtgaggtgtgactacacagtcatgagtgatatttctcatgtggctcataactgtctatgaagatagttcccagggaacagctctggaaatgtgaacgccagcagtatccttggaatctgtatacagcttctctgggtaacaactttgagaggaccagcatgcattgggtacaacacaggccctcgtgcgcttgctaaagatctgcttcaatactttgtcacaccgcctacactggctccacatttgccaagtaactatgagcatggttctccttccaacaatctggatggagctagcatccttcatgagtgtaaatttacaaaagtttaattaatatatcttgcttgctaatgagttattccttttgactccatagacatgcagggccaaatacatgatgtcagaattccctgagtgaattattgagcttgtgacaacctgggtcagaatgaaaaatcaccttagtatatttaatccagaagcaaataaagggccagagaattaattaatatgggttttaatttgttaaggtcttaagagggagcctctgtttgctctggtacctttttgtgtgtgtcctctttgattacaggtgaacatgcctttgggaaaagatatctacttctttactgtgctcctcggtaacctatagacaagaaagaaaaaagtgggttcttagtcttcagagagcatcaaatcattgaatttattgtttaggtgatgagccaatgccctgttcccaggaataggtttcatgaggaattgctaggaggcatagaaaaagaattgcacatagtggaagtagatgatgataaaagaaaacaagtgctagagctggacaacagagcaacaccccatgagtcctgaacaaagaactagaaagaaacccaaggaaaatcagagtgcttctttgcagcctttggctaagtctccctagctcccaaaaggatgtagacagcagataacactgctgatgagagggcaggatccagacaggtgagctgtgctagggaaggggctgccaaggaaagccccaaatgcaatggtacaaggtgatccagtgggagcaatccttcctattgtcccatgagcaggtgctttagggagccactggtccaaggcctgcattcaaattcatgcctcctggtttttcaccatctttccaggatcaggttagatcacagaaaggccgcccatttgccactttagcttagctgttactggcctaccttccaatgtggtatccccagctgctattaaaagaaatggacatgagtaaattttactgaatggaaagtatatcccaattaacttgactttttaaaatgtctctctatatacatacatatatatgtatatacatatatatacatatatgtgtgtgcgtgtatatatatatgtatatacatatatatacatatatatgtgtgtgtgtatatatatatatatatatgtatatatatgacactgtcctgtggagactgctcctacatatcctgtaaaaatcagtgcttcatagttttggcaccaggaataagtttgattctcctgacaaaatgataccttctctttaatcacaagttgagaatgctattatccagcgtgtttcttttaatgtttattgccttcgttgctgggaaactcagagctaaccccagcattcaatttcagtaatcttgctctttaagattttgagaattagtctcttatcccttctaaaatatttctactgatcttgttcttccccagggtcatattacaggtacgctttaggttaagctttctcaaaattggggtactggatgggttataaactataaaaaatagtgctctgaccctagtctgtgatggtccgaacacaccaacctgtgttcttcctggcccatgctacttgctctgacctggtgctccttgaaataaaatggatttctgttagttacagcccctatttttacactagagttgatgcttttttcctatgttagtcatgaattataatttctgtatgcccccaaatatcagaacaagtggggatggggaggcaaatagcggcatgcatttctctaatatttattcttatctctggagctggttgtataaagctgtcaagaagaaaatttccacttaaaccagaaccttccagcactaggagtgctgacctgtagcaattacgggtgctaggattgttttacttggtgtcttacttgactttcagtttgtgaccatcacttgacaggattaaaaattgcctctgttctatctgctaatttcttgaaggggacagcctattccagaagagacagtctgagcaggaaacaaaggctctgtactgtgctcagaaactaaaactagataggtcagggcccatgcctgaaagcagttggttctccacagcccattgttatccataggtcatggatacatcctggcaagcaggctgtaaaggacatgaccccttaattgaaataaaatgcccacctaggcatacaaaggatgagtagagaaagagtccttaagggaaatttttaattgtttacctcgattgattgattgattgattgattgagacagggtctcaccctgtcgcccaggctggagtgcagtggtgtggtcatagctcactgcagccttgacctacctggctcaagtgatcctctcatctcagcctctggagtagctgggcctacaggcaagtgccaccatgcccggatcattttaattattattattattatttagagacgagccctcactatgttgtccagacttgtcttgaacacctgagctcaagcgatcatcctgcatcagccacccaaagtgttgggattacaggtgtgagccaccgtgcctggcctgggaaatttttaaaaagaaacagcagaactttttgagagtaagaggggcatactccccttctggggttttatttcccccttgggcttctgaaactttaatgctgaactggcctctcacaagccacagacaaagctgagaatgtcaaaggtaactaataaactgctctgaaaaaaaaaaaaaaaagtaaacgtcattagagtggatggagtctaaaaatccataattctaagaatcccaggagaagcactgaacagctttttaaagccatttcttttgcccccaagccacaaaggattgtttatatccttttgaggcagctagctggatgcccctcttcccaattctgggattccctgagataaatactatcttgttcccttatatgccaactctactttctgctgttggaaacttctttgctacttgcagggccttctcctttcagatctgaaggtctggtctacttccccaaggcatgatgatagactgacgttcttgagccccagtgaaggttctagcctttcacagcttacattatcttcccatctcacatagaatcattctgtaaaatgtatatttctgaggtgtctggactcatacatcctccattgagagggggtctgaaaattgtttaatatagtttaacatttatggcatctcttccttgacagtgtcagtaacagagtgaagactgccattttctcaccaacgttaagggaagtcagggatagggcaggttcttcctacagtagcatctggtccaccagtactgagaacattctctgcaaggagtttgctctttatgtcatttagacattagacattttaaataataagcatgatttctacctttcatgtttttatcactggagttttctacctctccactcctccatctgctctaagccaagaagtgcctccagacagtgacatcttgcactgtgattaaagtgcttagtatagagaaatgagtggacaccaggtttgtataggtttaaagactttattaagtaagaagttgattgttttgtggctggagagaaccagaggaccattgtttgaaagctgacaacctatattacaaagaggtgacggagatgatatcatgactttcaggaagcacaggcttttggaagtgttcatcaagtgggtcgtggcataaggctgacttaaatttttttttaatgttttaatttgttgtagagacaggggtctccccatgttgctcaggctggtctcaaactcctggcctcaattgatcctcctgccttggcctcccgaattgctgggataataggcatgagccaccatgcccagcccttaaattctgattatatcagagccaagactttcttgacgttttgaagccaagttgagagcaaaacgacccatttctgattttctacataataaaggaaacaaaccaggaacaataatcaaaggtggattttttgtttctttgggaagttataaccatatttgcataaactttaaaacagttatgacatctagttgaggtactaaaacagtttctttttttaattaacttttgttgcaataaataaggccagactaacaaaaatatatccaaagccaataattctatatttgtttggcacatgttgcttccttcagcatacttcaggtcatctttgccaggaattgagaacaggttgcatgtaattacaaaggctccttggtgggatgaaggacaggatgactgacgaaataccacagctaatcagataagtgcaccagggaaaaagcaacatgtaatggctggaaacccaaaacacaagactttttttttttttttaagacagagttttgctcttgttgcccaggctggaatgcaatggcgcgatctgatcttggctcactgcaacctctgcctcccaggtttaagtgattatcctgcctcagccttcccaagtagctgggaatacaggcacccaccaccatgcccagctaatttttttatatttttagtagagacagggttttcaccatgttggccaggctggtcttgaactcctgacctcaggtgatccaccgactcagcctcccaaagtgctaggattacaggtgtgagccaccatgcccagccatcagcaaatgagtctattatgatgggaatactcatgcccccagactagatctagtttctcctttgatcccaagccttctggtgttgttctcctttgagcccactgtcccttctctggcctgtcctccttaatcttcttccaaggctattctcttctcatgctacacactctcctcatgtaatctcttctaaaggtttgaactaccatagactcccaaatctctaaagaccattcttcagctgagatctctatatccagctaagttctgcatccgtctatccaattgccaactaaacatcttacctagaggtaccaacaggcacacaaaactcaacatagctcaaaactgaacatgtcatcttcttccacatactctccccaacaaaaaaagaaggctgtgttgcgggaagtcagggaccccaaacagagggaccggctgaagccatggcagaagaacgtggattgtgaagatttcttggacatttattagttccccaaattaatacttttataatttcttatgcctgtctttactgcaatctctaaacataaattgtgaagatttcatggacacttatcacttccccaatcaatacacttgtgatttcctatgcctgtctttactttaatctcttaatcgtcatctcgtaagccgaggaggatgtatgtcacctcaggaccctgtgataattgcgttaactgcacaaattgtagagcatgtgtgtttgaacaatatgaaatctggccaccttgaaaaaagaacaggataacagcaatgtttaggaaacaagagagataaccttaaactctgaccgctggtgagccaggtggaacagagccatatttctcgtctttcaaaagcaaatgggagaaatatcgctgaattctttttctcagtaaggaacatccctgggaaagagaatacgcgcctgggggtgggtctctgaactggcccccccccaggcgtggttgtcttctatggtcgaggctgtaggggtgaaatagaccccagtctcccatagcgctcccaggcttaataggaagaggaaattcccacctaataaattttggtcagactggttgctctcaaaaccctgtctcctgataagatgttatcaatgacaatggtgcctgaaacttcattagcaattttaatttcgccccagtcctgtggtcctgtgatctcgccctgcctccatttgtcttgtgatattctattaccttgtgaagtatgtgatctttgtgaccaacaccctattcgtacactgcctccccttttgaaactccctaataaaaacttgctggttttgcggcttgtggggcatcacggaacctactgacatgtgatgtctcccccagatgcccagccttaaaatgtctctcttttgtactctgtccctttatttctcaaactggctgacgcttagggaaaatagaaaagaacctacgtgactataggggcaggttccctgataagactgccaacccttcttgtatggctgatattggcaaatggagccacaattaattcatgttacagcatctttgatcccacaccttctggccttgttctgtactccgtggtggctatggccctgtctgctatatgctagctaagttctgtcaagtcagtactgcatccttggatacttaccttgaatacatcccttctctctggaccttacttttctatttctaaggattcctctaactctatatttctaggcgtctttcccttgtctggggaggggtcaataaagagcctcactctttggctcagttaagcatcttgggtttaaccagactgtgattaaaaactcatgtgcatgaagcgaagtagattggtttaagttatacaaggtttagcgtttaacagtgattagtggatgatataaaaaagatgtgctttgtttccataaattgtcagaattttagtcttctgttttcatgcacactaaaataatgctcaattttccaaattgtaacacaatacaaagaggctgacaattgggtttcacttggaaaggaaaattaaaagtggtcaatacagatcacagaatagataatatttgcaaaggagaccctacttagaaataacacgcattcaaacaaaggtatgatgcctgaatgtgtgataactaagtagtttaaaaattgaaatagtttcatctgtccctgtaaataaacgtgaagagaaaagtacaaagtcctttggtttaaagggtcagtgtttttaacagacacatgaacgcatagtttaggggaactttcctttctaccccagaaggcattttcaatatcttgttggcatggcccttctacttgatttctaaggagccagatgcactgtttgcttttaagacaaggtctcgctctgttgcccagcctggagtgcagtggtgcaatcacagctcactgcagccttgacttcccaggctccagccattttcccaactcagcctctcaagtagctaggatgacaggcatgtgccaccacactcagctaattttgtttttgtttttgtagagacagggtattgctatgttgcccaagctggtcttggactcctgagcgcaaacaatcctcctgcctcagccacccaaagtgctgggattacaaacatgagccaccacacctagcccagatgcacttttaggtatagatgcatttggccccctagaaagtactcaagatgccaagttcagcaacaaggaaatatttgaatactcttggctttgggcacaacatggagctagagaatgggtaccccatgccccaatgtcaaaatcagcagtcttggttaagtaggaccaaccctgcctcaatgacccaacttgttcaagttctagctataaagacagaatatgacctcagctcttcctaatttcagtgcccaagctttttccacaacaccagggctgcttccagttagtatggcaacaccattctccagagttgctaattttcactggttttactctacttgagtttcctatctgtgggcactagagctaagaaatacttctgcaataggctgtcactttttagtcataaagtgtgagttaacatataatttgaacaaaaagccaaagccacatgactcctttagtaaacctctaacctagtttgcgtcagtcagtcaattcaattcagtaaacatgttagaagcccaatttaccaggtatggttttcagtcagcaggtgctgaaaaccttgtatatggcaagtgtgatcagagatattgtgaacagatgtgaatacaatttgcccttgtccttaaagaagttaatatgtaatgtgcaggcagagtggacattcttgaaaatcccataagaacatattaagtagaaagtgaaacaaagtggtaattcaccagggaggaggaaatgagcctctccaccaacacttagttcgtatcattctgtagtgtaaaatcagaatctcacctccaaatgaataggctgactgacttctctttgttctccgtgtgctaattcttgccattgcagttggctcctttggcttttcctaaaaagttcactgagaattttctggcctactctggggactccctaatgtgtaatgttcaccaactaggctccagttgtgaatttttaattatgccggatcattttcagtaaatagaacttcgggctcaactaatgctgtcagatctaatctttgtctcacctgctatggagctccactctgtggtgtttgcagtaattgccacttccccaggaaagaggagcttttgcagagatggatgtcagcagccctttgcattctcatctgccctcctcagaagccctacagcggggcactttatccagcagatttgaattttgatgtttggaaagtagagacaatggatacagctgattgttctctttcaattttcaccaagtgtgattgtctcatgcttcctgtgaggcagtagttctcaaagtgtgggccatagacaggaaacattaccgtcatctgggaacctgatagaattgtaaattctcaggtcccatcttagacctgctgaatcagaaactctgggggtccctgccacctgcatttaaaaaatactctaggttatctgatgtatgattaagtctatgagcccactattgagagagaactgtttcaaactaaggataagcataatttcgttctattttgtgaaaattctcataactcatttttctgatttacaattcttcaaaaacaaaaatcctaattttcataatggaaactcacatttacctttgctttccctaactttcccaagcataggcagttgtttcctgttttatttccctagcattttttcacacttgtttattccacttggtacattacattgttatgtagctgttaacatgcttgccttctccactagccttggggccacctgccggcgggaaccttgtcacactcatcatagtatccccaaggctacatagtaaacacacattaaagggcacagagtaaacacattcaatattttctgagtggataaattggttaacattgtataattttcaaaactaggtaatggccttaagaagtacgactggcagaataggaaactgagacccagagacattaaaggattcagttggtaagaagttgcagaggcagggctaacaacaaaagcttacctcagtatgggaaaggtgatggccacaggtccctcaaaactggcctaatacactaaactccactcaggaagcttgggatactttggctcttcaagggcaaagcccttgatttactcccagacaggttgctttctgccccaaaaccaaggatgctaagagagggtagctgaggttgccagttagtgagacacgtgcagagactgagaatcaagagggaagggaatcatgtaaaaaaaaaaaaggagattttagtactattggaggtataaattctagtactcggttaggccgtggtaaagagaaaagatgtgaactgcaagtgaagccaaggtagaaagctcaattttgctcatttgccagagtgtccttcttacaccaaggtgaaaacagcataggatgtactctgtgaggtatttgttataggaatgggctgccaatgattgccaccaatctcttggtacccagcttgccttgtcatctgtaagcaatctgggtgggctgggagaatggggagaagcagactatgggcatgggatgaagaaagccactggcctgcaccaggaacgaggccttcactttccctcattaaccttagcattaatctctacataactaagttacctgatttagatgcttttacttggacctctggcatacaagtctttgtaacgcagttgtaaatcctcatagagtggggtgggagtaaacagattctggcataggatgcttcttgaaacactccttaatcatagtggatcactgtctcatcaggcctcactgtttatctcatggctttgagtcccactttggagcaatgaccgcacatctgccttgtctttcttcttgagctccagttccatttctctaattgcctactgggacactgtccatcaataccccaactcgataggccccaaactgaatccgtcatcttctcctctagtccagatctccctcccaactactctctctttcactggcagagtaaatttgttctcagtcatccaacttgcaaaccttctcagtgactttcatttagggtttattctcattccccaaacatagtcaatccccaagttctgtcatattttcttttgccatgccaggcatagttattttccacccctataactgccattccagcccagcctctcattatatttcagatctcaattaccccaaaccatccaattccataactatggtttctgctcctcaatccctgatgtgatggagaagcccagagttagatgcgaacgcaacagttttataataccacttacaattgttagataccgttctattggcctctgatagtttgtaactacggtccatactgttggtaaagacacatgggattagtcagcttaaatgagaaaataatataatttagaaactgactcatgttctttcttgatcccaatgaggcattcagggacgtgactgtcactctctgggcaaaaacaacatgtaccaagaggtgaagagagcaaaatagcaacaaaaataaatgagcccattgctgcagtccctgatgccctgtggtgagctgctagagtgaaaagttaatggaatgggagagggcaagataatgtgagcgccctggttgccttttccaagagcttttcaattccagagtaactgtgagcttcattgtgaatggtttacctgatcagtataattccctctcctttgtagataagaagactaagacagcaagaagttaaatgccttgctggcagccaggattagaacctgggattcctgaataaatgctttgaacttatgaggctgcttctgagagatcatagttacactgggcttcatagcaataaaaatgagcttttcccttccctcagaaatcctgttattatccatagttaggcaaagggaaactagaagaggatgctaaataaaagcacatctcaatgaactgaactatctttgccaggtgattatcagaaatatagataatgagcgtaagatacttaaaggggcaaggactctaatttagacacctcgggcaaaagaagtgaaaaagtttggaacaaagaaaaccactcaggacataacctaacaagatagaaaaaaatgaaatgcgaaagtattatcagctttaattaaaggaaatcaatatttgaagaggtgtcttgctcaacaatagaacaagggcaaacatacttcagaaatgtgagtctcttagaaaagagaaaagcaagttttcatggggaaacaaccacgattgaaaaacctttcaaaagatgacgacttggtgtatctgttggagaggggcctgaagcacctgttggggaggccgactagatgagcttttatccctgggagagtctgttttaagtgcattttttcagtcagggagtgttcaggagcctagaggcatctctagggagtaaagaatagccagtatttccctcagagagacttgaaacaaaccctcaacaataaagtgggtttcatctcagttatcacttacaagaacacacattggaaaacattaaggactatacaaatgcaacagatgtgttatttcagaggcactctgcaaccatccaagcaagcttgcttgagaatcctttctaagctcacgttttttgtgatgcacatgatgaccaaccttcagtgactggagtccaattctcccagaccattcctcttcagggatggaagatatgtgacatgtgtcaccacttccttctctcaaactggtgcaagacattaatactcaatcatgacacttctttccattgagcccaaatgcagctttttcatttatttgttcaatgaatacctcttgactgcccatttaaaagtgagttggagagacagataaataataaaatataagcaacactacgagcaccacatgctaagtgcctagtaaaagatatgtagacaataaatatcatagccaaacctgttctcttgaaatacaatttcaatttcctgggaccctgaaaattaattcttaaaatttcagtactattgtagttgtatcagcacaactatttttcagggatctgagatgaattaattccgaaaagagcttacaaaggagatgcagaagtttctatatgccacccatcaaaaaagtgagtcaggtgtgttttaagccacagggttcttctcccacaattagctttgaccaaacagcaaaactcagattggagtgggtctgattgccattttggtttaagtacactggataccatttcagcatcaaatcattcaatcagaaacactgaaaatgctgaagagttgggttagttgcaattttcccacctgaatagaatgtgcataatactgcaaattgttttttcacttttgtagtgctggagacatttatggaacctgtgggaaagggttttcttgacagatggagatggacagccaaccagacagaaggagagctagcactcattaacttttcccaacagaaactcacctgtaattgttttcacaggcctttaatgaggcttggttgtgaggcactagagagaggaaagcagcttatccatagaaaaggatagctactcaggtgaggtagaggaagcctggatccatagccttggaaattgtaggacataaggtttgagattacaattcaaagacaagatgaaagtgatgagggctgacaagtagtctagagatgggcaaatcaaaagaataactactggggtagatctgtttcggttatgtaagttaggaactctaaatcaaggagcacccacccccccccaccaatctcatatatccaaaattatatctatgtgtctttgaaacaggttggatttattcttgtaaatccctgggattgcgggatgtttcagtgaccagagttcttggcaggatcttaatctttaggtctttgccccaaagatctttgaagttcccagacagtctgcagctgcagtattttctctttatttttcatgggacccttctagaaactgcagtgtccttgatatcactgctttagatctccttctctctcaaagtttcagaattatggcatcttgcccaggcttatctaactgacctggattttggtggaggaatgaagactttttctgtcaatgttaggtaaacttttctataccacagtcattagtacatctacaaaattaagctccgaggatccaagccagccacaagttcttcttgatccccctttcagatacatttcatcactgttaatggatctgttatttgcacagaacaaacatttccagttacttgattaattttacccctattcttggtgcaatgccttccctgtgtgatttattcctgagaatgtttttgttttcatttccccaatatctgtacttgggggatttggcagtaggttagaggggcccttattcctatcttttaaaggattactgctccaggaccacctcccgctagagcaccagttgacaataatgaggctgccgctgccagctgatagctttccctgatgtcctactgtgtcctgcattgagcttaaacagggtcaattataatgtaaactatagaggaccctagtgcccaaggcgcagacatgggaatttagcagtgggggattttgctttatcaaaaaaaaaaaaaaaaaaagtgaatgaatgaacttagtgactcagcacttagtgatttagtgatgacttaaatgaccacctactctgagcccagtagtgtgcatgagacacatcaaaaacatcccttgtatctgaatgcttccagccaagtttcccactgcctactgcttaagtgaggggctaggaggaggaaggctcagtggccagtgaccagggtgcaagagtgacacagagcatattagcatattgcattctttgcatcaggctatgccaaacttctggaagagacaattttgaatttgtgaggaggatagccaggatggtccctggtctcaggtccctaaggaatcctttgccaggaagtcatcgaggacggatagaggcagcaccaaatgaattcttcagtccccactcagaatgtggccacattctggtgagtctgtgagtggtacggggtaatggtccctgcactgtgcaggaatcccagcacttcattccagtggatttctgccccctcctctgggatagaatgtgtgtccactctctccagagccatccactccagcagcagagccagagctcacatgggtatctcccacttctaagagctgcttttcataccccctagacgttttttgttttgttttattcttgagacggagtctcgcactgttgcccgggctggagtgcaatcgcacaattttggctcactgcaacctccacctcccgggttcaagctattctcctgcctcagcctcccaagtagctgggattacagacgcccgccaccatgccctgggtaattttttattttttatttttgtatttttagtagagatggggttttgctatgttggccaggctggtctcgaactcctgacctcgtgatccgcctgacttggcctcccaaagtgctgggattacaggcatgagccaccgcgcccagcctagacactgactcttaagtgcttggacagttgctatctctctgacttttcctgatcagcctttttccatgcccacacacatctttattacctttgcaatcaccaggaacccatcattatctcttgttccaatcatatccatgaagtcatttgaagctgatgggtgcatggcagaatatcttttgtgacccccagcccaccccacatataaatacagctacttgcagacatctattttggagatacttaaaaggttcataaatatctgaaaagatgtttgacattttctgagacaatattctttgccactggaaggttctattatacacattaaaagcaaagatacatatttttctttcttaccttcactttttataaaaggttatgctgacgtagaacttactaacaaaaaaaaaaaaatcttcctgatgaaatcaggataaataattccacacatcttcaagtggagagaaaggctttgaattggtttccatggaaatctgaagatgaagtaaaggaataatttcaaggcagagcagctgaactgaagataatggtaaaatagtttgataaaggaaatagaataaagtaatcaagaagactccaatcaattattcctttttgtttacctttaggtgattaattcgtctgcgtttattaacctgatgagattaagcaggccttccttgtgatttatttcgtaattgtttccaaggtttgacataagctgtggagttattgaaggtggagatttaaattcaattactatgaagcaggtggtgattctcctgaaagaatatctgaattcacggacttcccatgtaacattatgagtgaaaattattaattcatctgatagtatctcccaaagacttttagaagtcatttggcatccacatacttcaccaaaagtcagcagcttcagaactgaacatgtaatgaagagaattcagtgcctggaaagaaaggattttattttaaagactagttatttttatacttttttttttaaaactagaggcccccttggggcctgggctgtggtgctatcattgatggaatccatgagctcaagctttgaatgccaaaaggatagctttctttgaacttgaccagtggttcccactctctacctttaaagggcacaactggataagatcatactttgacaggagagagagagagagagagagattggccagggggtggtggggggatatgcaggctggccttgagagtctttaaatgaagtgactaattgctttttgtctctgtggtccttgttgtgtatatgttttctattctttctgtgggtatagtaaggataaacggggttctccaaacactaacgcaggcgccaactctccgtcatccacaaagacccggaacacatctaagagtgggaagtaagtgaaaaagtgctcctgtacatctgacatagctgtcaaaaagtcaagtgctgtcctccttttgtcatttattcatattcattcaacaaagatttgtggaatgtcttctgtgtgcctcccactgggctcgtcactggggaattgaaacgagcaaggcatgtgtcagtaatattgggtgcatgaagaactagggaagagggaggagagggatggaaaagtcaggagatgactctggaaagatagcttagggctgactgtgaagggcaaggacataagtccataagggcaatgtaagagttggattacaagttttaagaattaaagcagcagcagcagcagcactgatttatgacttacaaagtccatgaaaacctgtcctgatccatacactgagtttaggcttgagttagaagaatctggtaagcttttccataaatttcctggtttaagtacatttatgttttaaccatatcactgatttatatgatatgtatattcttttcctagtaactaatatgcaccaagtcctacatgaagctgtttttttggtattaccaaaacttgtatgggctgaatatttgcgatattagattgaccttttctgggcttattccagaagacaacaccagccgatctctccctttggcttcagcaaagtgtggcaaactcaggcagtgtgatcccacgcagatgacatacctctaattagacacttccccttggaagttgcttcaaccctgtggtgaatggctcgagttctccgtaagctctctctccagggtgtggggcattgtgacacgcagaaactcagtccagaaagagcacccagcctgcatctaggagaaaatgaaagataccttcatcatgctaaaagctctaatctagcaataagatatgtcactacaagagcacagctttgcaatgaaaggtgaatttgtaatggtcatatattttatgtattcagcattggaccgtaaatgctgcactttgaatatgatcttatattcaattcccaaagtgaaagatctactggctgcctttttttccttcttttcctctgaataccatttcaggtttgcatataaagttgaatgcgggttatcttgcaaaatataaaaaacggtgttaaagacataaaactaaatctccaagcagttagaactcatttcagttatttattgctgagcaccataatcaaaatgctgtataaattatgaaggaagggaattgatgcacacattcccaggcagctgaatgttttcaaattagtcccaattcattgttaacacgcactcttagttaacagggatggcattgcagaacttcttttaactccatgcttacaacaatggcagaccctacctgggcaccctgtacctacctgtcacaccaaaaaccacagggcacaatctccatttattagtccctgatgtataattatggatgtttgtgatttgctgttgcctttccaaaggggccttcccttgtttcttttggctttgcaggagttcactgtcttactttttgagtgaagaatctccatttgagctacaaaaggagcaattggtagaatctgagttaagatgacatagagaatgcatacctaataccatacccaggttttcaacagtgggagggctgaataaatacattcttaaggagataaaaaatgatctatatctcacttgccatacttggtcacatcccaagcttctgccatggtgaagggtctctctctttgcacattttgagataggtaacttttacttgacatgtatagtgactcatagactgagctagttctgaattcttcattgtttttattggttgttagtgaaaaattacaagttctccgacatcctcttcctagatatgtgtgccagggtttcttgcactgttctcctcctcttagtcctctcccatcagttttcaggagatttttctttttttccattagtgtacattttctccttcttgggatatcattttcaacaggagcagtactgaccttctgtgcatatggtgagactatgaagggcatttttcacactttatagaacagtgcctatggatgtttaggcactgtgttctagttcagagagagttgtgattgccagttcctgctgcactgtctatgcatttccttagctttggtgtgtgtggtggtgaggaggggataggtagatgtctccaccccaaggcttttccccatggtgtattttctttcacaacaaccagcccagaggatgccatgttctgatgttatttgacctaatgacaataggatatagagcagtttttaagaatttccctatgttattttgaggccagacacaggctgggagatagaaggagggttctttccttctctgaaaagaaattcagtcttctctgtttttgaagaaaacaaaaaagcaaaagtcaagctgccccaaatatgcatcatggctaaaaataaggaatatgtgttgactgagtgttacgggccaacctgtgtcccaagcacttggtacattttgtctcattaatccttgcctaccaaaagctcatgaaacaggcactattatttctattgcacacatgaggaaattgaggctccaagaggataatgatatgcccacctgaggtatccaaatgaacaattttggtaaaaaaccttctttggcaccaatgataataatagtagtagtaattaaaatatattaagcatttactttgtgccattgcactagactctggggccatataaatataaaatactataggtgcccccaagcagttcacagtcttagtagggaggacagaggatgacaacgtggtatttaagtgctacaatccctagctgatgccagggttggggtgggaaataggtcatatggggatatcaataaaggctcctgagaagcaatccctgagctctttaattttatccatttacccttcatgtagcaaggttaggtcagagaaagaaaatgcaagtcggtcactccagaggggcagaatcctctgtgtcttggtcagaacacgttggagttgtggattaggtcaaagctaaaatgaaatgtctaattccacctttttccaactttcaatccatttggagcctactgagattcagtgtagcatgctgagtcgcttaggaaacctacagcttgaatgttgcgtcagttctggttgctctatttcattgcctggatgtgaagctgggtagccagccctctgtttcagggaggaacagatggaatgggatatgtctgagcagcagagccagactaccctggaaatgactttcagggaggtgcaagcagtttcttctatgccaacagtgagccaaattgacaagacagaaaaaaaaaaaacttcagtgcagaactgtgtcactgagatcaggaagcataggttttgcagaggttgacccatgaccaatcaggccagaccactgcatttagcctcacatatggttccctttggtaatgtgaacctgttattctggccaacacagcagaacacagtcaatccatttgctgacccattggattatccccagaaagcaagtaactgtcaaagctgggcatgtgtagtagccaccaagagcctttataatgttcatttggtattggaacattttcatactttacatgagaccaattattttgctgaacacaaggacactgagactcaagaaaggtaagtcactttccatgaggcacacacctagctactagcagagggcagcctagacacctggtcttctcatacttgtcccatgatctttccactgcaatgtatgctacagttcttctcccagagagcaagatacttcagctaattgcaccaagggaggccaggagccagatctcaggatgtccagccaggtgctcttccctctttttgtgtgggctctgccagctactgtgaaaatggagactttttggaaaaattagaatcatcctacttttaaaaaaatgtagcagtagcggtgatgaaaggaaaaagcatgtacttctcaactgcttcattttttcttctaaaataatggtatctctggttctatttggacagctacctttcctcaacagtattgttgagccatctcaagcctctaatctactccatcaatgaagcaatagagaactcatatatcactatagctattctctctcgaatcagccaaccaaagctaaggagatgtagattagataggtagatagacaaacagacacacatatatctacatctacgtatgacattcagaggcatccacttaaaaattaaattgcccaaagttgagatgatgatggaactcgatcactcctctcagtctgagatgtttttcacataggctcaggctagggaataacaaggaccaagtccagttttcaagtactagtgaaggccacaaatatggggccagggcagagcaaccaagcacagtgcctggcaaacaatactataaatgttgaattaagcactataagtgatgggttaaatgaattaagctaggggaaggagggatattaaaatggagaaaaagaaggtgtacagaaggggaatatgagatgatcaagtcaaaccctgcttactccacaaatctacttggagctgactctggtaagaccggctctaacctgcctttgccggaagtaccttatagtgaacaaacctgtttatctattcagtagtatccagataagagtagtcaagagcacatagcttcataaataaacataccagcacccctttgcttttggctggcaggagtcaaatgaaaaacttttcagctttagaaaaataaagtgaaggctgggcgtggtggctcacacctgtaatcccagcactttgggaggccgaggtgggcggaccatgaggtcaggagatcaagaccaccctgtctaacacagtgaaaccccatctctacaaaaatacaaaaaattagctgggcatggtggcacacgcctgtagtcccagctactcgggaggctgaggcaggtgaatcatttgaacccaggaggcagaggttgcagtgagctgagattgcaccactgcattctagcctgggtgacagagtgagactccgtctcaaaaaaaagaaaagaaaaaaatgaaagataaaatgaagtcttgcttgctctgtttggactcagcatggtgcattttcatgtttgacttcagctgtttctatgtccattgctggcaccagagtcctgcatattatatcgtgattatgttttttcctctaattgagacccatgtattttttctaagacattgggttgtgactgttgctaacccccactaattttgccactgtgtgtgtatgaaagtatgtgtgtgtatgaaagtatgtgtgtgtgagtgttctcttcaaaatggttgtatgttgcatgaagatagcaatccactggccaagtatttgactttgccagtaattgctgtagttttatgtgatgataatgtcaatagttccttagtttagctactagactaagtctaatatcacaaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggttgtctgcttttgccagttactgaaatgtggaagcaaaagccccagcaccataataacaatataacataataacataacataaacagtgcccatagattagatgctacaagaaatgagtaacagatccaggaagaaagagtccagccatggaaatgtttcttagcaagttcacctgcatctctgtgatggttaggatatacagtacacttcgtgacataataaatccacccccccaacccaacatatatgactttccatgctggtcatgcttctatagcttagtcaagaagagtgttctgttaatcaagccttgaaaagcaggaaccatttttctctcccttcaactgccatacaaaaatcagggaggcaatgtgctgctgctctctagaacaggggtcctcagtgactctttttctacctctgtgtcatacatggttgagaattctcacttatattgctctagcagagctcagggttctgtccagttcccaggcactgtctggaattccactcttctctctccctattgggaaagactaggaatgcaaggaagagtgatgttaaacagtatgctatttttttccacgtaataaaaagcaaatctctctctctctctctccttctctttcacttttccctccttccttccctcatctgtttgttcattgatctattaattcttccaccccatttttctggctctcaactgagctttctttgaactaccttggcaactttcttgaagatcatttgtccatatgtatttgggtctatatctggactcagtgttattccattgattgatatgtttatcgttatgccagcaccacactgtcttgattactatagctttatactagtattgcaattagatgttgtgagctctccaacttcattcttttttctttcttttttttgagataagactgtcaacccaggctggagtacagtggtgcaatcatggcccacttcaacctcccaagtaactgatacgactggcacatgccaccatgcctggctaatttttttgtagagatggggtctcactatgttgcccaggctggtctcaaacaatcctcctgccttggcctcctaaagtggtgggattacaggtgtgagccaatgcacccaaccattcttcctttataacttgttttggatgttgtacgtcctttccatttccatatgaattttagaatcggtctataaatttttgcaaaaagaaaaaagaagcctgctgggattttggcaaggattgccttgaatctgtatatcaaatttggagaaaactgacatcttaacaatattgagttaccatgaactcagggtatctatccatttatttgggttttttaaatttcactcatcagtgttttatagttttcaggatacacgcttttcctattttttttgtcagatatatccctaaatatttcacacttttggtgctatggtaaatagtattgttttatttcaatttctgattatttctaatagataacagaagtataattgatttttgtagattaatcttgtattctgcaaaacttactaagttttaggagcttttttttttttggtagattccactggatattcattggatattcaacatagatgattgttatctgtgactaaagacagatttattcttccttttcaatatggatgtctttttcttcttgccttattgcactggttaaagcctttagtacagtgttgaatagtgatatggttaggctatgtgtccccacccaaatctcatcttgaattataatccccataatccccatgtgtcaagggagagaaaaggtggaagtaattgaatcatgggggcggtttcctcgtgctgttcttgtgatagtgagttctcacaacaactgatggttttataaggggctcttacctcttcgatcagcacttcttcctccagccacgttgtgaataaggtgccttgcttccccttcaccttagaccatgattgtaagtttcctgagtcctctccagccatacagaactgtgagtagtcaattaaacctctttcctttctaaattactcagtctttggaagttctttatggcagtgtgagaacggactaatacaaatagctatgagttttttggtgtgtaaataatttctacccacttaagtctggaaaaagacacatacaataatggagagatagttgaacaatggaagcgtcctccgaagatgctattttgggaacaaatggttgatccctgcctttattgcatgtccaaagctagattcccatagcactgcacagatatatttcatcagagaaaagtagatcctattcatggggaggagggggaggtggaggagaaaaagtgaaaaacaagaagaaaaataaaccctaaagttcatagaatcatatatacttttctcattattctcattctttcattcatgttctctctctctctctcttctttgaaagaggtagtatagtataatggttaagacagcaaatgctggagcctaattactgccttaaaagcctagcattgccctcggaaggttaccggctctccctctgcatcagtttcttcacttataagaagaaactattagtagtgcatgcttcatagggttttcttgaggattaaattctttattcattcaaaaattttactgagtgcatagtaggtacaagatgctactctaggctctggggatacagcagagaacaaaacaggcaaaattccctgtccttatgcccattataatagagggatacagtcattaaacaagtaaaagacgtattattttaaaagggaataagtcataatttggaaaaagcaggggagaggtataaggaatcgtggaggcaagaaacttgtaaatttaaagtagttgagggaaacatcactaaaggtgacatttgaggaagggtttgatttatattaagtcagttaatgcatgtaaagaaatgggaatagttctttacatacagcaaaaatatagtacttttatgaattataatttattgagtactttctgtgtgtccaacactgtgcgagatgctttacatattatcttgtttaattattataataggcctataaagtaagggttattagccctttctactgaggaggaatctcaagacattggcttgtccaaagtcacatagtaggtgatagggccaatactcagatcacatctgagcttgtctcacgaggctaagttcatctaccccttctgaagacatcctgcatgcttagggactatattagactagactttgattcacaaatattagaagactggtcctgctgctggaggcctcagatgggataggattatgtagctaaaagcttctacaagggctgtggggagtggtgaaatatcaccttatctttagtatttcaacttgagaataagggcaatattgcctggcactccaataccagcacctggctctgacactttcactactatgtatgttgtgggcaagcaacctaagaatgggaagtggggaggacagaaataaaacaacgttactgggcaatagctattactccattacaaaagatgatttgggttttcaggatggtcgcttgctgaagtttaaacgaaaaaagaaaaatgaggctggactcagctcactgatgactgaactataaattttgcttggaaaatgctggcaatgctataaaattcaggccaccatctgttagtgcttgcttaaagtagcatttgcactggataattaagatgtcacatgcatttgaagcacaaatcatcagtgcatgggtgcctagcatccctggaaagattgtggatggtgaagatgttctgagaggaatatcatgttgcttgaaggatacatttatatgaaatcacaggagctagtgttttggatcacctgagtggggttgagtagaggaggagatgaggacactgagaaaactgctttcttgagttgactggatcatttaatcaaaatgatcaactggctaggcccatgcagtatggcaggcgtaataatatgtttggccatcactgtctgcaaagctcatagtgaattcagggatataaggaagaagggaggcaagtctggctaagcctaaaattcctaattaaaaaagaatttgcttgtaaagcactttataatttgcaaacagccttctcttttgttatttcatttaattaattttacccaccatcctaggaagcaggaattatatctacatcttacagactggaaaactaaggctgagggaaatagcatatttttgcccaaagccacatagatagtaagtggtagaaccatgattcaaaacagggcccttttaactctaaatcctaaagtattttttggccaaagcacaacgtgctctgatattagagtcaaataattttacatacctgaccaaaaaaaaagaaaaagaaaaaaaccatattttacaactttacaggcaggtagagaaacttacagacttcaattccaacaaagatgccagagactgccaaatatagcaagggcctggaatttttaaataataagaaataacatttattgagtgcttcctatgcaccaggccctgttcggagtgctttaaatgcatgcattatttcatttaatcctgagaactactccatgacgttgattcagggagagttcatcagtagcttagatggtgttgcccatacccaaatattgaaggttctctttggggtgatgtctgggtactttcagcagacacagcatggctggattgtggagctgagccaaggtaatgattctcccagctttggagtctaaagagtttcgctgttttggcatcaaagaccataattaatggaattaagaaggctgggcttgcttccaagtggctcttcaagagtgtccttctttctcatcatggttggggaggagatttgtgctccacgggctttaatgagatgttctgtacccaacgtctgcatgtttatcttcacttccccaatacgtgcctatggacccttcaaggatgatcaagctattttgtgccttcaccctaggcaccagggtatgttgttcagttgtgatatttgtcagaaaaatcttaggttggtgcaaaagtaattgcagtttttgccattacttttaatggcaaacaccacaattacttttgcaccaacctaatagtatgctgccactgcccactctcctagtactgctcccccttcttctgtgaaatgcaggtaatcattctcatcactcctcctggcatcaccaggaggatatgaaaacaagcaatataatgtctccaaagaccttacaaaaaataaataattacaaaaacatacttcatggtggttttcagtaactttggggggaaaaaatgcatctccatataagtaaagttgacagactcttacccctttccctgagaatgtcttcttgccatctatgtgccaggtttgcagaggttgccccttttctcccacagatcgttatgtcctttcccaaccacatgcctagtgtctcaccgactattcatttctcacttgccctccattggcagccatattttcaggggctaactacacatacccagctttgtcctaaaaacacacaccaagtctggaggccacgagtttccttacctgattatctgggtttctattcccccacttggtggtgaggaaacacatgcataatgttgttatttttttctgcttgcttgtaatttgggaggcagtgcgaccattcattactgaatgcctacaatggacaaggcatttgtgttagtcaacaggaataccaaggaaaaggcatattgtccctctcccctgcaaatgcctcctggtggggaatctctgcctgctgtagccattcttcattccaattctggcttctagcagatgaaaaaggacgaaaagaggtataaagaagccacccaggccattgagcctgagttcatagagccattgtgatgcacttaccatgtccttcctctgtgtagaccagtggttttcagtctatgttctgtacagcccttgggttctgagggaggacctcaaagcctgccatgagtgaaagtgatggggtagtctggagtggtaaatagatggggctccaggccctcactctacctcttcctgagtgactccattttaatctgttttacatattgggatctgcctagatttcattttttaaagccctgctgctgctagaatggaaaaccaaaaaccatatgttcacacttatacatgggagctaaactatgagtttgcaaaggcatacagagcaatataatggaccttgagactcaagaggccagggataaaaatctacacattagatacaatgtacactgcttgggtgatgggtgcactaaaatctcagaattcaccactgtgtaattcatccatataacacaaaactacttgtactccaaaagctattgaaataaaaataaataaataaaaataaaaaatacaaaagccccgttgctaagaaggaactgataactaccagtgtagacccagccagagaatactcagggagcaaggtttttattggaaaaccgcctttatccaccatgcctcagctccccagtgacaggcaaagcagttctggctattggacaatctcacagtcccctttctcaattctgcaagcttttttaaaaaaagaagaaaaaaagaaatgcttcctttcatatggccaaattgctctgaacagatgaaagggaccagactgacaggtgattgttccctaagattacagcctacacccaggctgaatctgaaacacttggaggaaaaaaaaatgctacaggttttgagtaatgctccccgactggcatctgctctcaagactaaatgaacacacactatttccactccatttccttaaactggcctctgtgctaggctgtaatgaaacctgtaggggaagaaagaccatttgcttggggaaaggattattttagttgcttaagccatcctctcccaaaaaataggcggatggttaggctggagtctttgtttttaatttaaatgtcattaggaggtccatgagttttcctcatatttattgtatgctatacatacacattgtagctattttatataaccctataaacaatttttaaaataaattttaaattgtctctttatattatattcactaacaaattcaaccttatcaccaacaatataatgttatcatcaggcccaaccttcatccccttcgttatactggtcttcttcttgtctataaaatgtctgcttttccataccattgcacctatcttgaataacctgtgtccttcaactacccatgtccaaacactagttcattgaaaagagctcattctttcaaaatagataagatatgtatttctatcccagctctagtaccttggacaagttaatctctttgagcctcagttttctcatttgtaaaatggggagaataactggaccttcctctctgctagaaattccttgaatgttcactgagatgacttaggcagatcttctggtacatactggtactcattaaatggaatcgttgttattacttatatttcaagacaattactgtgccccttactccatcatgtctcccttgatgcaacctgagggcatctctccctcctctgaacagcatctatttagcattgaaccagacactaagatgtgccattcatttgtttattaattcaatgagcaactatttattgtgcatttagaatgtgataggcacattaccagatgctggggcagggtgggcatagagaggtggatgtgaaagaaggaggagagaaggtggagacagcagggctgaaacagatactgctcttaagcacctaattttctagtaaagaagatattcatatacaaaaataactagaatacaaggaacaaagctatgtgctttgtaagaaaggtgcagctggagactcggctggaggactgtctccactggaagaaaaagttctggaaatgtcaactgtcttctttcttgttaactttccctttgtttgcttatctctccagcaaagttctggctgtggctccttgaggaagagtgggagtacttctttatcttccacagagcctaccaaagtacaaaatgagctctcagtgtatgcgctgatgtgagtaaagtatctgcagtatctgtagtaaagtacctgcaaagtatctgcagtaaacagaataggtatacaacacatgccagaaaagaccacctattctcttattccatcttatagcatctcataaaaagtgcatgcactgcaactcgatatgtgaaaaagttctaaaaaaaatggatacataaagaagtattcttcctccttgaactttaaagattcttgagcttattttaaacaaagagcattttgttgaggattttggtattgagccaactatagtacacattgcatttccctgaacctcatgatgttacagagaggggctaggagcacttctggggtacacttaccctacaggcacttctatttgaacctactgcttgtccctgcctttctgaatctgagaaattatacctgagagtactttttaaaaaccagttgattgaagtatgattgacatataaaaagctgcatacatttaatatttatttatatttaatgtatatatctcattgagttttggaggtaaatatacatctatgaaatcatcaccatcattaaggacataaatatatctatcatgccctaaaggtttcctcctgccccatgattattattgttttgttttttgataagaacacttacaacataagatctaccctgttagcaaattttacatataaaatcaagtattgttagccataggcactatgctgtgtagtagattcccagaacttatttatcttgtgtaattgaaagtttgtaccctttaaccatcaccacccccttgcccagcccctggtagctaccattctcctttctgcttctatgagtttgacctgattgtgcttttgatggatgttagaactatcttccttgacctggcttcagccatataagactgctgcagtgtctgttgaaagttgcatcccctaccccatctcagcacaacattctcctcctcctgttcatcttcatccctctttcaacccacagtagtcctttcattaacagagttgcttattcagtagtgcacagttcttttaaggcagattccaatgacttagggtttgtcctaattgactaagctggatgcaaaaaaccctgagagtcaaatgactgtggacatctgtccccatacctaaccctaagcaactctgacaccttgagaaagtcacctagcctctctgaatctgttttctctgctgttaaatgatggggctggctttgctgactaaagtacaaacaaatcgtgagacaagcccccgtcaccactatcaacacaaataatggagctagaaacacgagatcctttccaggtaatttaatactgctgcattttaaaagtcgtgggccgagaagatgagttttaaaaggagggaaaaagtaattcacatctcccaagatagtgtttataatggtctattaagaacacattgaaaagaaatggactaattctgtagtgttttacccaggacagcaggccagttcagtcaaagtgttttttgaatagggctataagcaaatctctttcggtgaaacctagagctgctttgcagaaagcagaaaagtggagttttcccctaatactttaaaaaatggtcacttcaccattgccaaacttcattaccactcccaggagctaaagcttcgagattaatgatcctcatcttaaagagaaggcagtgaccgctaaaagaaaaaaagaaattacaagcacatggtatttactgttctgcattctttgagaattaatgtcagtaatactgttgcaacatttttcaaaataaaggatggcgttttctaattgtctagttaaaaaaaaaatctaagtctgaatccccagagaagaaacctgagtttaaatcattaacaccacaaatctctgataattgtggcatgtttgcaagtgccttaatcaggatggtatgtcttagtggcctgttttaatttgatcacactgattaagcttctgtaagctaatatacgttgcatttccaattcaattaaatgagaatctcctggccttactagatattaccaaaatgccctgatgggtgaacactagacttggtattttcaattgctaccgactttctgattatataatctttgtattaaatgaaatcgatgaaagctcaaattaaattcagcaaactttaaggagtaaatatgttttccctgtatttttggcatactttcacctcaaggtgtggagcatgttagtcggaactcattgattacctttagtgataaattttatagggctctctcccccgtataccaattcctagaacagtctatcctgttagaaggcactgtaaatgtgggtgatgaataggcactctctctattatatatgtattatagttgtgcctttttcagctgtagataagagctatcttatgtaaatgtgattgctttgtaaatgtaaatgcctattgggtcatcgatcatcttggagatagaagaaacagaacaatagggggaggtgtgagagaaactgtctagggacagaaatgaagaaaattgctaagtgggtaacagattgaatcattagagctggagaactttgtggaggtggctaggatggaaacagcagccgcgaaactactggaagcctggcttgtgcctgcagagccctccaaaaggcttgcttccttgaggttctgaggactgactgctaaatgagaaatgggcctcttcagtgtaggtttgaagcaggaaggaactgaaaagaaaagcccaacttcattgttaggtgagcactgtgggtgcctgtcgtttgcctgcgcataacaggtttggaatctctcaaatccttcccactctcaacaacccacacaagttgtgagagtactacctaaaaacagccccttggtgtgccagtcatatgccaccccctggaggaggagggtactgaataatacctactgctgctgattcccatgccctagcagttctctcaattttttgggtggtatcaggaggcaggcaggcccagcagtgaactcaggaaccatcagggtgaaagtgcctctggaattttctcacaatctgttaggccctttttatggagtctggttttcaaaacctgctataagccaaatgtgtgactcacagagtaataaaggcctctaaatcaatttgtaagacatcttgaagttaaacaagaaggaaaggctgtttttgccccacatatttttttagatcctgcctacttccacaaaggatttgagatgacttccaaagcctttcttactcatgcctaagagtatttaagaactatttctgaaagttgaatccatgtgtaccatataaatagaggagaatgattatatggaaacacaaacagattggggctctctcactttatacaatagatcaactctggggaagtggttaaatgagggaagtatttggggcacttgctccagtcttcccttggttgtccttttacttccttctcccagcatctgcactctccaagtattgcctgcccttccaagcaaaacttccctgtcttgtattccatacctgcaaggaactttatttactttctaataaactctgctaataaatatgaaatagtgagtactagaggcttaatacatatgttagttgttctaatgttcaaaggaattcctacaatggtaggagagaaatttgaggccagaaataatgccattaagcatttatcccagctgggcatggtggctcacgcctgaactccaacactttgggaggccaaggtgggaggataatttgagaccaggagttcaagacaagcctgggcaacatagtgagacccctatctctaaaaaaaattgttttaaattagtcaggtgtggtgacatgtgcctgtagtcatagccacttgggaagctaagatgcaagaatcaggagtttgagtctgcagtgagctatggtcacaccactgcactccagcctgggcgatagagtgagacctcatctcttaaaacaaaacaaaaaagaagagagagagagagagagagagagagagagatccctcctatggatttaataatcatatcctgcattggggcaggggtgggttgaggtggaaaagggggtgtgaaagccatattatagagatgggcaccaagaccgagttttaaggaaagaaaaagaggccaagaaggatcactgaggaccccaaaggcaaacttggctgccttagaattttgctggggctgaggactctctggtttaaaaataaatatgaaagcaaagatattaaaggcaaagcacaaggatttacagagaaaatgagcagactgatttttagttgaaagatgtccacaatttatcactaagttattggtccaagctcatattccatcctatcactgttctcctgcacagtgacctccatactctaagcaaaccaaacttcctgagccgcacattgccaccccataccttggctcatactgttctctccagacacatttcctgctctacctctttgtccaaataggactgacttctcaagacttcattcctcctgatgttcaacagctgaagcagccataccttcctctgaacctccggaatgggttttctggacttctcttaggggacgctgttcatctggctttatcatgtatattcatgtccaagtcttctcttcccttcaaggctgcagacatcttggaaggagggcaagtcctctttatatctttactcctctcttcccatggactgagctggcccagaatcttgaaaaatagccaaccactgataaatgctttctagttaagagttcagactctggagtcaggaagttctggcagcaagcctcagcttgtgtttattacttcacctctctaagtcttggtttcctcatctgtaatcacctacttcggagttgtgttttttttttttttttagatagagtctcgctctgtcacccaggctggagtgcagtggcatgatctaggcttactgcaacctccgcctcctgggttcaagagattctcctgcctcagcctcccaagtagctgggattacaggtggccgccactgcgcccagctaatttttgtatttttagtagacacaaggtttcaccatattggccaggctggtctcgaactcctgacctcaggtgatccacctgcttcagcctctcaaaatactgggattacaggcgtgagccaccatgcccagcctggagttgtgatttttcaatgagataacccatgtagaatgcttagcatggtgcaagacacatggtatacattccacaattatttgttattgataccatttttcccttaaggaaaggtgcagtcttctctggctccctgtggcaataatccaactgagccattattccagaaggaaatcacattagggggcttttgggcaagggtttgctaaatgccctgactcacactatgtctacagtgacatttaccccatcaaaatgcagggaaagacaggaactggtttcaacttgaattcgatatttctgtggcccacatgctgaatgccaccaaagcctccactcccagagcagcagtttgtagagatggaatagtggcagtttttcattttccagagtccactcatccttccaagaatctcaatgcctcattgattcataatacagtgcataaagatttcatttttcctgcccacagtgatacattatggaggcaatctgttttgccactgaaaagtttgcttagtagaaaaatttggagttttgacattcaggaaattacagtcatctgtaaaacacgattgatatgccgaggctaacattttcattgcacttgcagagccagaataactatgataaaatatgtgttaccccacacacatttcaggatcttttagaaacattagctctgagaacctcctcccagggctccaggactagaatagctatccccattagttgtttgtttgccactcacaaggataatatctccattgacccaaccaagaatcagactgtaagacaaagtgatggctttcccgtaccaccaggttaaaggcatgaaagaaagtaaaaagatagagagataaagaattccaccccgttttggaattgttaaccagccacaaaaagcgcaggtataggttaggtagaactagaagctgaaggcttacaaaagagaaattagactgttctacatctgcctacaatttaaacttgttctctgtatttttacacccaaccttttttttttttttttttgtctctttccacatgcaattttcagtgttaaatgacatcaaaagcctagggctccggaactatccacttgttcaaaatttgatttcagaatgataaatacagttgttttagctgagagatgtagttgatttccactggcatactgagaaagtggtccattcagggtcagatttggccaggttgtgagcacttttcacttggtcctcatgcactgggacccacgggaagtgcacaaagtctgtggttccaaggcaaatgacaggtaccactgcttttgactttggaagtggcttagagtgaaccccattcagctctgggacagcttcttcaggcactgagaacacattctgcccaaagtgtgtaagtctgactcatgaatcaagcagtttttagaggtgtcattgaagtcctgcatgcaaccctatgcaaacaattattgccagtgcttactgaccttatattatgtgtcaaacacaattctaagtattaattcatttagttattacagccactctatgaggcaagtgatagaattatcatcttcactttatgaagaaactgaagcacagagtctgagcatctctcccaaagtcacactgctatctcataagaggtagagctggattcaaatcctcaacagaatggctgcagagctcatgctcatgatctatattatattgccttgcataaagaaattttataaaagccctctgttgtcagacatgctgcctggattatctcacaagtgccccatgcccatggtaggaaggctttcttgtcctcctaaaacacttggccaaacttcactctcctcctgtcccatggttaagcctcttgcatccaacaacttggcttcattcatttcctaccagtgtttgcacagatgctagaggagcaagaataaagccaatgggtatagggaggagaggagatggatgccaaagacacacttgggcaaagaccatgcctgcctaggagttttgggactctccagcaggggaataaggggaaaagtgatttcccagaggcatgttgaggattcacttgcttgtccccaggctgaagctttgggggtacccatattcagctttctctcctgctgctcacctctgggccttatttcagctgatctggccactgacaagggaaactaagagacagtggagcaaagaggactcatcagaatacaatgaggggacatagaggctggaggggtggagaagatagagggggagaaaggggagttatggcgtcaggacaggaaaaaaagatgaagagagaatggcaaaacaaccaggaggaggaggaagtcactgaaaaagaagaggggatgcacacagcatgaggtgggatgtggagaagactgagagaggaaggaaactgaggggaaaggctgatggagatgttctctctcctcacttctgtgatctcagtcctgtccatatgggcagtctgatatggtttggctgtgtccccactcaaatctcatcttgaattgtagctcccaaaatccccatacgtcgtgggagggacccagcagcaggtaattgaatcacaggggtgggttttccatgctgttcttgtgatagtgaataaatctcacaagatctgatggttttataaagggcagtccccctgcacacactgtcttgcctgctgccatggaaaacatgcctttgctcctcctttgccttccgccatgactgtgaggcctcctcagacatgtggaactgtgagtccattaaacctcttttctttataaattacccagtctcgggtatgtctttatcagcagcatgggaatggactaatacactctcctcaccaccagtagtcttccttgactgcctgctgggcaccactgaaaggctcttacgttgcacggtgttccaactagatggccttgctcttttccttctgtgagctccaggtacacttagagatgaggcctgtcttcttgtcctgaatttggacacatgacttttttttttttttttttttttaagagacagggtcttgctctgttattcagactagagtgcagagctgctatcatggctcactgcagcctcaacctcctgggctcaagtggtcctcccacttcagcgtcccaagtatcagggactacaggcacatgccaccacacctagcaggagggatatcttagaggtcatttagtccctcccccatgcaaatgaccaataagtcttcattgcttttgaccccgtactccttatctcctatcatcccctacgcacaggaggcagattcttaaaccaaaggaataaactttacattgtggattgctggccaactgtgttggggaggggctgtgcttcccagcactcctgaacttatgccaccccacaaggctggccctggttgcctgtcccattatggtgttgtagaaagctctccgctgtcatgcaaattaccttttaaaataaaatgaacaaagtggcatggggtagaaaaatgagtctggatatctagacttgggtttaaaacatatgtaacttgatgacttactggctgtgtgacctttcacctctctgtgcactaatatcagtgtctatgaaatggactggaactgtctatttctcagtcatggtgtaaggctctatgaagaagaagatgtgttttgttaaaaataaatatatatttgctataaagaactttttagaagtagaagagaaagagggtgctattcctttcaaaagatttggaataatagctctttaatccttgaaaatgaactgagaaatataaatacttatgattatttaaaaacctcaaaggtgacctgctcatcacctgaactgtgcttggtatgctgaaatgcagcaatgccagtctcccaaaaatgtacctgcccatatttcaactgtcagcacattctttccaccacgtagaaggtgaaggtcgacatgttctccctgcgtgcatttctagtaacaccttaactcatgaatgttaaatggaaggaggtgggataggggaacaacaggacttcaaaaatagccttggggaaatcaaatcttgctttaacttagtgtgttcatgaccgattcatggctctgaaaaggaaaaagtgtttgatcaaaactgtcaccaaaagacctcattttaaattcctctactttctttgagcagaaaggaataggtatcctgattatgactattgaagcaggctttacctgtgcataatagctggtctcctatattctgtgatttttggatggcctcctgccccatagaacttgccctactgctgcctgaaattctaccataagagggcatagcattgccccttaggggctgcccctttaaaatggaaatgcttctggtggtgctaagtacatgacactttgacaaaatgagtttttctaatgactttccttctaggtctcagattttgaacagactaagcccagagagagagtccagtgggggaaaggctggaagaagggggaggtgtaggaggaggaatggagaagcttggagggccgaggtctcccagctacaacaaaggaccaaagaaatagtaactaaggatgggatttcaggcctcagtggggtacatttggaggagaaggggcctcctttacccttacaagttgtattgtgggtgcagcagtctctcctgactggggaaatgccaacctggggacctgaggcactgcaccagccagaggtggagtcactttgggactcgtttcagggcctgtgtagtttaggggacaatgccctttgtttctgattggtgggaggaggaactgatgtgcagtgggatgggagaggataaaatggagcatcctgggtgatttcaaggcttcatgctagaaggctcatcaattaacccaccagtctgagttcccataaggtgctgggccctgtgttgagagacaggagagatatcaaatagtttggctcttaaggaatgtctagcctggtttgcaagacaaaataagagaaatggagtatgcagccatttatttgaggcttaatgtgcaacagagaaaacatgggggaaacactgaattgggagttaggaaacctgggttctggtcctagacccactgctgaccaactatatatccttgggaaagttgcctcctttgtttgaggttcagtttccttagctgcaaaatgggaattttatatcttgtcctgtatacttcataggattgagtgagaaactaactttataaaaacagtggaaaccttttcaaatttctcattgtgattaatcagccctccctccctcactcctatcttcccactttccctttttctgtccttccctccttccctccctcccccctttcttcctcccttccttccctctttctgtcctttctctctccctcgctccttcccatcttccttctttccttccttccttctctcaggcactgatatcaatgaattttcttcagatgacttttctgaaaaactattttgagaagggcaatgtcgtttagagtaattatctctggccttaaatccactttgcagtgagtcactatttctgagaattaagctcaattccagacaaaaaagcccaagccaggagggaaagctctgtaggtggctcacgcagcacgcaagcagatctctcttctcattgacatgtcctcacagtaaatgatgacttgaagaatctaagggaggttctgccctctagcatttgccttagttggaaagtcagggtcaggcatctgtcttaatgtgagcattgactttgagtccttttttatgggtttaaagtcttgcagtaaagaataagtgaacgtcaaccaaatagaggggttgcctttgcctaaagccgattcctgttcattggtcatcttaagggtgatattcaggaaagtgaacaaggagtcagagacttggttttgggtcccttctgtgccataaactggccaaatgaccctggatgagtccctatccttcacctctgggctttagcattctcattgctaaagtgattggagcaggtaacctctgagaggtctgccaaaccatctactctatgaaaaatatgagtttgtcactttcatctttcatttgtgagtggctctcattggttccattcacaggaaccttgcccttcatcggttggccagtttccacacatgggacatggctcttactcaacgagagagtaatccagagctcactgtatgcatggagggaggtgtggaacactctcaggctcccccttggttgaactgcccccaaccatgatgagtaaaatggcctcacccactttcagtgaagtaagatcccgttttgcacaagatgaggtttgtaaagtgcccctttaaaaaaaaaaagattctattctgtcaaaaattatggaatgttcatgctttcatcaaagtagagccatggcttatattttacaacacgcatagctgtctaatttcacatactgtttttctattctgtcacattttggacaaaaatgtcttttctctaggattcaggacattgcagtgtgatgtaaaattgcaatctggaggaatatactgtgcgtggagaagggatgatgagggcaactgccccgtgactccccaatactaggccactgatttcagggaaggtctcctttttgccttaaaggggaaacacagttgtccaaagtctctatgccatcaaaaagaaacctctgatgcacgaaacttatagaacgcttgtcagtttcagcattaacataaccttcaaaataattccttctgctcaatcaggatcttcatgtcttcagtcctccttcctgtacttgccccagtgtgacatcacattccttagctagagaggtgggatgggggatggatgagtttttttcaccacccagtattatcattgcaaagaaacaaggctgtgcctgttactgtatagaatgcttatttccccacacatgtagcccagccatgttattcagtaattatgccttttgcagcttgaatatctgaaggaaaaactttcccaggtgaaaggaggcatgaccctgccagcccttgaaattctgaatggcttcaattctttacagttcaaatggttaaaaagttctgttcccccacacccccccagaaaaagccagggtttgcacttcatatctctcagcaccttgaagcaatattagagctcattaaaatcaacccagggctcaagaagggaagccttcatttagggggaaaacttttcccctgtgctgctctggaaaatagcacaatgctgagagcaggcatttttcctgactaggtttcctctaacgatttctccaaagcacagttagggtacctgcctcccagacagcacatgtccagcaggcccaggtgaatgcgtgggactggctatcactagctcaaaattgccttaatatttattgacggcctaccatgtgaaaaaggcctcttacttgatttcttgtctctgtggaggtccctaaagaaatgattctgtgtgtctctggatttctcacaatctagagacatggaaagggagctggctatctggttcgggatccgtagaatacgaagtatggtctaaaatggtgtccagctatacccctgcccccaggcccctcagctctaaaatgctcagatcccagccctgcggttctgtaaggggcccacaaaaaccacagaattggatccctcatttcacatcccagcatatccaactgcctcctactcaaatgtcctgctgcattcaggccagttgtgctcctggcctgtgactcctgaggctgtgctcaggcacaaatgagaatgaacagcccagtgggtgagagcacacacattggaggctcagacacatctgtcagtgaggacacaaagaccaaatataaagaccagattttatcttcataaagactctatggttttcatgcattgtaaatgagaaaagtagaagcacagagaggttatttgcccaagatgacacagctagtaactgccagaactggaatttgaacacaggcagtctggctgtagatcagcattgtcaaatagaaatacaatgcaatggatgcacctggaggcgataaacgtaagcgaattaatgcaggaacagaaaaccaaatattgctgggtgtggtggctcatgcctgtaatcccaacactttgggaggtcgaggcgggcagatcacttgagatggtcaggagtttgagaccagcctggccaacatggtgaaacctcatctccactaaaaatacaaaaatcagctgggcattgtggtgcatgcctgtaatcccagctactcgggaggctaaggcaggagaatcacttaaacctgggaggtggaagttgcagtgagctgagatcgcaccacttcactccagcctaggagacagagcgagactgcatctccaaaaacaaacaaacaaaaacaaaaatccaagtatttcatgttctcgcttataagtgggagctaaacattgagcacacatgaacacaaacagggaaacaatagacaccatggactacttggttgggtgaggaaggggttgtgggttgaaaaactaccaattgggaactgtgctcaccacctgagtgatgggatccataccctaaacctcagcatcgtgcaatatatccatataacaagcctgcacatgtacccctgtatttgaaataaaagttgaaattcaaaaaaagaaatgtgatgcaagtcacctatgtaattttaaattttatagtatccacattaaaaatggggatacagatgaaattaattttaataatacattttatttaacccaatatatccacattattatttcaacatataatcagtataaataataattaattcatgagatattttctctacctctaagtcttggaaatcttagtatgcttgaaaacttaaatcacttcttagttcagactagccacatttcaagagctcagtagtcacatgttgctgatggctaccatattggacagtgcagctctagaacaagcccttttcatgatatacactgtgactaaaatgaaggcattaacacctatttgataggttttctgaaaaagcttctagcctagtgtctgacatactgtaggcacctgttaaatcaaaacatctattagtttcctgtgtgttttgctctttgctgatgtcagaatgccgtccacccaccccaccaccatacacgcacctagtcaaatcctttttgtccttcagaatccatcatattcctcctcttctatgaagccttccttgatgaccataatacagtcaactctcttctccccactcatttctcacttaatctctgtatgacacaattagcactgaaatatactgtgcctctatctgcccccgccccctccaattctaagcccgttgaaagctggcacccgtatacatgcaacttcctcaccatgcctacagctctaattatggcgacttctaggtcagagttgatacgttgttcatggattgattaaacttctgtcttgcaacccaaggccaagcccctcacctccagggctaaaagggcactatgtaccctctttgcacatgcctgtttctggattgagtttcatgaaagtaccagttttattactttttagttaagacctgaaacatgcagggttttatgtggatgtactaatcaatcaaaaggcaggaccaaagcaatggattcctgggacaagaggcactagggatgtttatctgaagagcaaaccatgatagtcccagtggggacacttagaaatttccccaacctcctcccatccactgtggcatggagcttatgattcttcccctctgtgcactcttgtttcagggttgggagaaggaagagaaccaacccctagctctggcagttccagatgccaatcctcaagggatggcaatttgacagaagatgtcacatagaaacactcagtaagctgagaagttccatatgtggagggaggagttcctagaaggaaagtcaggcaggaagcttgagtgtgttaatcagtggcagatctggtctccatgtgacttgggcagatcatatcccttcatgggaccccagtcccctaatctgcatgctgtagggtattttcataaaagtttcttccacctcaagaatacactgactattaatgaaccaagactcacaaaataattttagaatgcaaaaaattgggagaaaggcagtgtaatctacaaaatttttcatgatgtcaagcaattggatggattctgggtaaaggcctgcaactatgggtcataaagtttggaatttcacatcttgttaaagaactcagctttttcactatttgcaaaagcccttagagttatgtactttgaaacctactgggctttgggaaaaaggagagtgatttcttttaaaaagaagtaaatatcaccaggactcattgtgtgaagaattccaccttgagtttgaattcaaaggcattagaaatcttctttattttcaacaaaggaaaaaaatttctgctttgttaaagaaaaagaatcgcatagaaaaacatccttctgtttaatgaaagcccatttgtgctcctttgagcactccccacaatacacacagatgggtttacttttagttaatcagaggaaaagaatcaatgaatgaaggtgttactttatatacacagaactggtcctttgggtgaggtatgaagaagagcagaaaactccttcaaggagaactaatagcatgtttggtgggtgcaagaccttcagcctcttcagatttggttttgtgtctggtagatcttttgtctaataagtcttgcttgtctcatggatcactgtgctcccaagagttcaccttgctccccacctcctgtgggtagcccagaaagtctggctaagtcagcagcccacagcatgaacttcaaggggaaaggaagaggttcagcatccagatcatttaggtctttctagtgttgtgaagacaattaaatgaagtcatgtgtcacactgctctatgtaacccactgtctgcaaatgcaacagctcactcttctcactaggtaaagcatgactactaagccataaaacttgtgacaaatgtgccaaaaacaacacatctacaggcacgtctgtctgcttcaaagtagtccccttgtgaagtcccacacttcttttatgagactgctgccactgctgataacagcatttattaaactcctgtttggggactactaatatgagctacacaagaaaagcacttaaaacagcacctccagggcttaaggggtccagctccatcagaagcatgtttgcctttgattcaatttaccatacttttatttagtttgtgctcacatattaatattgtttgatttgaacgccttcctccttgctttgacccagtcatttacatgcaatgggaggatccatgtggttgctttagacttcattagccaaggaaggagaccagaccttcaacattaatgactcagtgtcatatacaaccaccccaactattggcagagttacttaggaccaccaaccacagttctttttctaccactcattgtttctccaagaacaagatgtgcaaaggctgaacttttatatatatatataaaatattttatatatattatatataaaatattatatataatatatatataaaatattatatataatattatatataaaatattatatatatattatatataatatattatatatatattatatataaaatattatatataatattatatatataaaataatatataatattatatatataaaatattatatatataaatatataatattttatatatatattttttatatatatatagcacatatatatgctacaggtataatagaatgttcactcctattgatttgggataagaatttgtttcctttcttaaattaactttttattgatcactcctatgaccttaactgctacgggttttctggccttcttctattaaaaaatgtctttgatatttatttcccctttgagtagtgcagggaaaaccttatcatggcctttcgtgaaccagtagcctcaaaggaaagtaaatgtttacagcatgatcctcagaactttgctcaagtaacattccctggactttcccttgatggaaatgggtgcccccagggtttctccaaggggtagagagaagatagggcttgcatccgggggcacagttggcttgtctacactctagataccacctgggatttctgagagacttctgatctctgaagccacatgcctaggacagtgattctcaaactcaactgtgtgtatatcagaatttctggatgggcttcccaaaatgcagattggcaagccccagcctctgagtttcagattcagtgagtggacctgagagtgtgcatttctaacaagttcctaaatgatgctgatgctgatggttctgggctcacactttaggaaccacttttttagttaactcatagaattagaagtcctgggcttgtgccctagcaccaggatggaaagaataccatttctagagtgagagagacctggattgaagcctgaacacacctacttaacttgaggcgtgacccagagtcacatcatctctgagtctcagtttcttcattctggaaaagggaataataatatatgattcacaggattgttgggagttaacgtataagtgtcaggcacagagcacccccagttcctggctatgtagttggtgtaagaaagtgtcctctttgagcagccaaatgtttacccttcatgggggttagtgagttctttcaggcctggttgagtgtgccatcctaggtaactagcagacacaaagagggtctgctaaaataacaggacttcggcccagaaatagttctctcaggtagattgattctcaagggctactggcaaggtgtgatttggggacaagtccttgcctgtctctctctgggcctcagtatccccacctttaaagtgaagggtttgacctaaatgatttactgtctcaaaggtttcctcctgttctgacgagtgtaggactctgtgacttagaacttgggcacttatttcagaatggtctattaaaaggagaataaaaaataagattcttgtttttaaccatttagttatttttaacgtccttaaactttccagccttcttttaaactgggatactgcacaaaaagtcagggacaacagctaaatataacaatgtccttcacagctacatctccttaaaatgctccattacaggtataaaatggtatatctgttatttcatagtgacatctagtggcttttccttatcaaagaataagatacgcattttcctatttgctcatcataagctctgctgcttctcctgcagaaattcattcaacaatcttttattaattgcttactttatgtcaaacattgtgctaggccctgaggatagatacatggttcttaccctcccagagctcatagtccagcggaagaggcagaaaaatcgcttgacaatcccagcacattgtgatacatgttacaatgggagaacaccagggcgtctggagcagagaagggggtgcttaactccatccagggaggtcaaggaaggtttcgcggaggagacagtctttgagttgagttttgaaagactttgccaggtaacctacaaaggataaatagaagccattcaaaagagtgggcactccatatacagaggcaaagcacctgtggagtcactgcctgggactttgatttggaaaattcagcatatagggtatagagcaaggttcctcaaccttggcattattggcatctgaggcagggtatttctttgttgtagggggactgtgcatgataggatatttagcaacatccctggacttgacttactagatgccagtaccaaccccctccccaagtcattacaaccaaaatatccccagatattgccaagtggcccagagttgggggtttggggagtggagatggaagatcactcacaattgagaaagacttgtatagagggagctcacttgagaaggctggacagaaagaaaggtggttgctggattccacaaggctgtctgtagcatgtggaggagcttggcttcatgtcatagttgatagggagccattgggagggcttaattagggaatgacaggtcaggtatgtgccatctgggggtgtggaagtggcatgggactggagacctgaagagtaggacgggatgctactgcaatgttttagtagagaagtgatgaaggcctgaccccaggcagtggtgcaaaggatggatttcagagctattagaaactggaaaggacttaagcgaatgtttagctcttagtagtgaggggagattagaggagtcaaggatggccctttggtttcttgcttggacaactctttcatttgttgctattatttcgacaattgcttatcagtgacaggaaaaagttggcctaaacttgtagacacaaagcaggttcactgtgcattgtttataaacttctatgggtttggtgagacagaacacactcataagcaacaagttacatgaagtgggtttattacttacagataggcagcaagggacaaaagaagcctaggatccactgtgagatggtttcccaagactcaagaaagctgcctgggtgaatgagtctcgattaagcatgcctcacttgcaccatagctgagagaccccaaaaggcagcctttcctgagttatatacctcaggggccatgtgactcatttagcaaagctttgaaggacatcctgcttctgagagaaaggaacaaaggctgggctgtcccaggcagttcctccctatctcaagatgttagattctccaggaaggactggaacaaggcttttgctgtttcaggcagttcctccctatctcaggatactgcactcccagcacattctacagttattcttaagaatgacaagcaagaatgaggggagtattgtgttggtccaaggccacccagagaactgtcattcagtagaaggtggtaaacctttaactgtgtagtgcctgtaaagtcaccatgggcatacagaagcaccaatcagccattcaattaacccatgtaacccaatggggagtcatggctccaatttaaaaatgtgacaccttgtcattttaattaggtgatacatttggtcacaagaaagtcctgtccaattactactaagtgaaacaggtggcgtatgattttcctggggctgaactggcctcattcagttaaaattcagtcagtccattcagcggcacccttcagtttcatgtcaacctgaagaaagatttccagcaactatcagagacttgctctcacctgcatcttgctctgttttgatcaatgcctgaatccaggcattgccaacaggaacaggaaagtatggtgaagatattgggggatataatcagaatgtagatgtcttttgacaggcttagatttcctccatcaagaagagattaaacagggccacaaatacactgcatcagttcctgacaatatagattgcgttccagcgtggcatatatgtgaaagtatgaaacaattgagcttactgtgtatcagtggtgtggtgtggccgccaaaatggtccatgtgatctgaggccacattaagagaaatggtgtcaagaatgaggaaggtgataggctgtcccttcttgttgcttgtcagatcgtgcttagcaggccatgttccaataaagtggaatgcacttgcaggcagacaacaggatagcggggccttgaagctatatagagaatagttgaaaaccatttttagcataaagaagagaagccctggggtaaatgctgtcttcgaatatctgaagccacacaagtggaattttaaaaaggtccctaaatagaccatgatggtctggaaattaccactttgtgctgaccactccgtaccttatcttcagcccaggttgctctctgagtgccagatctgttcattcaactctactcagatgtcccgcaggcacctcagtccttcctccagagctctaggaggcatccttaagtcctcctcctctttctcccccgaatcccttttgtcacttttacccgctaaatatttctctagtctgctcctccttctcttttgccttgtcttctgcagtggcctcttaactaacttcacgaatttcatcttcatatacataatgatctttctaaaacacagacctcatcatgtcattcccctgcttaaagcccttcaaagcctctctgttgcctgcagaattaactttgaatgctttaatatggcatctgtggcctttcacaaccaggtcctgggctccctctccatcttcaattcctgccactactccttcactccccgggaggttttttgatgcacgtttctcttgcacaataggctggtttatgcctctgtgcctctgctcatgctgatccttctgtctcatactcctttcctctctccttgactcatttttttttttttttttttgagatggagtctcacactctgtcacccaggctggagtgcagtggtgataccatggtgcactgcagcttctacctcctaggctcaagtgatcctctcgcctcagcctccctagtagctgagactacaggtgtgcaccaccacgcccactaatttttctattttttgcagagacagggtttcaccatgttgttcaggctggtcttgaactattgggttcaagtgatctgcccaccttggcctcccaaagtgctggaattacaggtgtgagccaccgtgcccagttgcctcatctaattcttgtttttcaaaataaagctgcagaaacccttgtcttatctttaggctaggttagaaatcagtgtgaggtgtttttttttaatcataccctgcacttgctccaagcattcatggcacacacaattgaaacactttccccgggtttccatgtcttatccctgtctgtatccccagtgcctgccatagtgccaggcacacattaggtgccaagactaagcaagtcttgacctgacctgaccactgagggaaaactggccatgtctctgtttgcccccgaccccagctgcattccccagcgtgcttctctgatattgccctaaaagctcttccttggatataatgagcatcctggattctttttctgacataacctccaaggtgttatctttacctgccttcctacttccaacacaccatgaaattcaggagacccctggaccctggacacctacccttcagcagatctttctttctttctacacatggaatatttctaagcagcatcaagtgctttcagttgaggcattctgggtccccaaggctatttgccctggaagaagggggctgttgacactcactgaatctctgcaggttttgtcatatgagtctaggtggctgttatcaccaaggcagcagtgtgtgtatgtgtgtgcccctctaacttctctgctgcagtgaaaatccctacagtgtagacactgaggctgcctacgttgggctgtccgtatttcttaagggcactaggtgaccttcaagttgaatgcatactggatccacacacccacaacatgagagaccctctctgaaagtctgtctctgtgttgccttctctctatccatgttggggtaggggtggtgcttatgaaacattgattgtgtcattaaccctggtggttgggatgtatttgctctgaaaggctaggaacaatgtttaggaaggagagctgcagacttccactgtggtgcactcttaatatttaccagaagatgtcactgtaggcttaaaccaatacaagaagttagggcaagaagacttccagctaagcatgaaggtgactccattttggggggttagaacaccgagcagcccccattacaatgcatgcctggaaaagctggttgaaaggttaatccaaatgtgtcacagaccttaataaatttctttttttttttttccaaataatcagactaattgccactaaactgttgcctcagggctagcataaaggctcaataagtatgcactgaatggatgagtactaaagctaggagtggaaggagggaacccagggctttagtagtcatctttgttggtaaaggctactggagaacaaaagctgctactctttagcagtggcttctcatagagatgaattttagtggcaccaacaagatcaggtcctagggaaagtagtgagacaagtgaaagtgctcttggccccttttccatcctcactcccagatgcttctcctgtgcccaatgcttgtttcttcctgaaaaaatatataaagtgatttattttaagaaaaaccttcctgtgattttttgcaaggcacttagaagattatccagagtttttatgtcatgaggcatgtccctagctctctccttcctcttccccaggatagttcatcaagtaagcagttaaagaagttactgagattctgctttatgccagggatgaaggccaatgtacaaagctggaatggatgggatgagggctatatagaagaataggacagagcccctgtccttgaaaacatagtttaagtggaaatataaacaattaattgtaattcagtatcacacatttttgggggaggcagtggggtggaggggtagggtctcactctattgctcaggctgaaatgcagtggcacaaccacagctcactgcaacctccgtctcctgggttcaagtgattctcgtgcctcagcctcctgagtagctaggattacgggagcgcacaaccacacctggctaatttttgtatttttaacagatggggtttcaccgtgttgtccaggctggtctcaaactccttacctcaagcaacccacccacctcagcctcccaaactgctgggattacaggcatgagccaccgtgcccagccccagtatcacaaatattttaacaaaggctaagtatagaagtgctatggcaacacagaggaagaaatgataactggcaacacagagtggggtacattttttcacaaaagagatggtacttgaactggtattgaaggatgagtagaattttccagccaaagagggaagatcatggcaggcagagcaagcaccatgtacaggatagaggcataggagatagatttcaggatgcctgaggtgatggaagccccagttgggagaaacgtttcctcaatgaacatcagccaatattcagttaagcaggtggctgagcaggttccctgtggctcctcatgtatgtgtagagaacaaccactccctcagatgggaatgaatatttcagaaaagttgcaagccattctccgggtttcctttaagaagctaaatgctaatattcaatgtttattgttgctttctttccacaatatgcccttctgtggcctcgtccttcatcttctgtacctgagtggtaacccatttctcatgaaaagcacaatgacacggttctctccttaagtatgcctgattgtatcatggacttgatgtttctggggcgtgtgcctaccatgtatggtgtgagtgtgttaacatgtggtttaaatgtttgctagtctgctatttgagcaaagaactttgtttgaagccctaaagagaagacagccatacagcaaagcctccacacttgctgacatccacgtgcccttttagtagataaggaaaagggacattttgaagctgctgatagagttaagtttcctatcctgggaatattatcataggagcaaaggtggaaaccaaggtagtagcttgcatacatgccattggcagctaccatgtctatttcagtcagtgactaaccacagcgtttattgctggaggccctgggctactctgcctatctctacattccacttccataatgtatgagccataatatgacaacagccagaatcaagagtatcatatcatacactcttttaatgagttttttaaaaacaaaaagatatgcagattagactggatattagaaaaaatgctattgcatatttaataagattcgaatttgaacccacttgtcaactccatttcactccaataaagtatgtgcttccaatgagtctccatttcatgatcactaaatggtttagagtggggggcatgaaataaagtggttgcctagttagccaatggtgtcattgggaagattttgtctttggttagagagggagaaaaagaggggaagggggaacgaacgggagtgaagcatgacaaggtcaatgtctggaatctaaccttttcatacctgttttagctgaagtatcagcaaattggttgaaaaaattagctatctctaggctagtgagactcagagaggggactgcagtacagtttacaggacaaatgccatcagatccctgtcatttttgctttgccttcctttttagccagtgaacaccacatatgccatgtacctccatgactccacttatttcgcccatatctctgactgttggtttttgtgcttcatccataggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgtta

SEQ ID NO: 5042 - DNA, 331310 bp, human
cgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcgggacccgggcctaggcgggcggagggctgggaggcgcggctggcccaagccggggacctagcgcgcaccctgacgcccgggcgtttgcaccccggctgggcaggtgctgggcgcccagtagcgcacgttcgccgcgctgtggcggccacagaaaggctttccgctccggccccggactgaccgtctgtctgtccgcagggtggcctgcgtgatggttggcagagcgtgcgggggaggcggccgagcggccggaacggggccgctgggacggggcatcgtactcagtctccgcactggagagccctaaagagccgcgctctccgtgcagcgtctctggatccctgctttcttctactctgcacccgggttccgaagtctcctttcagcgctctcttcctcctttcggcgcccgcattcttccctccccccgctttcccccctatttcgtctatttgccttgttctccctctttctctcttgtgtcctagatgttgtctgctcctgtttgctcgctgtttccttctttccattcccctctctcgcttttattctttttctctcttaccctttctgtttttctcttcttgccggacttttatcacctcgctccttccccgctctggctctggtcttcccgggcgactgggtgtccctctgtcgctattttccgacatccaaggagagctcatggttcccaggcttgcttatcactactggctgcatgagaggcatccgtggctctttgggagtggcggggggcaccccgcggaccgaagggcgggctgggatggtgccctggaccccatgtggggttcagtcaccaggagcctctcctgatttacaaaaaatatttaaaaagcttgagccccagcatggggcgctgccagcccatgttctgtgagcctgggctgatgcggtaaaagctgatttattaatagtctgtagccagaagcaagggtattttcctccctccagacgcgatgtccagttgctagaggtcatgcagtactgtaaagtgggtggtggtggggtgggggaagtgagtgctatggggtgcagttagtccagccagggctactgtttcgcaagtctccttaaaacaaatctgggctgaagcagggagtccagggggtgcacaaggtgagtttcatggcctggaggcctctggatggggtctctgggccggcaaggacatgtctgtgtcccatccccatcccccgggtgcacttggtaccctggacaaggggatgctttgcaggtgactgttagaacgcaacaaccagtgtggatttttctgtccaactgcagcaaatagagccctagagccctctgactttcagattaccattgagatttaaggggaacatcaccccctggctctcctcttcactctctcttctctcagtttacactgtcctttctcaaatgctggaattgtgtcagaatctgccaaacttgtatttcctttccaatactaacaaattttttcttccaccccaagaaaaccttagccccaggacctcaatccattggtacaattgtgtaagtcattgtcacaacaatattctggtgtttaataagttcccaaacaatttggcaatattgaaaagaatttctcatactgacagaccttgtaggtgtattgagaggtggtaatatttaaaaagctcttctgggcaaaagtagaattccacagccatgactatagcagagaagtgaaaacaaggtcttggtcaccatgaaagccatggccttgtctggagttccatggggcacatgtgcctttactgatccttttgaacatgtaggtcagagtatgatgtctataaacacacattattaatgtggtctagattatctgtttggtggctactgtcctctggcagattccttcccgcattctccagaagataaccagaacccctcaaagcctcttggattgtcccaaattgaagcaaaattatttgaaatgacataggattttcttggttattaaaagggtgatactacagtagcatctagtctaatcaaagagcaaccatgttctaaaaagtcacagttactggattttacggtgtttgcaaaaatgaaataaaacttgctagagaaatgcattgctacctcaagggcacctttttatttcattcattcctgcccacctccagaaatattcactttgaagaatagggatagcctaggggttccagaatttctctggatgttgacagatcccctaggaggttgcaggaccagttctgtgagttctgataatctgtaagagctaaggtgtgcatgtgtgtgtgagaatgagagagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctttaaaaaaaatcagaaattggatttcatccatctgtctgccagtatgttgtttgcagtcactcagggtcctgctcattttagaatttctgagaccatttttgaaagtgtatccaaacattgttgctcacaagctgttaaaagtcccaaattctgcaggcttttcttaggccaaatttcctctgtttgtagccaactctagtgtgccatttgttctgtagagggaattcagaactgggcccaaagaaatagcactagcccccttcttcatcactaagtatcatgctggccagcatgcacagaatggggttgagaggtcagggtccatggctatacaagtcaaagaatctgatcatattcatgttgtaccctagacttttagcatctctaaaattttcagtttggatgagtgattgggccgggggtaccacacccattgggagaagaacagatttctacatccctgaggtgttttattcaccaggggtaggtcttgtggctagattgcagaggggcctttcattgccatattgggaatccctgcaaagctgagcaggatgggagcaggctgaggcatctggaagagtaattaattatcatctcaaatccagtagcatatcattgatgggaaaggactaaaaagtgtttgtttagatggagaaaagctttttttggtcattctatttttttttaattgtgggaaaagctttcttttattcccatttgtttttaaaaggtggctctattttgaaagagctgtaactatagagtgtgtgtacctgatcatgcctcacaagcccacgctttccctctttcttctccttgattttgcagtgaggcaaaatgacacaacaggcttgtgatataggctgaggcattaagcagaatggactgttacagccagtggtcagtactggtcgtgtggttcatcaggctctaagctgttgggctcagttttacttagctgaggatacatttcttcagctgtctttgagagctgtggtaccatcttagctatttcatagaagagggggagaaatctaccattacaatatctgtagaattccagtagtattaattagcatctttgcatggatgtcgaacatggtgttggagtccttacaaagctgtaagttctcaggtagtacaaaaggctattcagaattaacatcacttaataataattttagatcagtgctatggggcaattaaaatgctagagcttgtctttcatggatatcagtcatcaactgaggtagtatgtaatgacattaaaagaatagccatccgtttttttctgtcattcattaagcaagattttgtgaaactgttcattatattccagggaagagacatcattctctgtctcacagagcttatggtagaacagaacaatttagtactttagatatttaattaaaaaatggattttgtttgaaaacaatttgaaaatcaataatgtctttaaaatgtcatacatttaccagaatatacaaaaaatagacaaaagtccatctgttatgttgtagtttgggtctaatcggcaaagcagatggagtaactattatgtctctggcatggtgctagcagttgtggggagattagagccaagaagaaaccaaaaaagccaagataaccatcttcagcctcaagtccataaagattagcatgtgaagtgcaggactatgtcatgtagacaggtgctgggagaggaaatttagattttggacaggcccttttccttcccttggtctcagtgtcttatctataaaattggagatttaaatgacatgctttccagggccctttcctttctaaagtatgaggaacaggccagaaaaaggagacatccttttgagaaggcctctgggagtaggagagttgtattaagaagaaaggaggcattgtgggtgggcacggagtcctcatgaccttttgaggtccagcaacctcacctaggcaggtctggccagacccgaaaggttcatgcttggagtaataatggttagggaagtagatggggttaggctccactgtggaggacttgaatggcaatgaggaaccccagtaagtatgagaagctcttggatggaaagagtgcaaaaacaccatgaaagtaaataaaggtcggagtctaggtaaagctatctccctgatatctagtctggaatgtaggtggtaccagccaccaaaacagagaggttgagaaggggatctggttcgggctggagagtactaagaagtcatgactggttcctgttgcctagatttctagtggacaggacttataaggaggtgacaactggggctctggggcaggttagggctccatcgtacattatatgtgggaatctgtggacccagttaatctgaattcacaattggcgttgttatttaagtgatagctgcaattcacatatgggactcttagccaaggaaaaggatgtttgaataaaggaaaaaagatcaatagttatgattacataagaataagatatgcttatctgtcaaaaaaaagccaaaacgaaaaggtttcaaactggtaataatatgcacaattacaacagacacaaagttgaaatctttactgtacaaagaactctcacgagctgattagagaatcaaaggacatgaccagacaatttacaacataggacccccaactagtttgcagacatggaaaaactgttttatttcactggtactaaagaaatgcacatttaaacatagaatactttttttgcctctctaaccctgattaaaacaaacaaacaaacaaagcaaaacccaacatatatcaccaccaaacaaaaaaagtagacagtgctgacaagggcatggtaaatatcaaaattctcatacattgtcagtgggaatgtaacttgaatgatctttttggaaataaatagtgtaaacacagaatataaaaatatttatttctatgacccataatttcttttctgggattttgcagaaaaacatacttttatacatgctttcattcattcactcatttatttattgattcagcaaatatttattgagtatctggtatccctgtgctatgtgctggggttaccgggaagaaccaggtagatgtggtccctgccttcgtaggagtgggaaagatagacagaaaacaaattatcaattacttaaaattatatgaagtgccatgggggaaaagtacaggatgctatgagaacacatactaggagactaactggagttatcataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagagaaaaagagatagaaaattatggacccagtacgactacaattatattaaagaaaaaaagatagcgagcgagcgagcgagagaaatcatctcctacccctcccaaatctaagcataaaagacagagactggaagaaaaaaataatagaatataaatagatctattagtgatttattttcttattctgcttttctgaaggttttgagttttctttgagtctacattacttatataataacaataagcattaacaatttttaaaataatgttttactaagctgtgattaattgcacacaggtctacttttttggttcctggctggttatttcattagcctcttgatatcctgggagcctttaatgaggagagtagcctcagccctaataaaccctcaccctgaaaggcagaggtgatgagtcagacattggctgctgattttcgataactgacttttatcatattcccacacaatgcatggaactctttttataccagtatggtatagagctacttgagtgaattgctattgtttctttctcatttataaattataaattttaatttataaattatatggaacaggaagttaatagtggtacacagttggaaatataaagcttattctgctcagccagagccatccgagatagtctggactttggatctccatgagcttctttcttagtgagttgacaccagggctgatggtctggctggaagagttaaaatcttggggttggtaaagggctatagttctaaacatccataactgggagcttagatcagttagtgtatgtgttgctctcgtccagcagaaaaggagagttcactttgctaagcagcgccccctagagaagtttcactgcataagagtattacccccagttaaccataaataaagttgattagaaatgtcattgtccaactattccaatatctgagggaccactctatgcacatatagtgaggtgcataatcttattgttgaaactccactgaaactacaccgtaggtacaagttgttttgacagtgtaaagaatgtccctcacagttgaaaagctaatattaacattctgtgacacatgaaatgaggtatttagtcactgagtttaaaaagagatgtatggatgggaatttccccctttccattaaaggataatgaataatccacttaatggcgtatgtcctctaaaacagtgtccttgtaagcttagataaatatttgtctaaactttagtaaaatatttattggcaaaagagcttttctcatttactaggtattgaactttgcagattattcagttggtcttattgcatcccatttgttatttctgccattttgcctctaaaaactgtgctgaagactttgacacatttcagagcattacactaaataaatctgtcttgcacattccactgtgctttttctggaatattataaatattcaaatataggcacacacgccgattcaaaatacaatttaatacatgcaaattgtgcataaattccatatttataacttggcaatagtttcgaacttgttatcctatgatataaatgtatcaaataggagctcatgggaattatcaataaatgtatttttctgattaaactgtgggctctttttcagtcacaatttaagcttcaattctgagttatattataagagaataatttgcacttcatttactctgaattgtcaagaatcttgttcttccccaatgtaagtgtctgcaaagaggacttcttattcagtttgattgctttttaaattttactagtggagatgccctagtgagtctgagagaattggtctgtttcttatgaagagtttagttctaatgagttgcttccatgcactgttctgtgcgaatacagagcaattgaaatgtgcggtgtattgatttacctcaaatggattaggcctgtgtgcaccattccttgcattaattgactttctcccataactgtactaataactgcaaatcttcagtatagtattagcttcaatttactcataaagatccttgggtttttgctaacttactacaggagagtcaatgcaagcaagagtatttagaaattgactagggggaccaagttacatcatacaacccagaaatacttttaaagggctctttgatcatggcagccaactcttcagttattacaataaataggagttgactaaactcaccagttaagacctagattatcacaatggatgaaaataaaaaatccagctatatgctgtgtataagagacaaaggtaaaacataagaacataaagcacacaaaaaggattggaataggtacactatgcaaacactagccagaagtaaactgatgtggctatgttgatatcagacaaaacagactttaaggtagaaccattattgggcataaacagatcactgtgtaatgattaacagttcagtttttttttcagataacaattctaaacttgcatatgcttaataccataagtttgaaacgtataaagcaaaagttggcagagctaaaagcagaaattataaaatctgattttttttcagaaattgataggtaaaatgaacaaaaaatgaataaggatacagaggatttgaacaacatgattaacaaactcaatataatgggtatatatatatacacacacacatatacatatacatctaaaatacacacatacacacacatacacgcacacacacacacatatatatatataaaatctgcacccaattggaagaatacacacacaagtgcatatgaaacacttttgaaaatagaccatatactgagccctaaaattactcttgaaaaacttcagtgaatgaattatcttgtagaccatactatctgatcatatgcagtgcttagacattgggtgttgtgttaaacctgagtgcgtgtgaaggaacgttagtagtttgctatatttgtaagtattaccaatccttcaccgaccacataacatttcttaattgacatacaaaagtgaagaactccaagacttaggtagtttgacccaggtaacttggccttattttccaagaagatctattactattttggggtacctattgagacaggtcctgtgcaaggagcatattatatattttctcatttaattctcacgacaaccctctgaggtagattttttaatatatactttaagttctagggtacatgtgcacaacgtgcaggtttattacatatgtatacatgtgccatgttggtgtgctgcacccattaactcatcatttacattaggtacatctcctaatgctatccctcccgcctcccctcaccccatgacaggccccagtgtgtgatgttccccaccctgtgtccaagtgttgtcattgttcaattcccacctatgaatgagaacatgcggtgtttggttttctgtccttgggatagtttgctgagaatgatggtttccagcttcatccatgttcctacaaaggacatgaactcatcctttttatggctgcatagtattccatggcatatatgtgccaaattttcttagtccagtctatcaatgatggacatttgggttggttccaagactttgctattgtgaatagtgtcacaataaatgtgtgcatgtgtctttatagcagcatgatttataatcctttgggtatatacccagtaatgggatggctgggtcaaacggtatttctagttctagatccttgaggaatcaccacactgtcttccacaatggttgaactagtttacagacccaccaacagtgtaaaagtgttcctatttctccacatcctctccaacacctgttgtttcctgaaattttaatgatcgccattctaactggtgtgagatggtatctcattgtggttttgatttgcatttctctgaaggccagtgacgatgagcattttttcatttcttttttaattattacactttaagtgctagggtacatgtgcacaacgtgcaggtttgttacatatgtatacatgtgccatgttggtgtgctgcacccattaactcatcatttacattaggtatatctcctaatgctatccctcccccctccccccaccccacaacaatccccagtgtgtgatgccccccttcctgtgtccaagtgttcttgttgttcaattaccacctatgagtgatgtgatgtttggttttttgtccttgggatactttgctgagaatgatggtttccagcttcatccatgtccctgcaaaggacatgaactcatcattttttatggctgcatagtattccatggtgtatatgtgccacattttcttaatccagtctgtcatcattggacatttgggttggttccaggtctttgctattgtgactaatgccgcaataaatatatgtgtgcatgtgtctttatggcagcatgatttataatcctttgggtatatacccagtaatgggatggctgcgtcaaatggtatttctagttctagatccctgaggaatcgccacactgacttccacaatggttgaaccagtttacagtcccagcaacagtgtaaaagtgttcctgtttctccacatcctctccagcacctgttgtttcttgactttttaatgatcgccattctaactggtgtgagatggtatctcattgtggttttgatttgcatttctctgatggccagtgatgatgagcattttttcatgtgtcttttggctgcataaatgtcttcttttaagaagtgcctgttcatatcctttgcccacttgttgatgggtttgtttgtttttttcttgtaaatctgtttgagttctttgtagattctggatattagccctttgtcagatggctagattgcaaaaattttcccccattctgtaggttgcctgttcactctgatggtagtttcttttgctgtgcagacgctcttgagtttaattagatatcatttgtgaattttggcttttgttgtcattgcttttggtgttttagacatgaagtccttgcccatgcctatgtcctgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggcagcagtaccatgctgttttggttactgtagccttgtagtatagtttgaagtcaggtagcgtgatgcctccagctttgttcttttggcttaggattgacttggcaatgtgagctcttttttggttccatatgaactttaaagtagttttttccaattctgtgaagaaagtcattggtagcttgatggggatggcattgaatctataaattaccttgggcagtacggccgttttcacaatattgattcttcctatccatgagcatggaatgttcttccatttgtttgtgtcctcttgtttcatcgagcagtggtttgtagttctccttgaagaggtccttcacttcccttgtaagttggattcctaggtattttattctctttgaggcagttgtgaatgggagttcactcatgatttggctctctgtatgttattggtgtataagaatgcttgtgatttttgcacattgattttgtatcctgagactttgctgaagttgcttatcagcttaaggaggttttgggctgagacgatggggttttctagatatatagtcatgtcatctgcaaacagggacaatttgacttcctcttttcccaattgaataccctttatttccttctcctgcctgattgccctggccagaacttccaacactatgttgaataggagtggtgagagagggcatccctgtcttgtgccagttttcaaagggaatgcttccagtttttgcccattcagtatgattttggctgtgggtttgtcataaatagctgttattattttgagatacgtcccatcaatacctaatttattgagagtttttagcatgaagggctattgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgaggatttttgcatcaatgttcatcatggatattggtctaaatttcgctttttttgtgtgtctctgccaggctttggtatcaggatgatgctggcctcataaaatgagttagggaggattccctctttttctattgattggaatagtttcagaaggaatggtaccagctcctctttgtacgtctgaggtagatgttttaaaaccccatttaaagatgagaaaacagaactggacaagatacataacctcctaaatcttcacagctacacagtattggagctggcatttaaaatcaactgggatatttggcctgtctggtatattttaatgtctactaaattctcagacaaatctccaaaaacctttttcttttctgtggctaagtctatacaagctaagtggaatggagacctgaagtaactatctggagataccaagatccaacatattagcttgtttttaaaaaaacaccttttaaaaatttaataaaagtcactctttcaaggtgaactctgcagctcttttttcccgtcttaaagatttagatgccgaagttatttcaaatactttttacattgaagatttacacataagtatgatgttttaatggaaatgaaaaaaggcgctagagaaaagattcaggttttcttttttcaaataagaaaaatgaggaccttaactgtattttaatttctacccccttgtagactgcatttttggtacatacactatgcaaaatttgtaagaggccaaagaatcttgctccttttagaatgttggcatttgtctcattagcagttagttgcattgctttgaccaattgtgacctgtttctataaatgaccattgctttttgctgcatttggtaagtgtagacacagcctttggagggtaatataaatgagttcaggcagggcatctcttgtaatctgggaacagaggagccagtgaaataaagatgctttctttcaaaaaccaagggaggagtcctagatgaaatgaatcctgaaggctattcttattttgggggctcatcatgaagataataagaatccattttgttgctgaaataaccaaataagagtggcacattcccataggagtgaccattctcttccttttggaaggggcagctttagaaaagtgccattatgcaaagctgaaggccataaaaaagtgccattaaagagaatgcaaattagcatgggcctaccagcctggcaggcattattaatgttggaggtaaagaaattaggttgaaggtatggaagaaccataaaaaaacaaccagaggccagtgtgacattgggctgatggccacttaagctgatgcctcatggctgagactttgctaagtggaagattaactgacaaaacagcttgaaggttgacgaactatttgagctcattgccagatactctagaggcaaaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcgaccacaaaattcagctcttctgatttgctaggatctgactccaggatgcagtactttctggttaacagagggggctcttgtatgcagtaaacctcccaagatggagagatgtggtatcagctattttcattatagccatcttaggagtgtgaagttgtatctcattgtggtattgatttgcatttttctgatggctaatgatgttaaacattttttcatgtgcctattgcccatttgagtatcttctctggagaaatatctatacaggttgtttgacattcttaattgtgttatttctttttctttttaatattaattggttttttttaaacatattctaggttcaagtctcttataagatatacgctttgcaaacattttacccccattcagtggttgttgcttcactttcttgaaggtacccattgaagcaggaaagttttaaattttggtgaagtccaatttaatttttttctttgtcacttctgaaggctttgcctagtgttcacaaaaatttactcctatatctgcttttaagagttttatagtttaaccttttacagtaaggtcaatgatctatttcaggttaatttttgtgcatattgtgaaaaaggagacacacccataagattggtataactttatccttttttatttaggtaatatttgtcccagaatcctttgttgaagactgtttttctttattcattttccttggtaccattatacaaaaccggttgatcataaatgtttggatttatttctggattctattttacttgtctataaagctatctttaatcaagtgacacacagtcttgactactgttgctttgtagctagttttgaaagcaggaagtgcgaatcttttatttattttttctttctctagattgttttggctattcttggcaccttgaatttcattgtgaattttagcatcagcttatcaatatccacaaagaagccggctgggatttttttagggattgtattaaatctgtagatcaattttggggagtattgccatatggacaatattgtttttcaattcaaaaacatgggctatttttccatttgtttaggtcttctttaaattctttcagtgctaattttgaagcctttagattgtaagttttgaatttattttgttaaatttatttaaaagtattttactcttttgatattattgtaaattgaatttttttcatttttggattgttcattgctactatataaaaagatagttttttttgtttgtttgttttgcaacggagtctctgtcggccaggctggagtgcggtggtgcaatctcggctcactgcaacctctgccccccatgttcaagcaattctcctgcctcagcctcctgagtagctgggattacaggtgcacgccaccatgcccggctaatttttgtatttttagtagagatggggtttcaccatgttggccagtctggtctcaaactcctgacctcaagtcatctgcccgccttggcctcccagagtgctgggattacaggcatgagccactgtgcccggccagttaatttttaaatattgatcttgtatgctgcagccttgctgaattcatttttaagttctaatagtttttcagagtatccctcaagattttctgtatacaaatgatagagtttggatgtgtgttccccacaatctcatgttgaaatgtaatccctaatgttggaggtggggcctggtgggaggtgtttggattatgggagcagatctctcatgaaaggctcagtgccctccctgtgataatgaggtcacatgacatctgtttgcttaaaagagtctagcacttccacctctctctcttgctccctctcttgccatgtgacacactggcttcccttcaccttccaccatgattctaagcttcctgaggcccttgccagaagcagaagccaacactatgctagctgtacagcctgcagaactgtaagccagataaacttcttttttatgttacccagtctcagacattcctttatagcaacacaaatggactaatacaacatgcttatgctatctgtaaatagacactttaatttcttactattcagtgttgatgaattttatttccttttcctgccttacttccttggctaaaatctccagtaaaatgtgaactggaagtggctataatgaacttctttatcttgtttttgatctcaggggaaagcattcagtctttcattattattattattattattatttgagacaaggtctcactgtcattcaggttgggatgcagtggcatgatcacagctcactgcaccctcaacctcctggggcttgaggaaacctcccacctcagccttccaagtaggaagaactataggcaaggatcactatgcctgactaatttttaaattctgtgtagagatggggtcttgctatgttgcccaggctggtcttggactcctgggctcaagtggtgtactgcctcagtctcccaaagtgttgggataacaggtgtgagccactgttctctgcccagtctatcactattaaatatgtgagctctaggtgtcttttatcagattgaggaagttctcttattcctagtttgatgagtgtttctttaaaaaaaaaacaatgaatggatattggattttgtcatgattattctgcatctcttgagataattgtgtttttttctctttattttttatttatttgtttttttttttttgagacagggtttccctttgttgcccagggtggagtgcagtggcatgatcatggctcactgaagcttcaacttcctgggctcaagcaatccccccacctcagcctcttgaatagctgggactacaggtgtgcatcactattcccagataattttattttttattgtagagatggggtctcactatgttgtccaggctggtctcaaactcctgcgctcaggaggtcctcctgccttggcctcctacatgctgggattacaggtgtgagtcaccacaccctacctctttattctattgatatagtgttttacattaatttactcacaggtagtaagccaacctcgcattctcttgacaaatcctacttagtcatggtgcataatctttttttatatattgctggattgcttagattttcttctagtattttcatagtttcaggtcttaggtttaagtctttaatcttgagttgatttttgcacatgatgagggctaagggtccagttttattcttctgcatgtggctatcaaattttcccagcacaagttattgaagagggtgcccttttcccaatatatattcttagtgcctttgttgaaaatcagttagatgtaaatacacagattttttttctgggttctctactctgttccattggtctatgtatctgtttttacagcaatgtcatgttgttgtggttactataactttctagtataatttgaagtcatgtagtgtcttgcctccagcgttgtcctttttgctcagtattgcttcggctgttcagggtcttctgtagtttcatacaaatttcagaatttgttttttctatttctatgaagaatgttattggtattttgacagggattgcattgaatctgtagattgctttgggtagtgtggacattttaacaatattaattctttcaatctatgagcatgtgatgtctttccttttttgtgtcttcttcaatttcttcagagttttattgtttttattttacttccttgattaaatttattccttgttattttatttttttgtagctgctataaatggaattactttcttgatttccttttcagctagtttgttaatggtgtatcaaaacactgttgacttttgtatgttgatttttgtgtcctgcaactttactaaattcattaaatagttctaagatatttttgatggagtttttagggttttctatatataagacaatgtcatctgcaaacagagacaatttgactttctctttttcaatttggatgcattttctttcttttttttttttctttctcaacttttattttaggttcaagtgtacatgcgcaggtttgttagatgggtaaattgcatgtcactggggtttggtgtacaaatgatttcatgacccaggtagtgggcatagtatctgacaagtagtttttcaaccctcatcctcctcccagtctccaccctcaagtaggccctggtttctattgttcctctctttgtatctaagtgtactcagtgtttagctctcacttataagtaaggacatgcaatatttggttttctgttcctgtgttaatttgcttagaataaatggcctccagctgtatctatattcataggagacattggtctatagttttcctgtgatgtctttgtctgaatttggtattagagtaacactagtctcacagaatgtgttgagagatattttctccttttctatttttttaaagagtttgtgaaagcttggtgttaattctttttaaatttttggtgtaattcactagagaaacatatgggcctgggcttttctctgtggtaagttaaaattatttatttgatcactttactttttatagttcaattgagttttttatttctttgtgagttaatttcagtagtttattgtctttctggtaacttgtgtgttctttccaagttatccagtttattggcatgcagctgttcatagcattaccttataattcaatttattgttaaaggatagtattaatgtcccctctttcattcctgattttaataattgagtcttttctctttttgttcagtataagttctgtttatcaattttgttgatctcttcaaagaatccatttttgttttcatggaatttattattctttttcaactctcaattccctagaatctataatatttcttttcttctgcttgctttatgtttagtgtgttcttcccttttcagtatcttatgatataaagttatattagtgatttgaaaattttcaaattatagttgtaaatgcctatattttcaaaaagaaaatatttcaaatcgcttcatcccataagctttgatatgttttgtttcatcccataggttttggtatgtttggtttcattttcatttgtatcaaacaattttctgatttcctttgtgattttttccttgacttattggttattttgcagtgtgatgtttaatttttcacgtttgtcaatttcccaaatttccttctgtaaatgatttataatttcattccactgtgattggagaacatacattgtatgattcaactattttaaatatattgagacttcatgaccagtctgggcaacatggcgaaactctatttctaccaaaaatacaaaaaattagctgactgtggtggtgcacacctgcagtcccagctactctggaggctgaggtgggaggatcacttgagtcctgggaggtggaggttgcagtgagctgagattgtgccactgcactgaagcctaggtgacagagtaagaccctagctggaaaaaaaaatatgttgagacacatcttgtggcctaacatatgctctatcctggagaatgtctgtgtgcatctgagaagactattttgctgttggtggtggagtgttctatagatgttgctaaaacttggtagtttattgtgctgtttagacttctatttctccattgatctttttctagttgttccaccattatttaaattgggataatgaagtctccaattattattattgaattatctgtttttccctttggtcctgtcagtttttacttcatgtgttttagggatctgttgttagctgcatatatatttataattgttttgttttcttgatgcattgtttctttatcattataaaacttctttctttagtaattttgtaatatttattttctctgatattagtatagccattccatatttcttgtggttcttgtttccatgatatcttttctcttctttttcctctccaatgatttctatctttttctatctataatgtgtgtttcttgtagacagcaaatagctggatcttgtttggtttttatttcattctggcagtctgtgccttttgattggattgtttcatccatctacatttaacaatattaatgatatagcttgatccatcttattttgattttccatatatctcatgtcttttttgttcccctattgctcctgtactgctttgtcttatattaagttaatgctttccagtgtaacattttaattcccttaatgattttctactgtattttgttgttattttctcaatgtattctctagggcttaatctatgtatattaaattatcagaatctacttcatatttatagtaacttaattacaataagctctttaagtgttttcctagatagctctgtttcttcttctctctttttgtgctgttattgttataaattttacatctatacatgttacaaactcagcagcacattgttataattattacttaatgaaattttatgtcttctaaagaaggtaagagaagtgagagaacaagtatatttattgagtttcttataaaccaccttatgtaccattactggttctgtttgtttgtttctgtgcatttaagttaccattttgtatttcctcactccagtacagccttgctccaacacatttcttttggtttgttattgtcatatgttaaatgtatatattttatggtcccaacaatacaattatatacctatttttttattgcttttcaaagtttgttatgagaaaaggggagtaaatatgcatttatactgtattttgttattattacattattattttattattacattattatcttcaaatgagctgattttttctttcatgtggacttgaattaccacctggtcccacttgctttcagccggagaatttttctttattatttcttgtaatgcaggactgttagcatgagattgtctcatgctaacatgagatactttgttttctgtgaatgtctttatattgctttcggttttgaaaatacttttgctggatatacaattcttaattattggtttcttttcctaagcatgttgaatgccatcccactgcctttgtcctctattgtgtctgatgagaagttagctgtcagtgttattgaggttcctctgtgtgatgggtcacttttctcttactgcttttaagaatttctctttctctttttaacatttttagtatggtatgtctgtgttaggatctctttttggttatcctacttgcagttcattgagctacttgcacgtgtagattaatttttcttccagcttagagaaagtattagccattaagatttttttttcttttctgtttctttctctttctggtactcttccattaggtgtattctggtgtgctttttggtgtcccatatttctctgaggttctgtccatttttataccttctttctctctctgttttcagattgcgtaatgtctactgaaatatcttcaaggttgctgattatttatcctgccagctcaaattgtctgcggaagccttgtagtaatttttttttaaattgagacagaatctcgctctgtcacccaggctggagtgcactggtgcgatctcggctcactgcaacctccgtctcctgggttcaagcagttctcccacctcagcctcccgaatagctgggattacagacgcatgccaccatgcctggccaatttttgtatttttagtagagagggggtttcaccatgttggccaggctggtctccatactcctggcctcaagtgatctgcctacctaggccccccaaagtactgggattacaggtgtgagccactgcacccagcccttgcagtaaatttgtaatttcaattattcttttcaatttcagagtgttcattagtttcatttttataatgtctatattatataacatagacattatattatagaaaatatatatagaaaaatatattatatataaatatatattatagaatatagaatatatatagaatagaatatatattctattctaaatacagaaatatatagaaaaatattatatattatataatatagacataatatccttttatggatattatatatttaatgagacattgtcattataccttcctttacttctttaagtatggttttcattagtttcaacactatttctaaaggctactttgaattctttgttaagtctgacatctgggctctgtcacagatagatcccattgcttgcctttttctcttgtgtatgggtcacgcctttctacgtcttttcgtgtctcataatattttgttggaaactggaccttttgaaactctggataatgattctcctccaccttcactgggttgtgtatttgttgctgtttgcttatttattctgggacttgtctgaactattttactaaaacctatttctcccctgtgtgaatcctttgatgtcagagggctgtcttgggcatgtgcagagtcacagtgggataacagttttagcagggatttctttgggtctttccctgatatttctgttaaacagtctgtctctgttgttatcatgtctatctgttggactccactaattgttgggtgattgctgtattgtttttgacagtgtcctggggcatcaattgctccacagtctgatcagatttggacacttttgctggggtattttttttttttttttgaggtggagtcttgctctgtcacccaggctgaagtgcagtggcgcaatctcggttcactgcaagctccgcctcccgggttcacgccattctcctgcctcagcctcctgagtagctgggactacaggcgcccaccaccacgcccggctaattttttgtatttttagtagagacggggtttcactgtgttagccaggatggtctcgatctcctgaccttgtgatccgcccaccttcggctcccaaagtgctgggattacaggcgtgagccacctcgcctggccttgctggggtattttttgaggccagtctttgagatttgttctaaccccaaaagggctcttctttgctggttctttttctggttatctaatgttagctttcctatgatttagcttgtcactgttacacatcctcttaaatgcttaccaccaagatttccatttttttctcagaggacctttagggttttactttcccttatgctataataaaaagtcagttcctttggggagagctttggaactctctgttttatggcttgcctttctgttggtgtacagtgtctgagccattgctttggagttggaggcaaggacaggggtcttgtttctctcaaaatgacactgcttcttttctagctgggtattcatggagtcagtatcctctggtcttctcagtttgcctctcctgatatggagcttctttgctgatagcgagctacaccagtggtgactggggggtccagtgttgttgctctgctatgcctgaagtacagtctccatcctataactggagacattgttgaggaagggagcccctgtcttcttggccatgcttgcctggagtttagcctttgcaacaaagagctgatgttgatgagaattctggaggccttggtctcctggggagatacatagctcttgactgggagctaggaattgtgggtatctcctctttttgtccacacccacctgtactggtcctgctgtgtgaaggggagggagtagatcatggctcaagtgctacagactctccctctttctaccaaaggttagtagacttccttgaataaatctttccttatttgctatatgcattaagaacatttccagagacagtaaatggctgctttagaattttcaccggtatggttgttttactggggagaggcctgcagagctaagtcacaattttcttggttttaggtatgatggatgatttttttttattggctccaagacatattatacattatgttcagggatgctgggtcctatttaaatcttttattttagcaagcagtctccctgtttaggtttagcatataggtcttggcctactttttttgtctgtggttccactgtgagtttaattttcacagcatttgtgttgttatttaggtctcctctgtttatttagtattattggacttttcactggtctctcttagtgctgcctaaggaagccaaggactttccccaagccaagcccttgggtgtcttttggtgggggagggttgtattgagatcctcctaatagtattatccagcctggtgtctcaggtttggggaggaaattcttgggtccatggggactaacaggcctcttagacccatatacttgctgcagttgtctcttttggtagctcttccagcctgcctcaatgtctctggtcaggggaggagagtgtcaggccaatagggacaaagagcctttccagtggctgggcgcagtagctcatgcctgtaatcccaacactttgggaggccgaggtgggtggatcaccagaagtcaggagtttgagaccagcctggccagcatgacgaaaccctttctctacaaaattaaaatacaaaattagccaggcttggtggcacatgtctgtaatcccagctactgaggaggctgaagcatgagaatcacttgaacctggaaggtggaggttgcagtgagccgagatcatgccaatgcactctagcctggacgacagagcaaggctccatctaaaacaaaacaaaacaaaacaaaacaacaacaacaacaacgaaaaaagcaaagcgaaaaaaaaaagcttcccagaatgggctacttgccacaattgggtctcttttattggttctgcccacccaccttgatgcctctgggaaagggaagagagtcttaggctcatggggacaaaggagcatcctatatctagctgttaggtataactgagtccctttttcaatctccgtctgcttatcctgatgtctctgggggaagaggggtcttgagtcctcgggggacttcctgaaataagtctcctagctgtggttaggtcctgtttgcttaatttggttttgtggaccttttgcatatccttgttgtttttctctctagtttttctatcagttttccagagaggaggtcgaagtttctaactataactgtggatttgtctatttctccttttagttccatcagttttcactttatatattttgcatttctgttgtttgttacacacacatttagaatggctgtgtgttcttggttgattgacccttttatcattatgtaatgtccccctacattcttggtaattttgtgttccaaagtctactttatctaatattagtatagctacttattgctttattttaattgatgcctacatgatatatctttctatttttcagtgccttcttttgcttgttttatgtattatgtcaggctggagtacagtggctattcataggtctgatcacagctcactgcagcctcaaattactggcctcaagtgatccttccacctcagcctcccaagtaggtaggacggtaggctcacaccatggcacctggcttgtcatgtgtgttttctgtaaaatctagaattagttggaggaatagagagaaatgtgtatactctgtcttgtccagaaccagaaatctagttcacctatttctgttttcttgaatgatctgggttggctttttaagtctttgaggctccgtgttgcactcacctaattttagctcaataagatcatgttactgagtctactactctgtacatcaagggctgtagtggctcaattttttttttcaaagatcaaattttcaaagtccatatatttttatcaaatatgcccttagccttttgttgctttggttgcatctgtccctccactgcctttgtaggcatttggttttggagagttgcaatgatgtatgatctgcaaatctccatctgctgcctgccactgactcagcatgaatagaaacaaaaattgactataaactggttgacaccaagatagacctaataacatggcttatttgtatgaagttggactctgctattaattcattcagtatgaagtgcttactgtgtgccaggatctgtgttaggtcctggggttacagagctagcagtgccataggtactgattttggagagttcatagactactgagaggagacaatcaaatagggtattcggtgctatgataaaggtgagcacaggttgctgtgacaatagagaacaagggtactcaaattagggtaggctctgttgatggaagtgacacctgagttgagtccctgatatagtttggatatttgtctctgcccaaatctcatgttgaaatgtaatccacaataattggaggtggggcccggtgggaggtatttggatcatggaggcagatccctcatgaatgccttgggccatccacttggtgataagggagctctcactctgaattcacatgagatctggtcatttgaaagtgtgtggcagctgggcgaagtggcacatgcctgtaatcccagcattttgggaggctgaggtgggagtttgaggccagaagtttgagaccagcctgaccaacatggtgaaactccatctctactaaaactacaaaaattagccaagcatggtggtgtgtgcctgtaatcccagctacttgagaggctgaggcaggagaatcgcttgaacccaggaggtgcagtgagccaagattgccccactgcactccagcctgggcaacagagtgagactccgtctcaaaaaaaaaaaaaaaaagtgtgtggcaactactcttgaccactgtctctctcctcctcctgcttttgccatgtgacatgcctgctaccctttcaccttccaccatgattggaatcttcctgaggcctccccaaaagccaagcagatgctaacactctgtttcttgtgcagcctacagaaccatgagctaattaaacctcttttctttataaattacccagtctctggcatttctttctctttttcttttttcttttcttttcttttttttttttttttctgagacagggtttcactctatagcccaggctggagtgtaatgttgtgttctcttatcactgcaacccctgtctcccaggcacaagcgatcctcccctctcagcctccagagtagctggaactacaggcacatgcctggctaattttttgtatttttggtagacacggggttttgccatgttgctcgggctggtctcaaactcaagcatttctttatagcaatgcaagtatggtccaatgcagtccccaaggatccataaccagtcaaggattgggggaaaccttaggaagcagcatgagtaaagggagtttcaagaggaagtgttgcttgtacttatgggctagaatgagatctgtgacctcagaatttgatagaaaccaggacacctagagcccagtaggatatgcgacatattttggactttagtctgagagcagtgagaaggcattgggactttttaagtagaggagtcatttaatttgatttgtgtttttactgaattcctctggcttctgtgtgaaggggctggagagtggcaagaacatggcagtgagttagaaggctgcagggagcagcccagggagacagggttgtggcttggcttggggaagtgattgtggggatgcagagaggtgaatggattcaggaggtttaggaggaagaacagaaagaatgctgcgagtaaaagatatagatggtagggatgagagtgaggaagcaaggaagtttctgccaaggattctgccttgagaagactggagaagctgtgataagcagggcagtgggagagagtctttgtttacatgtggaatttggggagactgtggagtcgccatgttgagatgcccacgggcagtggatctgtggatgggggggctcagtactgcagacatagactgggagggttttttgtttgttcgttttgttttgtttttgagacggagtccccctccgtcacccaagctggagtgcattggtgcgatctcagtttactgcaacctccacctcctgggttcaagtgattctcctgcctcggcctcccgagtagctgggattacaggcacacaccaccatgcccagctaatttttctatttttagtagacataggttttctccatgttggccagactggtctagaactcctggcctcaagtgatccacccgccttggcctcccaaagtgctaggattataggtgtgagctactgcgctcagccagactgggagttttgaggtgctttgtctcatttatctcacttaaaataatttcaaaatatgttaaaaggaaatgttatttgcaatgcatagacaggttttcctcgctagttgctgaggataaaatccaaacaactggacctaaacagacaggattggaagaggctgttctggaccaaatgggatgctaaaccttagaatggattgacaagagaaggccatgcagaatggtgagaaggccctacttacctcagcccagcttcaaggccctaagtgagggatacctggaatgcctctgaagactggcatttggatgcccattccttcccattgcagttgccaagcccaagagcagtggagaacaactgtaccttcttgtcatgaagtgtgtacaccggaaaaaagtaaatgcttgtattttctttttcctctctttcttttctatatacagctctccaaaaacgcagatttctctagatcacagttgttcgtggagaagtgagagtgacaattttagagtaaaaaatttaatattgtgggaattatctctaaccagtcaaattactaatgaagatatttattcttgggaatctagaatcagctatttaagctttctaggatctggagtcacacagacttgagttcacatgatggctctttcacttaccaatcatgagactttgggttaatcactgcatctacttctgaccttcagtttcctcatttgtaaaaggagaatgctacctcatgggactgttttgaggcccaaatactgtatgtaagtgagagggctttataacgtataagttgctctttaaatgttatttaatcattatttagcttctggtttcattctattaataacattttaaagtgttattagaaaaattgtaagattcttgctaatattaaaatatgttgctttatttaaaagtaactcctaattcatgcccacctaataataaagaatatcattaggtggctgtaaacaaaaaaatcaaacagttctttctttcctctatacactcacacacttctggtcatcaaaatgtgtgaatttttccgacagagaccaatactccgacactagctgggtgtcttacaattcaattcagttctgaaactaaccagcattagtgcaggccccatagattaagagctcagtcccacaagtctgccccctccccttcagacatctatctcaagtcccaggttgtcacctgtacttctggctgtaaatcaaggtttccacgaccccctccttgggtttgacaatttgctaggacagctcacagaactcaaggaacacttgcttacatttactggtttattatttaagaaaggatacaataaaggatacagatgaacagccagatgccaaggtacataaggaaaggtatgtggggagggatgcagagcctcttgtcacctccatgtgttcaccaatatggaagcattctaaaccctgtctttttggggttttgtggaggcttcattaggcaggactgattaaatcatttgtcattggtaataattcagtctctctttttatcttttgttttgagacagggtctcaccctatcacctaggctggagtgcagtggcgcgatcacagctcactgcaacgtctgcctcctgggttcaagtaatcgtcccacttccacctcctgagtagctgggaccacaggcgcacggtctcactttcttttccaggctggtctcgaactcccaggctcaagcaatcctcccacctcagcctcctgagtcactgggactgctggcacacaccacgacacacggctaatttttgtttttcctagaggcggcatttcgccatgttgcccaggctggtctggagctcctgagctcaagcgatctgcctacctcagcctcccacaaagtcctgggattatggacgtaagccaccatgccccgtcaacaactcaatcttaaacccctctccctttcctagaggtggtggggctggtctggctgaaagtttcaaccctctaatcacatggttggttcccttggcaaccagccttcatcctgaggctatccaggagcccccagccatcagtcattcattagcacacaaaacatctatcacttcagagattccaacagtttttggaggaatgaaaatcaaaatatatatttcttattataaatcacaataccacagtgattattggtatgtatgcttttaattttaggctaagcgaggattgattctattcaatttttccctcaggcttataggaacacatttaagggcatctgttgatgactcattaactgtttcaaacctaaaatgtgtcaaatgctgtgactttgcaactattgttgctcttccctttagcacgaaatactttaatgatctcaagacatttatattatcagatttttgcatatattcactaaaatttggttttattaatggtctcgatgtgtcccataaatattcctggtttccaacttgagctggatttattaggaagaggcaaaatttagcttatgtgccatacctgaaggaagttacgtatcgtagcttgtgatgctgtgggacagctaaagaacaagcctttacctggtgacagattttaactggggaatagttattgtaaaaaatattttcattttttttagactacaagatatgcgggctagcattggatgcttgaaaggaaaattacatttttgctgaaatccaggcaatgcaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaaaataaaatgctgagacctaccccccaaccatctaaatggacttcctcctcgaccaaggcactcttaaaatttaacttgaaagactggttcaagtcatgacaggttgtggcagtgggacatgcctcatgattacctctctggcattaacatcaacacagaccttaagtctgataagaagcatttacaatctgttctcttggaatcttcctacctggagacttcctctgcacaataagaactttggtcttcataatcctttatcttaacccaaacatttcctttctattgatcctaggcctttatttagataaactcaaccagttgtcaaccagaatttttttttttttttttttttttgagacagagtccagctccgtcacccagactggagtgccctactgcaatcttggctcactgcaacctatgcctcccaggctcaagcgattctcatgtctcagcgtcccaactagctgggattaaaggtgtgtgctaccacgcccggctaatttttgtatttttagtagagacagggttttgccatgttgggtagactggtctcaaattcctggcctcaagtgatccacccgccaaggcctcccaaagtgttgggattacaggcgtgagccacagaaaaattttaaacctacctataaagccggaagctctccccttcaagttgttccgcctttctgaaccgaaccaatatatttcttaaatgtatttcattgaaatcccatgcctccctaaaatgtatacaaccaagctgcaccgcgaccaccttgggcacatggtctcaagacctcctgagggttgtgtcatgggccgtggtcactcctatttggctcaaaataaatcacttcaaatatcttacagagtttaactcttttcattgacactctgccaaaaggagccctgaaatgttggtcagatttggataaggaccatggccatgtggcttaaatggcatttgctcgcttgttggtaatgagttgcatttgaagaggtggaataaatggagacaaccggcatcattgggcacctgtggacaaagaaaagcctttttggttgagccaaggtgatactatccacatctgcctaggaagttgtttttttgtttggagtagctgggactacaggtgcccgccaccacacctggctaatttgtttggttttgtatttttagtagagacggggtttcaccatgttagccaggatggtctcgatctcctgacctcgtgatccgcctgcctcggcctcccaaaatgctgggattacaggcgtgagccaccatgcccggccctgcttaggaagttttttgaaagagtgtttatttgtgaaaatgaaggtgcttctttatgtctatagctttctggctttactcctttcagagatttgacttgtaaggcaatagatagaaatgatagctcatcagcatctaatgagccaaattacttactccataaaatattatcctactttctaactccaaccatacaatttgaaggaaagaagcccaggggtcccgattaagccattgacatgtctggctgaaggatgatatgggcttctcattgactgagccaacaacatgacctgcccaggcgggatccgggctgactcctaactccaggatgaaagcaggaaggtaaacagtctttgggtaatttactcaaattgtagccagtgaatacctcaagcatggcactcaccatgctgtagtgtaattgcctggcttttgtttttgttttattttgttttacctgatgggagctctctaatacttcaaacatggcacttaccatgctgtagtgtaattgcctggtttttgtttctgttttcttttgttttaccagatgggagactatgtctttcatgtctgtcttcccagtgtctttgtccgcagtaatcaattattgtatgttgaataagcaaaattataatttttaagcaccataaattcaacctgccaaaagccaaatccaattttttgtctttcaggggatggcacaatagccagcttttcaggaacctgagtgttttccaaaccagcacttttcaaacttaactatgcacatgaatcactaagttttgtgaaaatgaagattctgattcagtaggtcaggggtggggcatgagattctgcatttttaacaatctcccaggtgaggctgatgctgttggtctgcagactacaccttaagtagtaaaggtctagaccctggtctctaccttatctccaaaatttaatccatcaccaagtcatgttgtctccatctcctttgtcccaactcatgtctgtttctgttgccaccactttagctgaagccttcatcatttcactgcagagattattgcaatagctttcatgtagtctacctgctctttattctccactccactgtctatactgcagccaagatgatatctctcaaatacacctttgggcatgtcaatccattgttaaggggctttcaatgtaggataaagtaacagaccttctgtggttagattgcctttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctgtcctgggaatgggatgcagtgccttgggtggtttcaggagattgacacacttccaggaccaggcattttcatttccaccttaaagaaggagcctgctgtgctttctgagacctactgtatctgggatggccagacttcaggagacaagaagaggaaggcatcctatccttttggtgggtggatggacgggccgaatctatctcagaaatttttaatttttacttccatgtcactttccagtcttcagccagccccccaccgtctacctcccactgctggagtgtggcttcattcaggggagaatgctgagctctgttgacatttggtagaatttgttttcttccctctttaatttagcaactaatcacgggggttgttctttgttcatctttccagggttttccgtacgctgactaatgcttacagctggctctctctggagagaagtgctgggaagatcaatcaaatgaaatcttaaagggtaaatcaggttttcaaatgtgttcaggcagctttaaatcgtttcagtgagaagaagtgcttacaagggcagaaatttgcccagcgaaatgcctcccaatggcaacagaacaatcacaccttggatggctgctttgtagcctgagtgtccagttcttctgagatttccaatggccatttacaactcaagagtgagggacaaaatgaagtgcatttgacttgaaggaattcactaatgcaagatcaaagttgtaaaaactgtaccttaatatgctctatcaaagggctgtatgcagatgttaagaaagggaagctgcacaaaatatcccttttcaataatttcacattttctttagtttttcagctcctataaatctcaagaaataattaacatgaaacctatattatgtttcaggaaaaactccagagagtctttcttaggcttttggaagtcagtgatgctgttttctgtcttcttagagaagtcctaaaatggaaaaattttatcatggaaattgacccattcagagcagagagtttatgtgactttatggtacaggaaatttgaaaatcgcatctcatcttttattttctattgtcatgttaaactatggttgtgcctatgggattaagtgaatattctagccacttgcattaaatgattagccagtcttttcatagtgacagttggttgtatgtgctgctagtcctgcagcggtctagtctgctagtggttaactatggagaattggtcagaggagtccctccccctattatacacatctcattaaagactctctgccactgccaaaccagaaaaggcaacttatttcacgattcattaaagaaaacataattgggaaggtaattttgtaaagtcatcatcaaacatagtccaccacccagtaggaattatcctctcattatctctttttctagatagtcattgacattgttcccctctgttagcatgaataattaaggactgagcataaagaagtggtgtggacctatggtcaatctgaaggtgtcatcagaagagttagcagggctttcttgccttcagcaggccatttattctgagctaacctgccaattgtatttagaacagggaccattaacagggtgactgtttggctggctgtcagtaggctgtggggctttttccagagcaaatagagaagccagctgggcttcactaagaccacccaggaagagagatcatgtcccacctgatcacattccaagcaggtagcaaatgggctccagttgaattgtacttctgaaggctttctgaaggggtaggggaaaatacctcccatcttagaaattatggctgctagtgtccagtttaaaaaatttctggccctcagcaccaagtgtcttagctttttgtccatctatagctgtcagaaagacacgctttgtcttcctggcaaaactgcctctcaaggtctatgccatcattatggcttggtttaatcaagctaccagggttgcccctgtgtctctcatctggctcttccagaagggacagtttgggaaactttcagagattctgaagatttcatagggggagaccacacttaaggaataagaccctccacacattgcagtgagagtgacatgttcattgccaccaaaagaagcccctctgttaaaacaaacctgattccaaacagagctaaggttgcttgggggctccgtattgtaaggcctatgggcatgcaatgaaataggagttgatgtggactctgaaccctgaagaagcagtttaaatcactagcactgctgtttattagctgggaaattttgggcaatctatttcagttgtcaggtcttcagtttcatcatctctaaaatggggaggacagtgcctgtctttttacactcctggacttgtgttgaggagatcatggataaagtgtgttgcacacagtaagggtagttatcatggttattaaccacactgcagctaattgggctctagctaccccatttgtccctggtcaggcaggcccaggactttcttaagcttttctcaccttaaagcggaaacacattccctctcctgtggggtcacgtggctctgtttaaatgtggctctaaatgagatgtgtgccttttgacaggtcaccttgtaaagatacacagcatttccaaccatgtaaaggtggctctaacttcttgaaatcctctctttgagaactgcctttagagctggtcattttagtcacaaaagaaacatctttcaacagggtcttttttttttttttgagagggagtctccacccaggctggagtgcagtggtgcagtctttgctcactgcaacttccggttcccgggttcaagcgattctcctgcctcagcctcccaagtagctgggactacaggcacacaccaccatgccccgctaattttttgtgtttttagtagagacatgatttcatcatgttggccaaactggtctcaaactcctggcctcaagtgatccgcccgcctcagccttccaaagtggtgggaatacaggtgtaagccaccatgcccagcctcaacatggtcatgttttgaatatgcttggacagaaccttgccaccatttctcatagtcatgtgtatggtatttaaaccatagaatgtcagatttgtaatgccccctagaaatcttctagtccagtagttttcaaactatgttccccagatctcaactgtttggagaagggacatcaaggtcagggaaaatccaaagcaccatatgttcttgatgctaagatgccattagttgtagtttgcaccatcaattaatactggcatttcaggaatattaaaagaatgtatgcagtcattctaagacccatccttattttagatatgaacttcaattaaatacagtattagggttctctggaggaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtcccagactccaaaagctgaagaatccggagtctgatgttcaggggcaggaagcatccagcacaggagaaagatgaaagctggaagactaggaagtcagctaattccaccttcttcttcctgctttgttctagccacgctggcagccagttggatagtgctcacccagattgagggtgggtctacccataacactctgctgactcaaatgttaatctcctatggcaacaccctcacaaacatatccaggaacaatactttgcatccgtaatccaatcaagttgacacttaatattaaccatcacactgtccatcatcaaattaaagaaatataatgttttctgttaaacagtataattttacacaattgggtaagcactgtttcattgctattttatagattgggctaatgcctatggtttcatgtcacagatttctgctcctacagagtttgaaaattgacctaatctaacccatttcttctgtagaggtccagacaggagaaggtcatacagatagttagcagcagggctggggctagaactcaggcttcttgactgccactccagttctcttcacaatgttacagtaccttttgtctacagccatattgcataccagcccagctttcctttgccatgacttggtttgcatgcaggaattgtaaacccatcttattaaaagttaccaatgataggctgggcccagtggctcacgtctgtaatcccagcactttgggaggccgaggcaggtggatcacgaggtcaggagttcgagaccagcctgaccaatgtggtgaaaccctgtctctactaaaaatacaaaaaaaaaaaatagccgggcgtggtggcacacacctgtaatcccagctactcggggggctgaggcaggagaatagcttgaacctgggaggtggaggttgcagtgagctgagattgcaccattgcactctggcctgggcaacagagagagactctctctcaaaaaaaaaaaaaagttaccaatgataagaacattttatgttactatagcccttaacattttacagaacaattttatattctccttttccttacatctttaccacagcttgttaggtggagcaaggaggatatcatcatcatcattattatcatcattattaagacaatcacctccattttatggatgagaaaactgatacccagggaggataagcaattggctcaagatcatgcagacagttaacagaactgagaagaccatccgtgggtcctgatttactcattcaatgttgttacacattaaagcaaaacataaatctaaagatacgtcttgaggaaagagttattcactagaagcttgcaagaacatcattttattgctgaaagcagctcaccttcaccagggacgttgagtcattgatatcccagaaaccccgtgtcattgggtgatttcaactacaagttggtgccatagcctgagccctgagccctgagccctgaggatggccttatactgagcattgggtgttttatcataacagagacagttaaggtttaacaatgggctaatggccgatggcagtgcttcctgcactgctagtgagagtgccaaaccaaggaggagctgaggaacagtccagtggctaatgtggggattagctgctgctttgggtaatctgtgtccagttcaggctggttacaggagagcctcaaggactcatttcacttggctgcttcttgacctgcaattttgcatgctgcatgctgcaattttccctttgaaaatacatctttccttttaaaaatgtggtgacatgtgacttctctgaagtttaaatgtttgatcatttttaagctggcacaaaaatggttataaatcttaatacttaaaaatgtaaaaggaaagcataaaccctaccaacttgtttggtcccttttgtgtgtttgagagagcaagcccagctcagcaggccctttggatgtccgctgaggttcagaaagcaatgatctagtcgcatcaagatattgaatcttctgaattctggccttgtgccccccaggtcagggctgttgtgttggttagatggctgcccaaaaaatggtcctgccatgcccctgagtttccctcttgtgaatgaatagaaagtttccatctacagagttggcaagctctgtgctgttaatttcacttagttaaaaggaaaaaaataactaaacacacaattattagtaaaccaccctgcagacaagtttaggattctaaagaacatttggtggttaggcttaaatgctgtaggctatgattacccttaattctgcacacagacaggcttcagagccagaagttacatgatttggtcttgtcagatgaggtcccctttttgccttattcacagggagattatggaggtggtaattgtcagtggattccaaaactccctggtcaatttaagcatttatatgtgggtttaataaaatgatgatataatacagaaagcacactgtcagggaaggaagtaactattagcaacatcatgacaccttaatctttttctccctctgggagagcagaatgggttaaacagaaggtttgcttttattattgaagcacaaaaaatcacatttttgtctaagttgtttagtcagtgagttttgtgtaattcaatggaaataattccatagtaacttagtaagtcagtattgaaaaggctgggtgaaaggacagcattttagagcaggcagtgggaagcctgagggagcaggagagggggagaggggctggttaatcagccgtcatatgccaggacaatatataatcctgtttgatttggtggaacaggccctttatgggtaacatattccccaatcccaaatcaggaactgtgaactcattttacttgctataacctcaatcctcataggactggggcttataaattgtggttgactaagtggggagggctgagttgtggaagatgccacctaagggtagtggggacaagcacttcaccaggaaaatcagtgacagaggatttttcagtgtaactttgccagctggagacctctgcagccagcgatggccatgcctggatctcactcaggccctgggcttgccacaggaggcaccctgctcacttggcccagggggctgtgcttggcttgcactcctgcccagatcccacacttgccacaggatccacactcagcctgcagctgggccgggcatgctgcaaccagcttcccccttgtgtgctgacatctggatgaggggaacacagtggcatctgaacagggatgccaacaacctcaaagccccagagggggtgttacagtgtgctaacagttgttttagtcccaccatccacagcctgagcaaacaggggtgtgttaacagctctttcagtcctgttgccctgctccagcccgcagccccagggctaggctggccctgctgctgcttcctggagcatgaagtggctgcctggcactggcggagggcagagggctacagttttacagccttctttgtacccacgtttggcaggttctgagttcttgtcccacatccaagaagaatgagggtacgttgacaactgaagtgtgaggagagttttattgcatggcagctctcagtagagaggggactcgagaggccagccctcgagtggtggtcccaaagtgtggctgagtccggggtttttatggactcggaaggggatgcacgctgattggtttgtgagtattcaaaaaaggctaaaacaagggcaccactcaaaggtgggcacgacagtataaaaagccaattagggaagggtaggtatatgtaaaataggtgaagggtggggatcaattaaaggaaagcatgccagatgggaagagaggttctcaattttgtccatggatttatctaggacttgtagcttggctttcaagctttaaactgtctatggtttgaaggtggggttttatcagggacttgcccctgtctgcctaagacttgtctgccttctgctgctatgagcagtacacagaggcaggagcaaaagcagaatagagccccatctgagccatgagttgggagattttacaatgggtcagtaaaagggacaaaatttatcaaatggaagagcacaaagatgagcatttggatttgtcaggaaagttccaagagaaatgttagcacaatcacagagggttaaattctgtaccatgaactacagatgaccctgactcctttgttggttataaaatacctttctagctccatataaagcaggatgccacagcctacatgtattaaatcatgcattgtattgagttgaattgaatggtatttgggagagggaggggatagcccaagtggtcccaggttaggaccaacactggggcagctgtgatcttgggacagaaatgtgaaaacacagactgtccagatgcagaacaggtgactttcatcaaatccagtccctccaatgaacataagaggaaactgatgccccatgaggggaagcaacttgtttcaggtcacctaccaggttagttgcagaacagacctaaagggtaggctacctaattttcaatttagtgtttgcttctctttaggctttattgttactttgcaatggagatcatacagatatgggtcaggagactcaagaggacaagtgatttgccccaggctacactagtgagcggcagtagccagtgtttgtctgattccagagtctgtggacgtaactacagggatatatgatagagtgttttgtggttggaggaggagagaattccttaagagtgtgtgctcatgaggccaggtgtggtggctgacgcctgtaatcccagcactttgggaggccgagacaggcagatcacgaggtcaggagatcgcaaccatcctggctaacacagtgaaaccctgtctctactaaaaatacaaaaaattagccaggcgtggtggcgggcacctgtagtcccagctactcaggaggctgaggcaggagaatggcgtgaacctgggaggtggagcttgcagtgagccgagatgggccactgcactccagcctggacaacagagcgagactccgtctcaaaaaaaaaaaaaaaaaagagtgtgtgctcacgaaaggcagctctaaagaggtcacatttaaactgaaatctaagggatcatgggaaagaattagccatagcaaagccaggggaagtccaggctgaagtaatcacaattgcaaagaccctgaggttgatttgtccctgggataaatgtccttgcctgatgatgtgcttgcctaagtcctttttttagaggtaattctttgacagacccattgctgtctggaactcccaatggacaattactgctttgttggtgtatctaattcaagagttagcagcagaggctcatgtcatgaaacttcccttcaagcttgtttgtctgctgagtttttggtaggagcaggatgggatcaggatggttagggggccaggagcggtgggaaggaaatgagttaggaatggtcttttatgtgcccatgagaccaggctactggtaaaatactgataaatatttcccctctaagttttttttttttttttgagatagcgtctcgctctgtcacccaggctggagtgcagtgctgcaatctcagctcaatgcaacctctgcctcccgagttcaagtgattctcctgcctcagcctccctggtagctgggattacaggcatgtgccaccacacccggctaatttttgtatttttagtagagacggggtttcaccatgttggccaggctggtctcaaactcctgacctcaagtgaaccacccgcctcggcctcccaaagtgttgggattacaagcgtgagctaccacacccagccccttctaagatttttaacatatgtcatgctgcaggattcctattccattagaggcttgtatttaccgaggcaaatggacgaaaggcaaggaaccagtactagaaatataaaaccatccctgtgttggatacgccctggaacaaaggaatataaggccaggattttactttctgccctggaactgacttccctttgactctgcaagttttactttcctgctttatgtctgataggcataaaatgcctaccattcttctttctaatacaattgtaatttcatcaatgggattagtgaaggcactaacaaaatctaaattctccatagtactgatcatcagggtgttctttagtagtgacttaaagaaaatcatgctctttgaaagaatatatataagttgcctttacattgctcactgagaaaagataatggagcccaaatctaggcttcttgttcctcgcctcccttttttttcctgggtgatcatacttttcaaggttatgttctttcatattcagtgttgaccatgcaaaactggtgaacaagaattggttctgggatgatttgttccagctataaagtagaaagcattttactaaaataggatgcttagatttgtttggatctacagtttattcttaactaaaattccaggaactgttggtaacagtctagattcatggcaaccagtttttacaagaattagaaagaaacgaataaaatgttctcattataaggttcaggaccgaatttgaaggctttcaggattccagatggcaaatggtagagcgaacgtgaaaatattagaaatttatgctcaatgatcatcatcttctgtccagtgaagaatgtagtttaagcaggatgggtgcgggcgtctgatgtcctcatttatttccacctctgtagctatttaagtgatgatcattcttggtggtggttaaattatgatgcacgaaatactatctccctaaggaccttgctacaggacagaggtgattacaagaaattgttgctgctgatgtaatgtttcgtataccaagattaaaccacaagatgaagtaatgtacattttttgcctttgaaatgcagctggagggaaaccagggtaagaactattgccaaatgaaatataatgccccaggaaaaatataagatactgtaaatgtaaaatcattacaaaactgaccatctgggtcatatattaaaccacagctttcaatttgttatggtttgaggaatgacttcacagtgtgtaccccttcctccgtaccttcctcagcctcaggaaagcattctattttcatgagtgtagaaaaaaaagtaatcttaaagttttgtttttaaaaaagagttccaatcaatagctcttaataaaggcacagtgtttgcttacttctttgcatttagtcctactatatagtcttgtgttgctaattccactttagctgtggcaaatataccagtgtgtagccaccgggccatgaggtaaattgaatccgtgtggagctgacagttgaaaaacctctgtctgcctcagttcaggaaacaagagcgtgttcaactcactttgggaaacccccaggcattaaaattttggcattttcatgttttgagagaactgaggagtagccctgttttgataatcatttaaaaatattttacttaattagagcagaatttgctcaggcagaaaatcacatttatatggtagccaggctgtaacacctcatagctacccattgtctctaatcagaaatgacagcctggtgactggctccatgctgggtgaagtccagcaaactgcaggccctgtaagtgcctaatcccaaacctgggcttccagtggagttggtttttttttttttttttttttttcagtggagttcttcaatgggtctggctttgaaatacttctatcctttctagtttaggaaagcaatggcacaagaaacccatatataagtcagctacttttttgatgtgtaattcacataccatacaatttcccatttaaaggctaaaattcagtggtttttagtatatttacgaagttgtacatccaaaaccacaatcaattttagaatattataattccccagaaaagaaacccctcactctttagccttcactcctagtctccccattcctcacacctctaggcaactactaatctactttctgtttctagagatttgtgcattctgataatttcacataaatggacaaatgcagtgtgtggtcctttgtgactgtcttcttggttcaacatgttgtagcatcaagcagcaattcatttcattttattgctgaataacattccattgcatgaatgcacaatttatttattcattcattggttgatggacattcagattgttttcagtttttaactattgtgaataatgctgctatgatttgtgtacaactctttgtgcagacatttgttttcatttctcatggagtagaattgctgggtcatgtgataactctgtgtttaatcatttgaggaattgtcaggctgttttccaatgtacctgcaccattttatatttacaccagcaatgtatgagggtttcagtttctccacatcctttccaacacttgttataatctgtctttttcaaatagctgtcttagcaggtttgtgaagggttacctcactgaagttttgatttgcattttcctaatgattaattatattgatcatctttatctgcttaatttctatttgtatattttatatagagaaatatctattcagattctttgcttatttgaaaattggattacttgtcttaagttattgagttataattgttctttatatagtctaggtacaagtcttttatcagtgacaggatttgcaaaaacttcctcccattctgtgagttttctttcttgatgttctttgaagcatgaaagtttaaaattttgatgatttccagtttatgtgttttttcttttgttgtttgtgtttttggcatcatagctaagaagtcattgcctatccaaggacatgaagatttacaactgtgttttcttctaagagttttattgttttagctcttacatttctgtctccgatcgatttcaagttaatttttgaatatggcataaagtaggggtccatctttgtccatttgcatgtggacgtcgacttgacccagaatcatttgctgaaaaggctattgttaacagttccctccctgccccatagcagccatgcatggggcaacttccagtgaggtgagtatgaggttgtggcaagcaggcctcagtgatggtggcatgatgaccatgctctggggcttcatctgtaatgacccgttcagtttcaacagcattaacttggagacacttacagaaacttacaagattcctttttacttacaatatcttgccagagtattttatcattgcagaggcatctagtggaaagttaatggattgtattgtgggtaaagcagaaggttcagtagctagggaagaatggcaccgttatgccacagctctttctgttgcccaaaatttccatatcttggtttggctgttaaactcatagagttgttggaggaaatttcagaaaggcacaagacaagggtgcctttggttggccctttaataatttactgtacccctagatagcacagggaaacaagtgtcttagtccatttatgttgctataaaggaaactgaagctgggtaatttataaagaaaagaggttttatttggcttatggttctgtaggcagtacaagaaatgtggtgctggcatctgcttctgggatgacctcagaaagcttccactaatggcagaaggcaagggagagcagacatcacattgtgtgagagaggaagagagtagagagggagtgctgggctctgtttctgaatcacttcttggctgggcatggcggctcatgcctgtaatcccagcactttgggaggccgaggtgggcagatcacctgaggtcaggagttcaagatcagcctggccatcatggtaaaaccctgtgtctattaaaaatataaaaattaactgggcgtggtgggtgcctgtaattccagctactcgggaggctgaggcaggagaattgcttgaacccgggaggcagaggttgcagtgagccactccagtctgggcaacagagtgagactccatctcaaaaaacaaaaagaaaaaaaaatcacttcttgagggacctgctagagtgagaactcagtcattatcatgaggatagcaccaagcccattcacgagggatctaccctcatggcccaaacacctcccatcaggccccacctctaacactggggatgaaatttcaacatgagattggaaggggcaaatattcaaactgtatcagtgagaaaaataaaataatatgagaattgagaaagaagcaaaacttttatgttgcatagatatgattgtacaaatagaaaatccacaattattcttatggatttattacaataaatgtttagaattaacaatgtttaagaagttggatataaattcagtacaaaaatcaattgcatttcaatatacaaaaaataacatttagagaaatatgtcatttgcagtgttaccaaaaaacattaagtgtttaggaaaaacctaacaaaagccatgcaagacctctttgaagtttataaagctttattgagaagcattcaacatgagctagctaagtgggcagatagactgcacttgtagattagatgacgtgatattataaaactggtaattctccccaaattgatccacagatccagtgtaattgcaatcaaaacctcaagtatttttgtgggatttgttaatctgattcctttttttttgaaacagtgtcttcctttgtcacccaggctggaatgcagtggcatgatctcggctcactgtagcctcaacctcccagactcaagtgatcctcccacctgagcctcctgagtagctgggactgcaggcctacaccaccacacctggctaattaaaaacattttttcatagacacagtgtcccactatgttgcctaggctgttaagctgattcttaaacttgtgaggtaacggaaatagctaaattaagacaaaatattcttttaattttttttaatatagagatggggtctccctgtgttgcccaggctggtctcaaattccttggctcaagtgatcctcccacctcagctgacaaggtattcttaaacaacaaaatgggcatacttgcccctccaaatgtcaggctataataaataagactttgtgttagcgttgtagtagttgtccagaccagtggaacagaatttgagaaacagatccaggaatacatggaatttgacatttcttagaggagaaattgcagatcagtggtgaaagaattgacttttcaaagtgtggtagaacaatttgacagccatgtgtggaaaaatttttcccagattactaccttatcatatgcacaaaaaataaattccagatttatgaaaaatctaggtgtgaaaagtaaagctaaaatgctctttaaagatagataatataggagagtgtctccatgacctcaggatagaaaataacttcttcaacaagccattgaagcaataactgtaaaggaaaagttcatatattcagtttcattgaagtgaagtcattttgttcttcaaaagatgtcataaggatcataacaagaccaaccacaagttggaagaagatatttgcaaaagcattacaacagtgtttgttggttatctggaatacatagagaagaactatagctgggaaaaataaataaataaataaatatgggaaagaccattaagtactatacaaaaagagaagagtaaatgggcaataaacaaaaactgcatttggccttattagtaatcaaaaatgcatattaaaatcacgatgcggcaccattataccatgagattggcaaaactaaaaatgtccaaagcaccaagccttggtactgtggggatggagttttactcaattctgtgagtgtaagctggtacaagcaggttagaaaacagtttggggccggctgtggttgctcacacctgtaatctcagcactttgggaggccaatgtgggaggattgcttgagaccaggagtttgagaccagcctgggccacatagcgagatctctgtctttacaaaaaaaaaaaaaatagctgggcctggtggtgtgggcctgtagtcccagctgctaaggaggctgaggtgggagggtgccttgagcccaggagttcgaggttgtgccactgcattacggcctgagcgagagtgagaccctgtctctatacacacacacacacacacacacacacaaagagaaaaaaaagaaaataaaaaaggaaagaaggaaacagtttgacactctaataaagtggaagatatgcatactcttttgacccaggaatgacctcataactgttgaccttagatattgcactatgagacgcaaaatgagaatattcatagtttttaatagtaaaagccggaaacttttaacaataggactatgggcaacttatgatatattcatacaatggaatgctaaacaacacacgaggctaagtttcacaatattaactgagaagggcaaatcaaaaaaatttaaaatataactccatttatatgaagttcataaacaggagaaactaaactatattaggtggtaaattagatattacttggcaatgcctaatttctttccatctatattaggtagtaatacctaatttattgctacttaatattgctatattaggtagcaagcagcaagaagataatgatcacaaaagtgaagaagtggagacctcttggtgagggaggggaagttgatgactagagggacctgagggaggctacctttgggccatggccacatgggtgcttactgcagtctttaatttgtacatatggatgagaacattgtatgtatgctatgactaatctataaaatgagcatatcaattactgcaacataacatatagtaatttttaaaaaccaagtaacagaattgtggttaaaaactacttttttgagtttatcttttaagaaactatatattatagattgtgaaatattagcatgaaaacaagaaagtcatgtttttatgctgcaaaataatggtcacaaatcctatgtaataaaaattgatattgtgatgtaaaacaaaggctattattttctcactggatttttccccactgttttagcacccttgttgacaatcattgactaaaaatatgaggatctggactcttaattgtatttatctatacttatgccaacaccatattttattgtcttgattaatgttttgaaattgagaagtgagtcctccaactttgttctggttttcatgattgttttggatattctgggtcttttatagttctatgtgaattttatgatcaactcattgatttctgcaaagaaaagtaagattttgatagggattacattgcatctgtagatcaattaggggagtattgtcatgttaacaatatcaagttttctgattcatgcacatgggatgttttcccatttatttaggtcctctttaatttctttctgcaatgtattttagttttcagagtataaattttaggcttattttattaaatttattcctaagtatttaatttctagcgatgctattgtaaatggaacagtgttcttaatttcatttttggtttgtccattgctactatatagatataaaattattgttggatattggtcatgtatcctgcaaccttattaaaattgtttattagttctaataaatgtttactttattccttaggattttctatatacaagatcatgtcatctgcaaatagttttacatcctcttttccaactggggtgcctgtatttccttatcttgcctaattggcctacctaaaacttccagtacaatgttgaataaaagtggctagaaaaattatccttgtcttgtttctgatctcaaggggaaagtatcattctttcaccatggagtctgatgttagttgtgggttttttctagttattctttatcaggttgaggaagtccattctccttttttctttaagctattgattatcaggatggatttaggtggtcttgctgctttggaaattgtagacttccttcttaaagcctgctccattttatccttctaagatatgcatgattttggaaagactacaagcttcccagttagaggagggccttcttgtttttcaccctacatacaatgagcctccttgttggatgccaaagtaaggtctttacatccttcattccctacagaccaggcttcttaaattatcaggccacaggtaacaaatatatttcatctcctgtaccaattctgatgttttggtagtagctgcccgaaggattgttaagaaggaatctgaggccaggcacagtctcagtgctgtcattaattagtgttatctggcctggtgcactggctcaggcctgtaatcccaacactttgggaagccaaggctggcagattgtttgagctcaggagtttgagacctgcctgggcaacatggtgaaaccccgcctctaccaaaaaatacaaaagctagctgggcatggtggcacacgcctgtggtcccagctactcaggaggctgaggtgggaggattgcttgagcccaggaggtggaggctgtagtgagccgagatcacacaactgcactccagcctgggttaaagagcaagagcctgtctcaaaaaaaaaaaaaaaaatgagtgatatgtgtcactggtctggtagtagggaaggctgcaaattgatacaacttctggattagactgtgcctgtgcctcaaccaattccagtggcctttttctcagtgccctccgtactccttcaacaacattaaatcttatggtccatacccctttgtaccaccctctcttctttagatctctgttacaaagcaatattctgggtctcctgtaaagtctctggccttccctcccccgacttttcccctcaacatatctctctagctttctcaactgagcctttgatcctgtgtactgtttgcttgggatattttgcccttcttttacatctctccttgctgaaaattgtgccattcttcaaggtccatctcaaatctgcttccctggttttccccatacctgagagactgttctgcccttaaactgccaaggcataggatatttgggtaccatacctagaattgttttccttcatgtacttttctgagttcctgcccagtactgaaaatatgaaattttttaagtccaggcagggactttatattcttagcatatgactccctgcttttactatggtggatgctcaataaatgtttggtccttttaaactctttgcttgctgtctattggaatgattatttttaagatttcatgttatttctattataggctcattagtaatgctctttattttgtgtttttcctggtgtttattccaggacatacaatatataacaatttagtattagtacacatatataactaggttatatattgctgcatgacaacctgtcttcgaatttagtggcttaaaacaacaaacatttattatctaatagttttagtgagttaggaatctaggcatggctttgctgggttctctggctcaaggtctctcacaaggctgcaatcaagatgttggctggggctgcagtcatttcttctgaaggcttgattgagggaggatgcaattctaagctcatgcatgtggttgttggaaggattcagttccttgtagtctgttggactgaaggcctcagttcatcactgactgtcagctggaaacccccatcagttccttgccccatggaactctgcatagggcaatttgccacatagcatctattttcatcagagaaagtgaaagataataagagagggtgaacaagagagaaggcagagtctttttttttgtaccataatcttggaagtgacatcttagtacttttgcgctattccatttgttatgagtcattatatccatcacccattcaaagggcaggtattacacaatgacatgaataacagatgttgtggatcattggaagtcatcttagaggctgcctaccataacatccttctaacttttaatattctaccttgaaataataatataccattttagatggtatattattcatgtgaaaacctataacaatatattttaattttcctcttctcagcctttgaactacctttctcatcatttttctacatatgttataccacatatagtacaatatagtattatttaattaatttatttattagagatagggtcttgctatgttgcctaggctgtttttgaactcttggcctcaagcagtcctcccacttcagcctccaaaagtgctaggattataggcatgagccactatatctggcctattatttttgatttaaataattatcttttaaagagattttacaaatgagaaaccaatatttaatatttatgcacatttttatcatttacagtgttcttcattcctttttgtagctccagcatcccatctggtgttattttccttgtgatgaaagaactttattatttcttatagtgttggtctccttgcaatgaattctccctcaaaaaaggaaaaagaaataagaagtgtaagaattgatagggaagatataaaactatcattacttgcagttggtatgatcatctgcagaagaaaaacaagataatggatagaaaaaatgataaaaactaataagaaaatgcagcaacttataaaaatcaatagcgtttctctgtaccgatgataactgatccaaaaacagctggacttctggcagtaattttctcagactgctcccttatttcacctaatttttgaaagacagttttttttttctgtaaatagaatgataaggtgtcagttttttctttcaatacttcaaagatgtcacactattgtttttggtttgcatagcttctgatgagaagtatgccatcatttttatctttgttcctttgaacaactttcacattttttcagtacttagataatgatttgctatggtgtggttttttccttttatttttggcttacagtccattgaaatttttagacttgcgcatttatagttttcataaaatttgcaaaacttttggtcctttttcttcgaatattttggtacttcattgaaccctgtggtgtttcccatagctaactgatgctctgttctgtttgtctcagtcttttttctctatgtatttcattttgaccagtttctattgctgtgtctttaggttcattcatcttttcttccgcagtgtctattgtactagaaatcccagcctatgtatttttcattacagatactgtatgtttcatgtctagatgtttgatttgagtctttcctgtaccctccatgtttctacttaacatgcccagtctttcctctagctcccctattaaatgggagcatatatataatgactatattttaatgtccttatatgttaagtctataatttgtgtcatcttagtttgtttctgttgattgatttttctccatttaagagttgtatctttctaattctttgcatgtctgataatttttgattggatgttggacattatggattttatattgttgggtgctttattttatcatatttctttaaatactattaaactttgaaccagcatgcagttaattggaatcagtttgatccttttgaggcttgatttttatgctttcttagggtagtatcaacgtagcctttagcctgcagctaattttatttcactaccaagacaatacacttttcagggctctaattattgccccatatatcacaaggtctttccattctgctggtaggaacacaaactgttcctgtgtctttgtgagcttctggggactggccctcctactttttctttttttagcaattcttttattggtcttgggtagtttcctcccatacgtatgccaatcagtactcagccaaagacataaagggatccatctgaagacctccagagctctctcctatgtagctctcttctctctggaactttttcccacaagttttaattattttggcctccctcttccctgatttctgtcttctcaatgcaggaaatcactgggctgtttgcactgcatcgtggaaagcctctccagtcagtaagctagggaagatttaggggtgcctcacttgttccccttctctgagggctagcaatcttgtactgactgttgtctagtgtctgaaagccatttttttttcatgtattttgtccagttttttagttgtttaatctgattgcttttactccatcatggttggaagcaaaagttgttaatacgtttttgtgatgccagactgaactttcattgtttggctattcaagggctaactcttcagcttattaaaatgcagagaagcttatatatatatatatatatatatataaccttatgttgataaagagagcatatatgacaggacacctttttttcaaactgagtagttagtagaagcatctagaagagaaaacatttggttttctaaactattaggaagatattaagccatttagggcagtgttccccaatcattttggcaccagggaacagtttcgtagaagacaatttttccacggacagggggaggtgggggatggtttcgggatgaaactgttccacctcagatcatcaagcattagattctcatgaggagcgcaacctagatccgttgcatgcagagttcacaatagggttggcactcctataagaatctaatgacgccactgatctgacaggaggcggagctcaggcagtaatgcttgctggcccgctgctcaccacctgctgtgcagcctggttcctaacaagccatggaccagtacccattcgtggcccagggatggggacttctgatttataactttgagtcactcaggctaacagcatcatggttaaggggatatttagcaacagaaataaagtgacttttctgagagtatgcaatgactccattcgccctaggtccaaaatgatgagaattgaaacacatatgttactaagattgtaaatggaagagggcggagggaggtggtgaacatcagcatagggcagaagttgtcacatccacactttcttgtatgtcccctattcctggagctgccttccctatttttttgcatgtctaaagagcaagtcatatcactgatctctgaataataaaagttaccatttattcagtgcttattatgttccttgcactgtgctaagtttatatattatctttcactgaatcctcacatctgcctatgaggtgggtgctattactattaccattttatagatgaggaaattcagatatagagaggtttaattatgtacttaaaggctatacagattagtgattggctgagctaggactagaacccaggctttttgactccatactctgtacttttgccttcatgtctccacctgagttgggatttcctgttcttccaaatcaatctcggcattatttagcactgaccacgattctttgcatcccttgcccccgctccccccgcccccagcacctccaagtatctattttaggcgactccagctcaggaagagcctcgatgttactcggcaacaggtatctctcaacctctaaaatgttccaccttctgatagaattccaccttatagttttgtcatgttgcttccttcaacactagatggtggacttcctcattgtctcctgattagaccttaatcactgctgcctttaaatgtcatgttccttcaaagctcaagacttagttggctctttcagttagtctttcctgatggatcacatgctgtcgaaatccttctaatgctttgaattatcagcatttaccttggatttggttagatggtctttctgactttctctgagattctctggtactttgaatctctttctagatgtttatgacatagcacccctatattcatattataacctgctcaaaattcccaatcatagaatatttactgagttcctaatatgagcaaaacactgattttaacattgcccttctcttttgagacaatcagtgtttccactgtttaatttttaattttttgtgggtacatagtagatatatgtatttatggggtatgtgagatattttaatacaggcatgtaatacgtaataatcacatcatgtaaaatggggtatccatcccctcaagcatttaccctttgagttacaaacaatccaattacactctttaagttattttataatgtgcatttaagttattattgactctagtcaccttattgtgctatcaaatagtaggtcttactcattcttttttttttttttttgagacggagtctggctctgtagcccaggatggagtgcagtggcacaatcttggctcactacaagctccgcctcctgggtttatgacattctcccacctcagcctcccgagtagctgggactacaggtgttcaccaccacgcctgggtaatttttttgtatttttagtagagacgaggttttaccgtgttagccaggatggtctcgatctcctgacctcgtgatccacccgcctccgcctcccaaagtgctgggattacaggcatgagccaacactcccggctcattctttctaactattgtttttgtacccattaaccatcctcacccatccccagtcccccacttcccttcccagcctctggtaatcatccttctactctctgtctccttgagttcaactgttttgacttttagatcccacaaataagtgagaacatatgatgtttgtctttctatgcttggattaattcacttaacataaagtctttaaactcttcatgtttattattcctccaattatttaatatgaagatctgcctggtgacagtattggagtgacgctcctatagaaccaaaagaggcacctgagttgcagttttcatcaaagtcatgtagtatacaccataggcattcagagtcactgtcagtccattgataagatgtaaggcaacagattagaacccacagcccagtgtcagcaagcagaagtgatgattgataccagtgagaggaaatagatgaactaacaagtatggccagctgccagatagttgtttatatgtcagtatcatcattgagcatcacattatcataacctagtacagtaatagatattcctaaagactgagacaaaatgcatataaagccctcatctaatgcctgacacgcataaagcacagaataaagtgtgtgtctatgtatatacattttatatatacacacaaatatacaaatgaaaaggctaaattataatcattgtattttatatatatcatatatatgtgtatatgtatgtatatcattatatacattgtaccttatagaagagaagtatacatgacattttagaatgatttccgtggaagtagctagaattaaaaaatatttttcgtttattgagaagtactttcagttatcacagtgcaacactgctttctgtaatgaggctagaaaaatgaggagccattgtatttaataaaataagaattttttctgtctccatggtaagattaacgaacacacttcaacataaagtaatacaattgctaccttcttcctggtggcatgctccctgtgttaaatttaagtgacagtaaaacgtaatgagttagaggagaaaaattttaatttattcgtttatttgaatagggaaacccaagagatcagtgatagaatttgaactgcgagacaaaaagaaagaagaggttttagttttgtagctaaaattaaggtggtggcacttgaagtgaaatttaaaaatacacattcacttagttttcttggccatattctgcttctcatgtgaaactggacttcctgccttttagccttgtattctgtccctttggaaactgtatcatcttttaaaaatgaagtacgtgactttcgtaatgatcttttatattataaaaataggccgggctcagtggctcatgcctgtaatcccagcattttgggaggccgaggctggtggatcacttgaggtcaggagctcgagaccagcctggccaacatggtgaaaccctgtctctacaaaaatacaaaaattagtcggacatggtggcacatgcctgtaatcccagctactcaggaggctgaagcaggagaatcacttgaaccccagaggcagaggttgcagtgagctgagattgtgccactgcactccagcctgggcaacagaacaagactccatctcagaaaagaaaataacatcaaaataaataacataacataacataacataacataacataacataacataacataacataacataacaataggaatttcaaaaaatctgaaacccgggcctggcacagtggctcacacctgtaattccagcactttgggaggctgagacgggtggatcacctgacgtcaggagtttgtgactagcctgaccaacatggtgaaaccccatctctactaaaaatacaaaaatcagccgggcgtggtggcgcatgctgtaatcccagctactcaggaggctgaggtacaagaatcgcttgaacccaggaggtagaggttgcagtgagctgagattgcgccattgcaatccagactgggcaacaagaacaaaacttcgtctctctccccacctccccccccacaaaaaaaaaaaaaacctgaaacccatcatgactatatcatgatgctgtagcctcaaaatggacttcacaagttcacctgtgattccctcaaaagcacttgagttttgatttgctgattgccagaagtgtatttgaacagtcccactttatatggagccccaagcatattaaatggagattccagataattagtgagctctggatgaagctcctgggatgcagtggggaaaaaactggatctggagtgttaaggtttgggctctgggcctgactttttcccttatcatttggaaattaggctcaggattgtgtattggggaaacacagcaagctgtatgcctatagtaaatagacaccctgtttagtggcattcaatagacctcaatgccatattcattcttccccaaccctatctgtcttggcttcaggcagatcttggcatagggcaccctcatcctcccccactgccacctagctcctgggtgaatgtctcccagcctgggaagagttctgttgaacttcatgaacaatgctgtctgcctagcattggagctcataccctgagactttgccttagtcctctcctttgtgcccagaggcatacatttgagagacagtcaatagagccttagacccctaactttgcacatataagtcctatgaaccatctgggccactcactctgcttagagcaattgcacactgctccctctcctttccttccatttacatctacagggagatttttagtttactaagccctggtaaatgacagttactaagatgtaatacaaatcttaacagtgggaacagtgactactgtttatcacgtgaatactataagtcaagcacaacaaccctttgtggtgctgctagagttaaggaggcatcctcagaggttgaggaatgtgcccaacctcagatgctagcaaatggtagagctttgttcagagtccaggtcctcattctaccacatctcactgcctctttatgttctgatgtctctactgtgtatatcaatgcttctcaaacgcagtatgtacacagttggccctctatatccgtgggttccacatttatggattcaacctaccacagacagaaaatatttcaaataaaaagcaataaaacataacaatacaacaataaaaataagacaaattttaaaagcaatacagtgtaataactgtttatatagcatttacatttattggatacgagaagcactctagagatgacttaaagcatatgggggatgtgtagaggttatacacaaatactttgccattttatttatttgtgtgtttgggtttctttttaagatggagtctcactctgtcacccaggctggagtgcagtggcacaatctcggctcactgcaacttccacctcccaggttcagatgattctcctgcctcagcttccggggtagctgggattacagacatgcacacccacgcccaactaatttttgtatttttagtagagacggggtttcaccatattggccaggctggtatcgaactcctgacctcaagtgatcaggctgctttggcctcccaaaatgctgggattacaggcgtgagccaccatgcccagcctgtgttgccattttatatcaggctcttgaacatttgtggattttggtaccacagggggtcttggaacattgcaatactctatgaatactgagggacgactgtatacatatcacctgggaatcttgggaaatgcagattctgatcttgtacctctggcatgaggccttgattctgtgtttctatcaagttccaaggtgctgctgctgctactgatccatggaccacattttgagtagcaagagtgtgcactatcagaaatacaaggggagtcaagaatcttataaccggattggacatttttaacaaaaatactgttgaaaatttacaggataaatttttgaacattttgaaagaacaaaatgttttatcaactagaactttgcttcattttcaatatggtcttcaaaaacaaaaacaaaaaatcaaaaccacaatgagataccatctcacaccagttagaatggcgatcatcaaaaagtcaggaaacaacaggtgctgaagaggatgtggagaaataggaacacttttacactgttgctgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttgttgtggcactattcacaataggaaagacttggaaccaacccaaatgtccaacaatgatagactggattaagaaaatgtggcacatatacaccgtggaatactatgcagccataaaaaatgaggagttcatgtcctttgtagggacatggatgaaactggaaatcattattgtcagtaaactatcgcaaggacaaaaaatcaaacaccgcatgttctcactcataggtgggaattgaacaatgagaacacatggacacaggaaggggaacatcacactctggggcctgttgtggggtggggggagtgtggagggatagcattaggagatatacctaatgctaaatgacgagttaatgggtgcagcacaccagcatggcacatgtatacatatgtaactaacctgcacattgtgcacatgtaccctaaaacttaaagtagaataataataaaaaaaaaaataaaaaaaacttttgttctttcagttaacatttttttttttttggtaaacatttggataaggaaacctgcttatccaaatgtttaccaaaacagtatcatccagatgatgacagttttgccccacttgctgaattcagcttcacattgctgacactctaagcaggggtctttgaatgtgcttcgggagattcacacttctcctccccatgatcatatacacagtcattcatatatgtttctttgtacatgttctgaggaagaatcggaactgttcatcacattctccttggacttgcaaaccagtgctccaggagaaaggtgcactccttctaatggttctggaattccccatcaccaaatccttgaccaagaagaatacatagtaatatatgcaatttatttgtatcaggtgctatgagttctcaggctgctgactacataattgaagcccttggaaaatgccagttgaatgctataattaggtaaaaataaatgcactaggccttttagataactttccagatgattgtcagccaaagcccaggcagaagtagtccctaatttccctagagctgaaagtcagtgaccttcagcttcccttttccacccttgtgattgtcattagggctgtgcatgtagcaccctcagccagcaatacggtagaagtgaggctcatcgttacttacctaggtctctgcattttcaatatctatctgcaaaatgagcttgatcaatatttaattattagtcaccaggaggtaattagagttacagaaaccaaaaagaatacatatagatgagctcaaggtgttctgagcacaccaaaccattctgacgattcaacatggaaacagctctgatcccaataatagccatagaagcctacctttaaaacccatccctgctcatttttattaggttggtgcacaagtaattgcgggttttgccattacttttaatggcaaaaactgcaattacttatgcaccaacctaatgcatttccatcattttcatagacctgagcacttatgagccatggccttgtagtcagactgcatggattcaaatcccaattattccacttaatagttgtatgaccttggtacattattgtcctctctagtctcagtttcttcttcctgcaacataagaataatgatgctaataataatagtgatagatagtactgctctcatggggtagttttcagattaaatgaaatgatctatgtcaagcacacagccaaatgactggcacatagcaagtactcactaaatgctaactgttgttattactttctaggccaaaaacaatatgtcctctttaacaggagcattgggtacaaagagttactgttgcctatgaaccttaactctttcagttagtggaggagaaattaaaaatctttgtgttatctattctgttcccttggtctttgtgcctatttttatactagtaccatgttgttttggtgactgtagccttgtagtatagtttgaagtcaggcaatgtgatgcctccagatatgttctttttgcttagtcttgctttggctatgtgggctaattttaggattgttttttctagttctgtaaagaatgatggtggcatttatctatcatcgtctttccttccacccagaacatcagagctagttgctacttacttccacattgcctctctgtttctccaccttcctagctttgatgatctgcatttctgctccattgtacttccctcacatacccactaccaaggtcacatatttaaccttacactttcgtatgtggatccactcctaagacctcaacctctgactacattcatcttggactacatacatctcttcctttctcacctcagaatctgctcttggtattcccaggactcattgatcttcataccgttccctttgacccagtatagaagcttctccctactttcagccacttccccccttctcttgccatggattcacactctcctgtatcctgcacaccattgccagtcatttcaacagatgactcataattccaaaatccctcaacaccataatcttatatcattcttgatttaatccccagcataatctctctgctcttgaagtaccaagtgttggtggaaaaagttgcaaaatgatgctcattgggtacacagatcagtagtactttctgatcttagctgggccctccctactgcttgaatgctctcttggatgctcttgtattcctctcttgccatcttctcagagaggcaggatggcacagcagttaatagcccaagcacaggcaactgatgagacttagacgctgaaatcctgggtctgctacttgctgcctgtatgattgggaaaattgatctaatcttaggctttagttttcttcacctgtaaattgggattgctcctcaccttaggggattgcttgtgaataccaaatgagatcatatatggaaagcacttataacacagtgaatggcacacgaagtacaaacacacacacacacacatgcacacaagcacatacacatcagctctattgaggtatgaattatataccataaaatctaccaattgtggcaggacacgttggctcacacctgtaatcccagcgctttgggaggccaaggagggcagatcacttgagcccaagagttcacgaccagcccaagcaacatggtgaaaccctgtctctacaaaaaatagaaaaattagcaggacatggtggtgcgtgcctgtaatccagctactcgggaggctgaggcatgagaattgcttgagcccaggaggcggaggttgcagtgagctgtgatcatgctgttgcactccagcctgggcaactgtaatgaaactctgatatggtttggctgtgtccccacccaaatttcatcttgaattgtaactctcataattcccacgtgtcgtgggagggacctggtgggagataattgaatcatgggggcgggtatttcttgtgctgttcttgtgacagtgaataagtctcatgagatctgatggttttataaatgggagttcccctgcacaagctctttattgcctgccaccatgtaagatgtccctttgttcttcctttgtcttccaccatgattgtgcggcctccccagccatgtggaactaagagtccattattaatctttataaattacccagtctcgggaatgtctttattaacagcatgagaacagacgaatacaaactctttcttaaaaaaaatctaccaactgtaattgtacaatttaatgattttagaatatttatacagttgtgcaattgtcataatctagttttagaacacttccattaccccacaaaattccaatgtgcctgtttacaaacaggcaattgtagtcaattgccattttcactcttgacctctggcaaccactgagtgaaccactttctataattttgctttttcttgacattcacataaatggagccatataacatgtagtcttttgcatctgacttctttcacacattataatattttgggggtttgtgcatgtggcatcatgtatcagtactttattccttttgatggccaaataatattccattttgtggctataccacattttgtgtgtccattcatcagtagatggatatttgaattgtttcctcagtgtttccaattgtgaataatgttgctatgaatatttgtatacagctctttgtgtggaaatatattttcattcctcttagatctgtacctaggagtggaattgctgggttatatggtaagtgtgtgtttaatttttaagaaactgccaaagaatgttttaaagtgtcagtaccattataccttctcaatagcaatatatgagattccagtttcaccacattctcaacaatacttgttagtgtctatcttttattacagtcactctagtgaatgtacagtggttctccttttgcttttaatttaatttccctgatgtctaatgacaattgatggcatatacttattaaacattcacagatctcctttgatgaaatgcctattcaaatattttgcttataattggtttatgttctcattattgagttgtaagagctctttatatagtatagatacaagtcctttatcagttctgcccataatgaattctctcagactttgtttatctgggaatagccttattttgccttcattttcaaaggacagttttactgcatgtagaattattggttaccttttttcatctttcagcattttttttttttgagacagagtcttgctctgtcaccaaggctggagtgcagtggcctaatctcagctcactgcaacctctgttcccaggttcaagcaattctcctgcctcagcctcctgagtagctgggactacaggtgtgtgccactacgctcagctaatttttgtatttttagtagagacggggtttcatcatgttggtcaggctggtctcaaactcctgacctcaagtgatctgccctccttggcctcccaaagtgctgggattacaggcgtgagccaccatgcctggccctctcagcattttgaatgttactccactacctacagcctccattgtttcagacaaaaagagcattaattgtattgatgctctactgtacataagaggcttttttctgttgtttctttctagatttttctatcctgtcttctcttttttgtttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtggtgaacatatttataagaggtcttttgaagttctcatccagcaagtccaatatatggggacatccagaaactttattgattgctttgtttttcctgagcacatctcacttttctgtttctctctaattttttgttcaaaactcacattttacataatatattgtagcaactatggattctggtgtttttcctctgatggttggtgttgttgctgtttttctttgtttgtttgtttgtttggtagtttctttgtttattaacttgcctgatctaaatatgtgaattatgtctcccacatcgtgtgtagcccccgatgtctgtgctcagtttttaaattcttgttttttatttttaagcatggctttctattggttcttttctctgtctgtgtagtttagtgtacagaggctgtgaccaaacatcttgtgccattaaggctactatcttctgttggtgggtctgtgtttggtagagttgctcattcagggtttaagctattttcaagtctgccctggctattactttctactgggccatcttacatcatatgtgttctctgtaagttttagttgttatgattattatgactgtatattctttcctctcagcagttgtaccaaaggcttttttgctctccagtagctctcctttctagcttcttcaatctcagcaggtgaccctccttcttgctttctgaaaagatgtcggccacacagtatagaacccatgacttccgatttcattttttttattgagatataatttacctaaggtaaaattcaccattcagagtacacagctctgtgtgactgttagtataatcacaaagatgtacaactaccatcactgtctgattccagaatgttttcatcacccagaaataaaccctgtgcccattagcaatctcttctcatttctgtttcccaccaactcctggataccagaagttgtagcatgaatcattgcttcattccttttcattgctgaataatagtccattataagggtagatcatatttggtttatctgtttatcacttgatggacattggattggttccacattttttctgttgtggataatgctgctatgaacttttgcatacaaattttagtgcagacatctttttggttctcttgggtttacacctccccactttatattttatttaatgtaaagtatatattataataatgttgttacttacttctcattgttgaagaattaccttctacgccatgaagaattcttaaattttattcccactctctatcaccacttgcaggaccttgctccaacaatatcactcctcatcagtatctctcttcttgctcccacagtatctctccttaccagtcatttcatcttctcctctgagtccatgctgttagtctacaaacatgatctgatatgtttgatcccaagccttcagttacctttaacacttcccatcattcttcttatctaattggttgccaaatctggccaattttatcttcaaattaattttgaaaattattttgtactcctcttccacattcctaccagtcaaatcactctctatgccccagattagacacagttactcttttctctatagcactttgtactttgtgatggcacttagtgtcttgtggaatagtcatttttgttttagttgtaatttgttaatttcctcctggctgcaagaataatcttttattcttactcattcttgcatccccagagcagcctagcattggatcagagcaaaggagtagcactcaaaacatcataacatctgcagattgtggtttaatttggactttcaaatttattatttctcatggtctctctcctttccatccttcatctctctccctccttctcttactaccattgtatataaaactaatttctatttatatgtatcttgaatggtgtaaggtcagagataaccagtttcacacatgtttgtgtctttccacagtgtcagacttttattgatgctatttcaatcacaaaatccatgagccacatggagttcccaaggaggcaattctccttcgtacttcccattcactcggaagtcagagccatgccacagaggcacaagccactccataagtcagtcaatattgcaaaccacacaaaacagtacatttcatctatatatatatgttacagattgaacattccacaacaaacaaattaacatttaacatcaagagaaagaggataggaaaaggggttaatgaaccagtctaggaagacagatatagacaaaaagaatgtcctggtctggaccagctggtttgtcaattttgcaaggaaaagtctcatgtgggcagagcctttggtggcagatgctgggtgcttatcacgagtgaaagcaagacggtgtcagttaagacagccatttggagctgctgaagtcctgctccttttatggccacagagtcctctggtgaggactgatagtggaaaagtatgcctatgtccttatctggttggttgcagtctttatttattaagcaaaacatcttgaccctcttaaaaaagtgccctatgaaatgtaagatggagtctttttctaagatggagttacttatgttaagggcgctctgtacaatatatgcttgacatatgttaggcactcaataaaaagctgttggttaacgcaataaaaaatggtaaaggagatatcaccaccgattccacagaaatacaaactaccatcagagaatactataaacacctctacacaaataaaccaaaaatctagaagaaatggataaattcttggacacatacaccctcccaagactaaaccaggaagaagttgaatccctgaatagaccaataacaggctctgaaattgaggcaataattaatagcctaccagccaaaaaaagtccaggaccagacagattcacagctgaattctaccagaggtacaaggaggagctggtaccattccttctgaaactattccaatcagtagaaaaagagggaatcctccctaactcattttatgaggccaacatcatcctgataccaaagcctggcagagacacaacaaaaaaaaagagaattttagaccaatatccctgatgaacattgatgcaaaaatcctcaataaaatactggcaaaccgaatccagcagcacatcaaaaagcttatccaccatgatcaactgggcttcatccctggtatgcaaggctggttcaacatatgcaaatcaatgaacgtaatccagcatataaacagtcccaaagacaaaaaccacatgattatctcagtagatgcagaaaaggcctttgacaaaattcaacagcccttcatgctaaaaactctcaataaattaggtattgatgggatgtatctcaaaataataagaactatttatgacaatcccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcgtctcagcccaaaatgtccttaagctcataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcaaggaaataaaagaggacacaaacaaatggaagagcattctatgctcatggataggaagaatcaatattgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaggctggaggcatcacgctacctgacatcaaactatactacaaggctacagtaaccaaaacagcatggtactggtaccaaaacagagatatagaccaatggaacagaacagggccctcagaaataataccacacatctacaaccatctgatctttgacaaacctgacaaaaaccagaaatggggaagggattccctatttaataaatgctgttgggaaaactggctagccatatgtagaaagctgaaactggatcccttccttacaccttatacaaaaattaattcaagatggattaaagacatacatgttagacctaaaaccataaaaaccctagaagaaaacctagacaataccattcaggacataagcatgggcaaggacttcatgactaaaacaccaaaagcaatgacaacaaaagccaaaattgacaaatgggatctaattaaactcaagagcttctgcacagcaaaagaaactaccatcagagtgaacaggcaacctacagaataggagaaaatttttgcaatctacccatctgacaaagggctaatatccagaatctacaaagaactcaacaaatttacaagaaaaacaaacaaccccatcaacaagtaggcaaagtatatgaacagacacttctcaaaagaagacatttatgcagccaaaaaacacatgaaaaaatgctcatcatcactggccatcagagaaatgcaaatgaaaaccacaatgagataccatctcacaccagttagaatggcgatcattaaaaagtcaggaaacaacaggtgctggagaggatgtggagaaataggaatacttttacactgttggtgggactgtaaactagttcaaccattgtggaagacagtgtggcgagtcctcagggatctagaactagaaataccatttgacccagccatcccattactgggtatatacccaaaggattataaatcgtgctgctataaagacacatgcacatgtatgtttattgtggcactattcacaatagcaaagacttggaaccaacccaaatgtccaacaatgatagactggattaagaaaatgtggcacatacacaccatggaatactatgcagccataaaaaatgatgagtgcatgtcctttgtagggacatggatgaagctggaaaccatcattctcagcaaactatcgcaaggacagaaaccaaacactgcatgttctcactcataggtgggaattgaacaatgagtacacttggacacaggaagaggaacatcacacatgagggcctgttgtggggtggggggaggggggagggatagcattaggagatatacctaatgtaaatgatgagttaatgggtgcagcacaccaacatggcacatgtatacatatgtaacaaagctgcacgttgtgcacatgtaccctggaacttaaagtatagtaataaaaaaaaaaagaaaaaaaaagttgttggttaaatagtctctgctaaatttgcgacacatcttcccagataagattcttctctccgaacctttttttttttcctttttttttttacacagagtctcactctgccatccaggctggagtgtagtggctcgctgcaacttctgcctcccaggttcaagtgattctcctgcctcagcctcccaagtagctgggactacaggtgcatgccaccacgcccagctaatttttgtatttttaggagagacagtgtttcaccatgttgaccaggctggtctcgaactcctgacctcagttgatccacccaccttgacctcccaaagtgctaggattacgggcatgagccaccgcacctggcctctctgaacttttttaccagtatttattttaattttggttgggggcagtagagagatgcagaaaaggaaaggaaggcatgaaactgcttgagaaatacatcagtgaataaaagttttttaacatttgtggtgtaatgacaaatcctggagaagttttagttcacacctggagtattccagcagaagttggatgccagccgctaggcattcattctgcagaggggcttctctgttaggtacaaggttgggttcaagtaccttctgaagtctagctcagtgtattttttggagtgtagtatactaacaggcaagaacaagaagtggaggagatgtgccaggggaggaatagtgatgacgttgtaggtgctcagctcccagatgatgggaaaagtgtttcatggcctcacacatcttttgggttttttgttgactgtctcccccattactcaatgagctgctacagcatagggaatgaatcttcaacttgtatttccagtacccagaacagaggcttgtactaagaaggcattcaattggtatgtaatggattagaataagttgaattgaagattgaactgaagtcaaaatctgatttctaaggttccttctggcctgaaaattcagactcctctgatttcaaccataacagcctggctaagcctccttgagagaaaccctgtgcttccttagtttaaccacctctttgtggttgaatagtataggttttcaatcaagtcctaggagggtgtcagtttcttgttgtacttaccaggatgtgataggatttcaaacaaggcccaaaagaatgtattttcaggagttgagatgtagccacactttctacatttacaatggcctgaaatgggttacagtttagaacaagctttcttctttatgatgcacaggatttctatgatgggtggctgttaggcaatgagtgtgatgggggagcattttcaatcttagctcaccttagcacaccttagcacaggactctagttacagggtcataattccccatgaggttagcccctgtagtatcagctactttgtatgtgatttaagccagtactgattattctcctgcttagggagaagcggtagaaggcccttggaactgtgagttttgcattccaacttgctaattcaacatagatcctaattccttaaatgcttgtaattagaaattctcgtgaactgtattggtttttgtcaagcaatctgtttggggaacttgaccaactggggcactgctggctagggtgaaatttatttaatttgtttttatgacattcttcatcttggaaatggggttttcaaatattgctttcccaggcatcattacttatttgctggtttttatttcaggattgggactagctcagggtgccagggaagcgttttgtggtgctctatattagagtcgtaatatccaagaaaattgtctgattgtatgtggtatcttggatgtggtaccttatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaatctctgttcactttagaattcacattgaacatgagctgatccaattgctacagccttggcagtgatagaggcaggagacagccaaatccctaggcagatagggaaaggtccccggagaatctccgacctgccccacaagtgttgacaccagatgttttgtgcagataagggaacctgcacagggggcttgcctgggcatgcccacagcatactggaggcccactgggggaatgggatggagccactaggagttcacaccttatgcaggggtggagcctggcctcatcagttcttgtgtggtggccctggtattcaattgtgagggggaaacctgcttggaggacccctctccttactgagagctttcttttcacttaataaattctgccctcttcaccctttaatgtgtctgcatgcctaattcttcctagtcatgagacgagaacctggatttaactgagccagggagcagaaactcctgcatcagtagcaattttacaactgtttattaaggaatacatcttgcccgaggaggttttatattgtatccctcaaatggctattttcccctcctccgtttaaatatttttactcaagtggtttccttcttttggaatgccagtcaactccatctcctacttgatttccaagaccgtctcctccaagatgcctctcctgtctcccctttccatacaatagaatttatgggtttatcactgttagtaccaagggcttcatcatctgctctcttatgttccctgcttgtcaaggtgtagcttattgtagggttcaatgagctgctagccactgtcccatttgactagcagatgcttgagaaaagcaagtacacagtttggattcgatcctacagtgtcttacatagttcttggcacctgcatgtttgctctaggaacaaccttccttattataccgagctgatccttttgggcagcattcattgagtcaaatggcctgtgtgaaacggggtctgaccctaagtggacagagctgagaggttagagctgaaggactcaagccccagacttgctacagattagtagggtgacttccagttacttcagttttctgagtgtagtttcctcattttaagctttgtaaatattaatatctggcatacataatttgaaaaaatgctgtaaggattagaagaacgaatatacgtgcaaacctttaagaaattataagtgcaaacacacgtagtacatttccatttttagagcttcatttttttcttatctgtaaaatagacatgtaaatgcctacctttcttattgggttattgtgaggattaagtagaataacatatgtggaagtgcttagcaaataggaggtgtttaataaatgttgcctggatatgaattcccctctcgggactgtcctgatgtgaggcttttccagcccttgggggatgtgcatttaaatcaggctgcttgtaccttggattaggcaacttaaaaaaagtgtagccttgttagttccaacttctcagctataaaatgcagagtaattaaatttgctagtaaatgtttccaggcctttgaatggcagccaataaaaaggactaaatattattcttttagaattcatgtccttgatgtagaggaaatatcatatttacttacacatactcctgccttggctttttagaagaaaactaagaaaaatgttttcccctctacatttcccacttgaaggtgttatctgtattgaaacagcaatgacagctgccagcaaaggagtgtgatttttctttgccaaggtaaaccaagggttaacatcaaggagtgttggggcccctgctggtgggctggaaccagagctaattccttagcagtcactcactcttctgcctcttcagctgtctctcacccccctcccaccataaaggagtgggtgttccttcaggactgtgcactcgcctccctccctctatccctctttttcccacccacacatacttcccagaacctctccaccctgtggctgatttatctttcctgggaccaaaggcaataaagcctcaaaactaaaacttgcaaggaaagacaatcctaatggtaaacacctaacccgcaatgctgattacttgaaaataagctgttattctgtctccagatcacaaatagcctcacttaaagctctacccctgaaagaactactgaaagattcaggaaggtcaggagatccagattccaattaacttagcacctgatgcctgtgtaactctggatgggtctcagttctctagtagttgaggactggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacctgcattttggaagagaggtatttcaggatcttctcattactgaagcctctcattgtaggaccatggtcatttttaaatctcccacattgaaatgaccagttggcaaaaaccttcaattacaaaatctcttccaaagaggctgagttttttttttttcttggatcacttcacatccttttgaataccctgaggcagtatttttatgggctaacagcaaacagagtgtcgtgtagaaccaagtgtgtcccttcactttctccaccccctgcaaagtttgtgatcttcaaagcatgctggattttaaaataaaacatctacttctagtccaagcctttggctgtagactttgggcttaagtgtgtttttccacagaggtgttacatccccatttctatcagctaaggaaaatgaattcattcaaggtctcccctgccattcatcgaggctccccaagaggagctttccagaaagatctgtgccaattgtaaacttacaagatcctcagcccataacaaaatgcccagacaccttggctctgctgacacaggctgagagagataaaggaaacagctggctgaggtcctgacttttttttcacatttttttcactttttttttcacaaaggcccgctagcctttgcagactggggactttaagattgttcactacccatccagcagggctgggcatacagataccaaagctccatctccagagacgtgaactctaaccaaggatcctcaaaccacttaaatcatgaacctgaaccttgaaatgaagcaaacattacatttaaactcccatgtttaaaatcagtttgcccttttcgctcactctttactctgggggatgcataaacaccttgggtgcctgctgtgacaatcaagttggcaatacatgccacctgctggaaccatagtctccaatctgaactccttccccagctacctgtttcctgtcacaggccttggcattccctgtagcttcattgcttacctcatagaatcatgcttctcattagagagtattcaacagcttcttgtcactggggggtgcacttcatttcctctactcttggacttctgctctacttggacttcatactcttggctgtctctgaggtagaggcagagagaacatccctgactctctgctgcccattttctgccatgggccgccccccccttccagaggaggaggtgttggggaacctctcccacatggcagaacaaccactcaagtctggggaggtctttggcagtcatcttgggccagatgttgtgctagaccaagactgagctgggatttgggttttctattctcacatagccagttggaaagggtggaaacacatgtgggggtcccaaggaaccatgagagacttctcatcattactgcggagtttgactatgatctggcatcctgggctgttgtgtggaggtctctatcatgaccgacctctttggcttctcttgtgccctaaggaaggtgttttttttgctagttttgttttatgtttttagactgagtcttgctcttttgccaggctggagtgcagtggcatgatctccactcactgcaacctcggcctcccgggttcaagcaattctcctgcctcagcctcctgagtagctgggactacaggtgtgtgccaccacacccagctaattttcgtatttttagtagagacggggtttcaccatgttggccaggatggcctcaatctcttgacctcgtgatccgcctgcctcagcctcccaaagtgctgagattacaggagtgagccaccatgcccagccggaaggtgttttaaaattgaaacaaagttgcatagttggttgtgttaattgattcaaaatctttcttttttgcaggggcagctctaggccaaattcttcttgcaagtttttatggatcacatgtttgtctaaagtacacacagatcattcccaaggccagagcaggaatgctctggaagtgccctctctgatctagggcaagcctgtagtttcagggttatcgatagacctcgcggagggcagtgtacaaggcctctggctgcatgaagagaaatctggtgtgtgggactgctctcagaagcagagaggtgtagaaggctgtcaaatgcataaagacaatgtctcttcacttggaggacaatttgtctgccaaggggacggtgagatttggcttcatctcttaagaacctgcattgagggctgctcacaatttcacccgaggtccagggcaattctctcctctccagatcccatatctagtgcttgttgctgctcattcagtatatggatacttctattcttaacaagttcataagtttgtttaaccgatgactgctcatgtctttaaagccattcattcattcatccattcattctctccctcccttgtcaatcaacaaatgtgttttgaaattaagtctatgctggaatttagtgattaataagacccagatccaccaaactatgagcttcctaagagcagggagtgcatatttcatttatgcatacacagtgctgggcatatgatttccataaatatgaatggatgcttcaggcaaatgcactttaatgaagtttgccacagaggcatctaattctcaaaccaaatgctggtattttaatatcttttcataaccagaggtctgagggcatgggaaaattgctgggaaggagggctctggaataacatgatattaagatagatgcatgagtgatgacccaaagcttcttgttgtcacccatagaataacttagtttcctgtcttccctggaagaaatgtaagaggatgtgtggggctagaaagagcaacaagcttatatcacccatatagtagaaaaggagtgagtggagcatcgagcctgatcctgtgcatttacagtagcagtaatagagtaaaacagagcaattagtgcctcatgtagacttggcattgagcaccccatcgcaaaatagccatgttacatatttcagtgtttaccagtgacaacgttttcctcttctttatgatttttggttcctgagatgtttaactggccttaatgcagttttgagagattgcaggaagtgatgggctgggttgggaatggctgggcattcaagtgatttagccatgggactcagcagtgcattgcttttactcctgaaggactcttggaagaaagctctgggcctctgcagagctttgatcagcttgttcagaaagagagcgttttatcgattttatcatggttacctttttttattgttaaaagtgtctatgttgtaaggcctctttgtgtgataaaattctgaaatgatctcacattgatttattttttcctgctttcaaaacacagcaatcttggtagtttcttagtatcccaaagggataaggagtcagcttctcaataaaccttttctggttatgaacactgtatgtattaaataataagcaagccttacagagtttatatgatcacattaagggatctgttaaattccaagagttattgttatgtgtgcaaaatactacagaagcacttgattttgttccagaagcactctgctgggaatgagtgcatattggttctagtgactctgccagtaattagctgtgacctttggtaagtcacttctcctccattccctcttgcatcctgatctgtaaaacgaggagtctcttagtcccttctaagtccctcaccagctttaacattctgaggcttaaaaaagctcataggagacaggctgttctttgcaatattttccatacaggtagtataaacaagtggagaggtaattgaaagactgactttcaaaatctagtacaaggaccttatttatatgggattttaaactgatatcttgagtcggactatgaatgactacgactatcaatcagttatctgcaccaataaaggacaaccgatgtgaatcatttggagatcttcctactcccagtagatgcaggtttcgtgccccagaataatactggaatgtgctcatgtctttagcacataccaactaatcttggtgagaagtgaccccctaaaaaggtgttggaaggcaagggaacacagtggctagagcttaacacatttgttggaaagaagagcatttttacactgctgacaatatgaggactatttgttttcttattttattattatacttttaagtattaagatacatgtgcggaacgttcaggtttgttacatatgtatacacatgccatggtggtttgctgcacttatcaacccgtcatctacattagatatttctcctaataatatccctcccctagcccctcactcccccaacaggcccccgtgagttatgttcccctccctgagtccatgagttctcattgttcacctcccatttatgagtgagaatatgtggtgtttggttttctgttcctgtgttagttcgctgagaatgatggtttccaacttcatccatgtccctgcaaagaacatgaaatcatcctttttctggctgcatagtattccatggtgtatatgtgccacattttctttatccagtctgtcattgatgggcatttgggttggttccaaaactttgctattgtgaacagtgctgcaataaacatacgtgtgcatgtgtctttatagtagaatgatttattaccctttgggtatatacccagtaatgggattgctgggtcaaatggtatttctggttctagatccttgaggaattgccacactgtcttccacaatggttgaactaatttacactcccaccaacagtgcagtgtaaaagcattcctatttctccacatcctctccagcatctgttgtttcctgacgttttaatgatcaccattctaactgggcatgagatagtatctcgttgtggttttgatttgcatttctctaatgaccactgatgatgagctttttttcatatgtttgttggccacataaatgtcttctttggagaagtgtttgttcatatccttcacccactttttgatggggttgtttgtttttttcttgtaaatttaagttccttgtagattctggatattggccctttgtcagatgggtagattgcaaaaattttctcccaatctgtaggttgcctgtaggttgcctgttcactctgatgatagttttttttttgctgtgcacagctgtttagtttaattagattccgtttgtccattttggcttttgttgcagttgctttcggtcttttagtcatgaagtctttgcccatgccaatgcctgaatggtattgcctaggttttcttctagggattttatggttttaggtcttatgtttaagtctttaatccatcttgagttaatttttgtataaggtgtaaggaaggggcccagtttcagttttctgcatgtggctagctgttttcccaataccatttattaaataggaaatcctttccccattgcttgtttttgatagttttgtcaaaatcagatggctgtagatgtgtggtattatttctgaggcctctgttctgttccattggtcaatttatctgttttggtaccagtactatgctgttttggttactctagccttatagtatagtttgaagtcaggtagcgtgatgcctccagctttgttctttttgcttaggattgtcttggctacatgggctctttttttgttccatatgaacttgaaagtagttttttccaattctgtgaagaaagccaatggtagcttgatggggatagcattgaatctataaattacttcgggcagtatggccattttcatgatattcattcttcctatccatgaaaattgaatatttttccatttgtttgtgtcctctcttatttccttgaacagtggtttgtagttctccttgaagaggtccttcacatcccttataagttggattcctaggtattttattctctttgtagcaattgtgaatgggagttcactcatgatttggctctctgcttgtctattattggtgtataggaatgcttgtgatttttacacattgattttgtatcctgagactttgctgaagttgtttattagcttaaggagattttgggctgagacgatggggttttctagatatacaatcatgtcatctgcaaacagagacaattcgacttcctctcttcctatttgaataccctttatttctttctcttgcctgatttccctggccagaacttccaatactatgttgaatagaagtgttgagagagggcatccttgtcttgtgccagttttcagagggaatccttccagcttttgcccattcattatgatattggctgtgggtttgtactaaatagctcttgttattttgagatacattccatcaatacctagtttattgagagtttttagcatgaaggcatgttgaattttatcaaaggccttttctgcatgtattgagataatcatgtggtttttgtcattggttctctttttgtgatggattacgtttattgatttgcatatgttgaaccagccttgcttcccaggaatgaagctgacttgatcatggtggataagctttttgatgtgctgctggattcggtttgccagtatttcattgaggattttcacgtcaatgttcataaaggatattggcctgaaattttctttttttgttgtgtctctgccaggttttggtatcaggttgatgctggcctcataaaatgagttagggaggcgtccctctttttctattgattggaatagtttcagaaggaatagtaccagctcttctttgtacctctggtagaattcagctgtgaacccatctggtccttcgttggtaggctattactgcctcaatttcagaacttgttattggcctattcagggatttgacttcttcctggtttactcttgggagggtgtatgtgtccaggaatttacccatttcttctagattttctagtttatttgcatagaggtgtttatagtattctctgatggtagtttgtatttctttgggatccgtgatgatatcccattgatcattttattgtgtctatttgattcttctctcttttcttctttattagtctggctagccttctatctattttgttagtctttaaaaaaaaaatacctcctggattcattgattttttgaagggtttttcgtctctctatctccttcagttctgctctgatgttagttatttcttgtcttctgctaggttttgaatttgtttgctcttgcttctctagttctgttaattgtgatgttagggtgtctattttagatctttcccagtttctcctgtgggcatttagtgctataaatttccttctaaacactgctttagctgtgtcccagagattctggtatgtagtgtctttgttctcgtcggtttcaaagaacttatttatttctgccttaatttcgttatttactcagtagtcattcaggagcaggttgtttagtttccatgtagtcatgaggttttgagtaaggttcttaatcctgaattctaatttgattgcactgtggtctgagagactgtttgttatgatttctgttcttttgcatttgctgaggaatgttttacttccaattatgtggtcagttttagaataagtgccatgtggtgctgagaagaatgtatattctgttgatttggggtggagaattctgtagatgtctgttaggtccacttggtccagagctgagctcaagtcctgaatatccttgataattttttgtcttgctgatctaatattgacagtgaggtgttaaagtctcccactattattgtgttggagtctaagtttcttcataggtctctaagaacttgctatatgaatctgggtgctcatgtactgggtacacgtatatttaggatagttagctcttcttgttgcattgatccctttatcattatgtaatgcccttctttgtctttttgatctttgttggtttaaagtctgtttcatctgagactaggattgcaaccctttctttgttttactttccatttacttggtaaacctttctccatccctttattttgagcctatttgtgtctttgcacatgagatgggactcctgaatacagcacactgatgggtcttgactctttatccaatttgccagtctttgtcttttaattagggcatttagcccatttacatttaaggttaatattgttatgtgtgaatttgatcctttcattatgatgctagctggttatttttcctgttagttgatgcagtttcttcatagtgtcgatggtctttacaattttgtatgtttttgcagtgactggtactggttattcctttccatgttagtgcttccttcaggcgctgttgtaaggcagcctattggtgacaaaatctctcagcatttgctcgtctgtaaaggattttatttctcctttgcttatgaagctcagtttcgctggatatgaaattctgggttgaaaattgttttcttataatcaatagcttaccaaccaaaaacagttcaggaccagatggattcacagccgaattctaccagaggtacaaggaggaactggtaccattccttctgaaactattccaatcagtagaaaaagagggaatcctccctaactcattctatgaggccagcgtcatcctgataccaaagccgggcaaagacacaacgaaaaaagagaattttagaccaatatccttgatgaacattgatgcaaaaatcctcaataaaatactggcaaaccgaatccagcagcacatcaaaaagcttatccaccatgatcaagtgggcttcatccctggtatgcaaggctggttcaatatatgcaaatcaataaatgtaatccagcatataaacagaagcaaagacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatgtccttaagctcataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgctatctacaactatctgatctttgacaaacctcagaaaaacaaacaatggggaaaggattccctatttaataaatggtgctgggaaaactggctagccttatgtagaaagatgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaactgcaacaaaagccaaaattgacaaatgggatctaattaaactcaagagcttctgcacagaaaaagaaattaccatcagagtgaacaggcaacctacaaaatgggagaaaattttcgcaacctgctcatctgacaaagggctaatatccagaatctacaatgaactcaaacaaatttacaagaaaaaaaacaaacaaccccatcaaaaagtgggcgaaggacatgaacagacacttctcaaaagaagacatttatccagccaaaaaacacatgaaataatgctcaccatcactggccatcagagaaatgccaatcaaaaccacaatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggataaagaaaatgtggcacatatacaccatggaatactatgcagccataaaaaatgatgagttcatgtcctttgtagggacatggatgaaattggaaatcatcattctcagtaaactaccgcaaaaacagaaaaccaaacaccgcatattctcactcataggtgggaattgaacaatgagatcacgtggacacaggaaggggaacatcacactctggggactgttgtggggtggggggaggggggagggatagcattgggagatatacctcatgctggatgacgagttagtgggtgcagcgcaccagcatgacacatgtatacatatgtaagtaagctgcacatggtgcacatgtaccctaaaatttaaagtataataataataaaaaaaattgttttctttaagaatgttgaatattggcccccattctcttctggcttgtagggtttctgcagagagatctgctgttagtctgatgggcttccgttgatgggtaacgcgacctttctttctggctgcccttaacatttttttccttcatttcaaccttggtgaatctgatgattacgtgtcttagggttgctcttctggaggtgtatctttgtggtgttctctgtatttcctcaatttgaatgttggcctgtcttgctaggtcggggacgttctcctggaaaatatcctgaagagtgttttacaacttggttccattcttcccatcaatttcaagtacaccgatcaagtgtaggtttggtcttttcacatagtcccatatttcttggaggttttgtttgttccttttcattcttttctttttttttccaatcttgtcttcacactttatttcattaagttgattttcaatctctgatatcctttcttctgcttgatcaatttggctgtttatacttgtgtatccttcgtgaagttctcatgctgtgttttcagctccatcaggtcatttatgttcttctccaaactggttattctagttagcaattcctctaaccttttttcaaggttcttagtttccttgtgttgggttagaatgtgctcctttagcttgaaggagtttgttattacccaccttctgaagcctacttctgtcaattcgtccatgtcattctccttccatttttgttcccttgctcgcgaggagttgtgatcctttggaggtgaagaggcgtgctggtttttggaattttcagccgttttgtgatggtttttcctcatcttcatgaatttatctacctttggtctttgatgttggtgagcttcatatggggtttctctgtggatgtcctttttgttgatgttgatgctattcttttctgtttgttagttttccttctgacagtcaggcccctctgctgcaggcctgctggagtttgctggaggtccagtccagaccctgtttgcctgggtatcatcagcggaggctgcagaacagcaaagattgctgcccgttcattcttgagtaatgtttagcaggcatagtaagccttcttcaatatttaattgtctgcatactgatggatatttttagggatgaagataagtggttcttgtttgcagtggatacgatgcttatgaggaaagaagagctctttttaaatagagtctcttgggtagaaactcccttgattaagttcctgaagtcttttactttgctgatcctcaattcagtttcatcagctcacccagagtttatcaaactttggaggaatgattttaagaaccaaatatggccagatgcagtggctcatgcctataatccgagcagtttgggaggccaaggcaggaggatcacttgaggcaaggagtttgagaccagcctgggcaacacagtgaaaccccgtctcaaaaaaaaaaaaaaaattaagttagctgggtgtgtcactgtgcgcctgcagtcccagctactcgggaggctgagttgggaggatcacttaagcccaggaattgggggctgcagtgagccatgattgtgccactgcccttgagcctgggcaacagcgtgagactctgtctctttaaataaataaatatgtaataaaagtggaaaaaacaggcaaatgtataagtcactgatctataactctaacgtgatagtttgtttatttactaattatattgccaactgacactgattgctcagacccttaagaggcactcttgtgtgaggatttcactcaagacaccaaattacagacagtgaatgttccatggagaacagagttgaaatacttccatgcatattgtctctgagaaaaccacctcttttccaggagaggttgttctgcagagggtgccagatcccaatcctgaagaatccaaacaccttttgaaattgtattctggggctgaggccctgcttgttcaccttgatcagacaggtgaatttcctcagcttcctcagccattgatttctaaatgatctcttactttgaggtgcagataagctttcttgatgtagatcctttccattttccttgtaggtacttcgtggttcaaactttcactactgcaactacggttaccataaagtgattactatgtgctagattgtgtactaagtgctttccatgaaatatttagttgtcacggcaaccctacacaggtctggccaataaacatttctgcaatgatggaaatgttttataatactagcaccacctaactctggtagccattaacacatgtgaatattgagcattgaaaatgtttctagtgtgactaagaaactaaagttttaattttgtttagttttgattaattaaaatgtaaatagctagtgtggccagtagctatggtattgacatgatgcagatacaagtactttgattctcatattacatgtagagaagctacagttcaaagaaattaaataattttctcaaggtcacagaacttgcaaatggcagagcaaggatttgattttgaagtcagtgtccttatccctatagtgtatggccactatttagactgtgcctgctctttttgtatccaaatttgttaagaaacacctctggtacatttgcaattaaccattgaaagaaataaaactgataattatacaataaaggacaacagtcattaaaacagcactaccctggtcccaaaatagaagtatggctaatggaacagaagaaaaaatgtacaggtatgaaaatagatgttcttgtgttatatttatattcttatattactgtgatgaactgagcatcacaaaagaataagaaaggaagagctatttaactaatgacttgggaaaaactggttatcaattaaacattcataagctcccaacctagtatattgtatgaaaatatatttcaaatggcataagattcaattattaaagaacaaacttgtttaaaaaatcaaatcacaagaaacagcagaaaattcatttaagaaaccatctgttccatggtaagttctgaagaaatcatgaaggaaaaaattacagatttgactgcttaagaaataaagactaatgaacaataaaaatatacatagaataaaaaggataacagatttggggaatatttgcaacgaataagaaagacaagggtgataattacattatcaataagaaaaccttaagatacccgggaaagttaatggaaaagaacgtgaacagacagttcacacaccagggaatataactagtgattgagcttatggggaatagttgaattagggcttttcaaagaggtacaaattaagtgatgacaagatagcatcttatgccttttgaattagcaaacatttaagaaaatagtaattctttgtgttgaagataaggcagaaaactgctgtatatgctgcctgcggcagctaaaattactctgatttaggaagcaaatttgatgaagtaatcaagaaccataaaaatgttcattcagtctgacttaataatccgcccctgaaaatttatctgagaaaaaaatcctaaggaaaattcacctccttttaccatcaaacctttaaagtagaggaaaggccatatattaaataatgtgaagattttaatttatagagttagccctaataaggaaaggaagggaagcaatctaaaatgctgagtcattggtgaaggccattaaatatattatgacacatatactctgtagaatattatgcatctgttaaagtgataattatggccactgtgtagcaacatggaaaatgtttataatggcaaacgaaaaacagcaggatacacatttgtatcttgtctaaaatttcaatcctgtcgaaagatacacatgagggccaggtggtggctcatgcctgtaatcccagcacttagggaggccaaggcaggcagatcacttgaggtcaggagttcaagaccagcctggccaacatggtgaaaccccttctctactaaaaaaatacaaaaattagctgggtgtggtggcatactatgactgtaatcccagctacttgcgaggctgaggcaggaaaatcacttgaacctgtgaaatggaggttgtggtgagccgagattgcaccactgcactccagcctgggtgacacagcaagactccatgtccaaaaaaaaaaaaaaaaaaaaaaaaaaagatacacatgcctaaggacccagactggaagggaactcaaggcaaacaaaaacagttggtatgttagggtcatgggacttgtttttatttttatttacctttgtcctattttctcaataaactcaaactagaaatggaaacacagtcacagaaatgaaggatattcataaagcattgtttcctgttggaagctgccttttattctcctttgccctcagacatgtactcctcattttgatgagcagcaagtgatcagaattatccagccttcagtcaaacataatctgtagaagaaagcactgctttatgcaaggagatttactgtgtgatggttggcaaaagaaaggatgcacaaagactctgtgtgggcagatttagcagaggtactgaaagtgaaaggagaggccatctggtagaatgtgctgtggcaaattaaactgagttttatgaacatgaaataccagaagaaaatccaaatgccctggacttggaaaaagcccatctgaggcaccataaaaccaatcaactacagactgacaatatgccactcataagctcagatatgcccattactagggacagcatcattcaagccagattttgcagagctcatttgatgtggatttcccgtaggggaaaaaatcaacaaattacccaccgtgtcccccacacatgcgcagatgcctgatacagagctactgtttcaataaatatggtaaatgcataatgatctggaaggcattggtttggcttctcctgcctcacattcattagtgaactctgacacccaaaccagacaactagacttgggtatggatataaggagccatttttccctccctccctccctcctttccctgcttgcctttctcttttccctcccaattattttcattctttcctctcccctccctccatctctccctccttctctcccttccttccctctgtccctccctccctcacttccttccttctttccttcctttgtttctctctccctcccttcctccctcccttccttcctttctttctcgctccctcccttcctccctcccttcctgccttcttttcttcattctttctttcctgtccctccctccctccctcttcctcccttccttccttccctccttcctctgactctctccttccctccctttctttcctcccctcctcttttcttttcttcttttcctaagcagttcatatccctatcctttagcctgtatgtctggaattctttatagttccactacacttgccccctcattttgtcctaatgttcctccaattctccatttcctctttatttttactctggggctctttcgagtgcatgtatcctgcatattcagctacttctgcttttcctcacctttaatgctttgattgcttccattagagtgttgataattctgtcatgatccttgtctgtatatagttcttccttatatttcaagtccctttatgatagctctgctacaagtgtgttttcaatggcactgtagttctgctgtggctttggggctgctttggttttctttggaaggagatagctacatgggtagcttgattgaggaagggcacaaaagcagtctaagtgtttgaaggactgtctctgggaagaggagcttagctattcccatgtggctagaaagggcacaacaaatcccactgggaggtgtacttagactctgtaaaaggaagcacattctaatatagcaggtcaaagactgaatgggctatttccagggccgacatatctgggtgttcagtttgtgcattgtacaaagacacctggccgagaaaatgaatgggagctgaaatgcagcccgtgctttgctcactaagccctgtgctctggagtgaggccatgccgacctagaagaacgggtgccaagataagttaccttttgatattccacataaagacaccagtatgtgctagtggtagccctagctatcccaggaggggatattgtctactgttgcagaacaagggagagaatagatgaacttgtgtgctagaggaagtgcttgcctcttctccaccatctccacatttcctggatgtgctttgattctattgcactgccaaacaatccctttttctaaacttgtctgtgccaatcttgtgtcttcttatctcacatatgctaacaacatccacattaagactctcaacttccccgagatggataggtgccatcacataccgtgctggattgaattctcatttcagagaatacatcttctttctacttttcaatgaggatcagcatcccattcttgcccaccacctagtactttgttaggaacacaggaggtaaggcaaactgaaagcactttgaaaactgtgaagaattttttcatcaatatcattagacaagatcctgttacaccaggaagtcaagaggctttactggcatttagtgcctcttgtttcaccatcaagattccctgtctacaacagttcatagctgagtctctattcatcaaactttctgcagggttgacatacacaccatttatttggctctcagtgtataacatttggtggtgagtcaccctttcctgtgtacatcttgtttaccccagatagactgtaagctcctggaccaattcaggaaaccacatactggtttcctggtatggaaaggaaatgttttatttcagaaagtcacttctctccatgagcaaagaacagtgagggtcattttaaactgttgtagctgaattccaaatggcaactgagatggtcccaagatttgggccatgtcaatttagggagtaggtaattaaaggcagtccaacaatttcacaaatttatagttaggtgccatgccgtgcactgtcttggaattcctcacaaggacattgtgtaatgtatactttttgaattcaattgaatttatccttccttccacctttcctcccttccttcaacaaatattcattgagactgtactatgtttcagtctttgttccaatgaacctaaacagacaaaagtctgtgccgtcatggaactttctattcttgtccagatctgccatttactagttgtgtgtagactcaaccaaatcacttccttctccggaccaagtgtgttcttctgtgtacactgaaggtttcacagatgtttccatttttccttcctattattttttctttaatcaacctccgtacttttaattgctttcttggttatctatttttgcctaatatccagtactgtaaggaaaataacaaggatgtactttttcttttcttttttttttctttttttttttgagacagagtctcactctgtcgcccaggctggagtgcagtggcgtgataacggctcactgcaacctctgcctcctgggttcaagcaattctccttcctcagcctcctgagtagctgggattacaggcgcccgccaccacacccagctaatttttgtatttttagtagaggcggggtttcaccatgttggtcaggttgatctcgaacccttgacctcgtgatccacccgccttggcctcccaaagtgctgggattacaggcgtgagccaccgcgcccggccgaggatgccctttttcaatggttcacctttgggtatttttatatctatgtttgcctagatcattcctttgttttgatatcatcaatttgtttagcccaaagataatggctgttgtatttccgtcttgagtgccaagctcacaatgagctgttactcagtttttgaagtattttctcccattataacatcaaccttctttcatttatttcctttagtcctctgtcctgagagcatcccccagagttatagccttggattctcaagctgcaggagattgcatgtttaaccatgataaatactcaggacaaaattgagcctttttttctctcataattttatttgtttaaatcttgactgcttatagtaaatatcctctcaaagataatttcatttccaaacaatttggtacctgatctgacgcagcttgagtgtttattttggggatgttgtttttcttttttaatgagttccccaaaatagcttttattgtttttacatctttcttttttttccccgggctatcagagggattgtagttagcattgctggaggattattagtttattaataataattatctcttaaatttcttttttggaagcagcatttggtcattattgaaaaaacagagcttttaaaaaatggaatgactttaaggaatctgaagaaaagataaatgtactcctgtatgatttttatagtgtttgcaatccagtgatcattctcacattgtttaagtttcagtttcaaggtgcgttgtccccctttatctgtggggaatgtgttccaagacccccggcggatgcctgaaaccctatatatactatgttctttcctacacatacttacctatgataaagtttaacttataaattaggcacagtaagattaacaacgacaacaataaaatagaacaattataataatatgctgtaataaaaattatatgaatgtagtctttttctctcagaatatcttatactgtgatcacgtatttcctgactgtgagtgaccatggctcactgaaaattgaaagtgaaaccacagataagggtggggactatgatagtaaggtaagattggtattaatatattgtctgagcaaggcaactaaatgtgttccttttggaatgcatactgttacaattcaggtttaattattaaacagcattggtctaagtggatgaaggttctgttttcgacccataatttaacacatgtcaagtttaaatgtacacagtaactcaaaaaacggcctgcctttggttgttgtttccaggatactgtgagcattgcaattagcaataaggaaagcactgaccaactcccggaaccacatctagttgcctggcatggaaaggaaatgcttttattttagaaagtcacttctctgcatgagcaaggaacagcgagagtcattttaaactattgtagttgaattccaaatggcaactgaggtggtcccaagatttgggccatgccaatgtagggagtagaggattaaacacagtccaacagttttacaaatttctagttggtgggtggctgggaactgtttattattgttaatgttactgaaaaatcacttgtttcgtgttaatacatcatcccttctccagtcctccagccccagtgaattttgtgttgatatagcaatgtgttcatagtgccactttactgaatcagttgttaaacaaatatttgtgccatacctactattttacagacattatgtcaggcactggggaatttatgttggtgaataaatagacatggttcctgctctcatgaaacttaaaatctggtctttttaagcaagctatttcacttttctgagagtcagtttcattatcttaaaataggcataatgcctatctggaaggattgtggtgagaataaaatgagactatgtctataaagcactggtgtgatgtttggcacatagaacatggtagaacctcaacaaatgatggctcttataatcattgtgagtgctggagagccccagtgctggtctatggattgaagagctatcgaagaggttcttgctgaaggttcaccccttggagtatctctactcaatccactgagtgggaagatttgaaggtaacaggctacgggggttgaacttttcccacatggacattttaaactcagttcaaatacatttgaatgagagagcaaagtacattaagcacagaatttctagaactcaccttgggaaatttaaagctgaccattttctctagcattttggaaattatcaaaaggccagacggaatgcacaattcacttcttggctgccaggagtgaaggagagaagaggtgaggttgaatgatttgaaattcagttcgtctgtgttagaacaagtcaaaacaattctagctgttaattttagttagttgagtccagagtaaaggtttgtaaagggcataagaaagcaacattacttttttctcacaatgagcacttaaaagatcttttaaaagtgtttctgtaatgtaaaagaaatagtcttactgcagtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgattcacttacaatcataatgtagggcttgatgtaaaacatgagaagacttgatgtttctgggtaacaatgggtgcagctcttgattattcatagtctgattatccttactggggagtatcctgtctcattttacttcttgttgtctgaatgcctaccttttacctttgtaaactccagatttaaagtttgtgtagggtggggtgcggtggctgacgcctgtaatctcagcactttgggaggctgaggcaggaggatcgcttgagcccaggaattcaagacaagcctgggcaacaaagcaagagaccatctctaaaaaaaaagaaaaaaaaaaaaaagccaggcaccctagcacacgcctgtagtcccagctactcaggaagctgattcaggaggattgcttgagcccaggagttggaggttgcagtgagctatgattgcatcactgcactccagtctgggtgacacagcaggagacactgtctcaaaacaagaacaaaaacaaattttgtttaaaactgaaaatggggggatagatggaaactattttactttttatcttaacagcttgtgcaggtagaacagtttaatgaggaaggagctgacactcttgcctatggtgtgttgggagattatagattttagttatccatgtttatgttgtaccccaggactacagattattggcagctggctataaacaaatgaccaaataaatctacagttgaagttacctagtgtctccaagatttcagggatgatcaaggacaggtagcagagcctggggccatcagctgtgtgttggcctcatctcattctgaacccctctcctactttaatcagaaccctgatacttaagggactgaactagctgtgacatccatttatccattttatagaatggctgtaggtaactacagggccataatcggaattctatacagggatgggtccctaggctcattaattgatgacagggtaggagaagactttgacacctacagattcattagagacagctgaatggatttattccaaggaggtcacctttgaaaacgcaatgaatttctatgggtggataacaatgcaaataggcaaggatgaagctttagatttaatctacatctgctgcaacaatgttctgatatagaattgtttagcccaagtcctaattgaaaaggtgagtaacattgatattgtctttctgaaatggattagaaatagggctggaaattggatgctaggaagagggacatataaggtttatgaggtaaaccccaataaatggaatttactatgattatattaaaaatagagacaatgtcatgtttatacagcgtgtaatatcatgcataatgtcaaatgccctttggagttactcctgtcccttgtactgataacatggcagttttttgagtcctagcatagggaaacagtgaaaatttccaggagtgcatcttttcaataatgcaaaggatacatatcagtgtttcacaaatttctctcttttttttaagagacagggtctcactctgttgcccaggctggagggcagtggtgcaatcagctcactgcagccttgaactcctgggctcaagcgatcctccctcctcagcctctggaatatttaaaactacaggcgtgcatcaccacacccagctaagttttaaagttttttgtagagacacggtcttgctgtgttgcccagactggtctggaactcctggcctcaagctattctttctccttagcctcccaaagtgctgggataatgggtgtgagccaccctgcctggcctcacaaccttttgaaaaagatcatcccctaaggaggaaattcaatttaaataatcctaatgagagaacttaaatactaaggaaaaagatttaggggaggaggattggatgtgaagggccacaatctactgtaatatctttttttttcactttccccccaaatcaattttcttccccttatggacaatatcacccttgttggaaatgcatgatatagatctgtgaagccagccaatttatgatgtgatatttaaattgtctctggttatggatattgtttccattgcccacattaaccctcaagaggagggcagtaatgccaattaagttcttgctatgtgttagatcctttccatgcattgtttaatttcacccttacaacaaccctgaagttgagaagttaagcgactttcccagactcatacagtggcaagtcaggggttgaacccaggcctttctgatgccagagactagaatatttctaacacttacttatcttacgggaggcattacaagatgtgtcttacatagaaaggacataatggtgggtgtttatttctgaagttgattttggagtctctggattgcattttggttaccctcaggtagaatagaaaagagaaacttgattaatactaaattttctcttttattctctccacccctctttaatggtttgtattgtgtttcttagtattatgtggaaataaccttagcttcttgatatgtgctgagatcctaggaactcagtgacttacagcacaggttggataaggttaatattatgttaataacacagattttatagctcttctactaatctttacatagattaatgcctctcaattttacaaaaaatagaccattaattgtgaagctggaagaggacaattcatggcagaaaatgttaggttagtagaacaatagtcatttacacaggattgttaaagaaagggaaaggtaaactgatgttcaacatctagtgcttgagaagttgctctgcacataaaatcaaaccaggcagctttgacctagctcttgggagagaatatatcaggttgtattgatgatgcattgatgagaatacatcagtgtgtatgatgtgggagcgtgtgtgtgtgtgtgtgtagatgtagaaaatagcattttcttatctggactttagacttcatagttaaagtaaattatgttcatacatctgtatgtgtagacttcctacctgtgctttaacgcctctatctccacctccatccctttcttctgtctccccagggggcaatggtgcaagtaaaccaaattcgaaatgcttggtcccagtgttgttagcagctgattcataggtgctcccctcattttagataagaagaaattgagatttgcaaaagtcacacaaactggagctcagattgcctgatttgtactggtatattgcactgtctgtcggccttcactctttctgactctctgcttcttagaaaaagagagtgtgggaaaatgtgctggcaccttcatctggtggccagagaccaattctaggccagaggtaagctttaaagagaataaaaagtgaggaaaattggctcaccagagcacgtcattatttacataataatacattgactacgatgtgggctttaaaagaaaaagaaaatgaaagtctttctcacaaaatactctaaaaataaactttttagggaacattataaaaccatacaatgtattttttcccaaacacaaagtcccactgaaatctgtctcttggttttttagatgccaaaagtcaactcatcttgatgtagaaaatgaggaggtgctgttagtgcatggagaaatagccttctgctaagaggtagttgacttagtttctaacttatgttttcgtttcatgctatgtgatcttggtcaaatcattttgcctctctggactttgatatccttttctgcaaaataaaagggttcaactggatgattttgaaagcacctctctcttctataagtctctgcaagtgggaagatgattagtttgtagtcttataatgtttagatggtttaacactgctatcttctagcttttctaaaagttttctgatgttgtcataggcagttttgtgtacaaaggtcatttgatggatgctaatgtacctttggttgataggaggttcgtaaaagaaatatgcatcaaaccttattattcgtgtattagataaagcagatctactgacattttaatgtcaccaagtaagtaatttataaagtcagtgtgccccactgaaacatttccaaagatatttactattgagtacttgggttctgctgagggtgaatactgaaatgtattctttttgtgctaatgtttgcagtacagtgtttcccagcagtcagaatgattgtctgatattgttagtgtaacccctgtgatctaacataggcttctgtgattataatgatttttatttgaaaaggtaattgtgtttgcctggcaacctccccacttgattttttttctgtatacacctctttctttggctctttaaaagccagcagtagagtatgtgtagttaaaataccttcttcttcttgcatccacgtttttgactgtgtctttgcattgccattggggggactggagagttaatatgctgtgttgcctaaaggaataaaagcaaaaattatctttgcaatcaaaatattaccagaaagaatttattaaaaattacaacagagagaaaaacggacattaaaaagagatttttatctttgtttgctttttgttttattggcttgccgagctttatcagtcattaatgatgaaggaaatagaagacctctccaaacctatgcatttgaattttgtccagttatcaagctttcccctgtgcacacccaattttttttactagctcaaggacaaagagatttttctcattttcccattttaagataagctatataggaatctgggtacatttgagtatgtgaggaaagatcaaggactctgtaagcatgcatctttccaatcatggcccttttagcaatttgcagtcattggaatgtgggagtttagggagagtgctgtttccagagttagacacttcggtaattccactactttagggtttcctgccacatgctgttggctttcagtaacaagtttcagtaaggattctcttggagtatgcatagaattttcttaacaatctgtgagtgattataagcagtatattctgggctcttgtgttttcgggagttaagagacctctcttttgcagtccccaagagtccatggcgctcatctatgaaaacggcccaagtgacagccagatgaatgtgtgctgagcgccactgaggctaagtgccaggaaagtagaaggcaccaccctgtggaagagggccaggaattctagaggacactactcctttgaacaaaaaggatgtggaaaacagttttctttgtttccttttgagttagctttgggcatgggctgatgccaagcttcgtcctatgacaggctcattgccatccatcctacccaggagggatgcatctctgagcatggagacagtgctgaggaaggcaggttggatggtgcttccttatctgattatcagacaagccatattttttcaaaggaacagtgagaacagatgatctttctgatctcgtgttaaatacagtactgggcatctttagcatatgtgctttaggttattgccttcttagcctgctcagaaaaaaaacacagcactggcagcattccgtttacttactcattagaatctaagggctggaagatcccttgaaagtcatctactccaccacccacccccatctgatgcaccagctgtttctacaaccaagtcgttatccttgcctatgcatgatgttctcaaagacacggcattagaacaccttccattgattgagttgaaatctttttcccattgctgtcatgcactgatgctagctgggcttcttggaaccatacaaaacaagtctaatgttcttctctatgccagcccttcggagctttatgtcacattccagtctcacccttcctttccatctcagctgcagtaaggttgattaacctgaattaaggaagacttgagggtggggtgagaagttgcacatctgttcctctgataacatggatttgattctccctctcccttttggtccctctgatagaaataggctctagttcttccatattcctcttaacaatgttcagatgtggtctcactagtgttgatgatctccgtctttatacttaactttgattcagcagtggagtccaagattctgttagttcttttggtgatctcaccatactagagattcctattcaacttgtacttgataaaaattttattattgtctgtgcttcctctaagccactggtgctcaaccggggtgatactgtcatcccccacaacgtccccaggacatttggcaatgtctggagacaattttgatttttatggcttgggggatggtatactactggcatctaatgggtagagtccagagatactgctaaccatccaacaaggatgcacaaaacagccccccatgacaaagaattatccagcccagaatgttaatagcatcaaggttacagaaccctgcttcaagccacttgtgtccatattccttccaaattttttctctgtactgtgaaggtagctttgttgactcaagtcaggatcttttgcttattcctatttaatttcatctggttagaaatcatacagctgtagtgtttcaagaccttcttggacttgatatatatcatcaacgaacatatctgcagtacctccagcttcatgcatgaacccctcttgcttctgatggactattaataccaaattcagggaactctcctcttaaccaaaagcaaattgttttcctagactggcatgggattccatggcaggtggactgatgatcattaggaggtgctgtgctcagttttttttcttttttacatttttggtactcccagacttccttagtagagagctggtgtgatctagaatggcatttgtatcttctcccacccaattagattagcaagagagagtttagccaagcaccactgctctgcaaatggagtctccaaatgccacatcagcagaaagaaaagtatctacactcataagagcatggggtagggggaaacaaggatgcataggttgttgcttggcaaatccattcactcctagcactgttccagtgatattagttccacatgcctagacagatagagaatcactgcgactggtaggcaggtcctgctgtctctaatgggatctgttttaaggaaaaagttcttgcatctattctgatttctgtatcaggccaaacaatgctagagttgctgacttaatgaccacattggctccgctgttggtcaagatcatcagactctcatttcagctttcaatgatattgcatcctgcaaacaaaccacttgagatgagcttggtataagggtcctactaagagagttctgattaccttattcacttgagatgaaatttttcactggagtgaaattaccagacaactaaaatgttttttccaagggacaaatgtgcaatttttgatccccaagagtagaccagaggccaaaagctacagccattctaccttgcctgctgtgtttctgtggcacacaaactaagaatggtttttacctggttaaatggtaggaaacagtcaaaagaagattttgtgacatgtgaaagttgtatgaaattatatgaaattcacatttcattgtccttatggcggggtcatcagaacgcaaccacacttatttatgtgttatttatgctgctttcttgaaacaaaactagagtagttgcaacagagaccttatggcccacaaagcctaaaatatttattttctggccttttacaggaaaagcatgccaatccctggtctagagcttaatttgtgtaaaagacccttcattttgtgacttttattctgttaggggctgagaaaataaacttcttatgaataacgtatttgatgggagtcttttggtgtctgagtgtggactcaaggaaggcaccgagggcttttgagactgctaaataaggcatctatttctatatatactgtcatggtctgggagctggaagaaatactttaagaagctcaagttgccggatgggatttctggattttttatgtgcacaactaatagcctctcaacctagagttgtaaggtaacttctaatgttcatagggattttgagaattgcttcctgattaactctaagagttgttcagttatttacattctttcagtagaattcttttatacctcctatgtgccaggtaataaatgtggagacctttcccaaagctttttgtatatatttaatttagagagcttctacctcaattttgttgcaattaaactgatgctaaattatgttcttcccttttgaattatggctgattgtgtctctcatcatacatagagatgttagaaagctaagctttacatttcagctgcttatattatatatacacacatgcaacacacattcacatataattgaactaaattgacattgacattgagagaatatcccctgatatttatctatgtaatttttattcttaggattagattaatcagtgattgagactgatcctctgaatcaatctctctctcgatgaaatacacaatatgtataatgtatatattaataattataattattaattgttaatatataataattagatattataactacacatatatatttaaaatttatattttctccagaactttgagttttaaccctagagagactctatcacagcacccagaatattctattttaatagttcatttaggataccaacactggaaaactccagttttccagtgatgaataaagttggaaactttattcatctagcacgacgtatggtgctcagcatagtagatgcctctgaaatgctgattgaatggaactaaactgactttaatcgagagaatagccttgagatttctttatctatataatttttatccttaggattagattattcagtgatggagacttgacctaaaaatatggctctgtaatttcactgatattgtcaagagcttgtttatgctccatcagcatcaggtccgtgggtgttgattccacttataggagtccctgtggtgttgggagggggccagaaaagtaaagagtggtctgctggaagtcagtggattagctggagagctcattctgctgatggctgccctggtagagcaccccatttggaagtggagctgaagggagagacagtagtgatgctaagagaaatgagaggaagatgagaagggaaaaattagctcatccaggcagaacctttattaaatttagttccagatcttgagttcacaacttaaataccctgtaagatcagaaatgttattatttgtacctgtagatcaagacttagaatacaggaggatcatggctatccaggatggaagagacattggagcctctctatttcagccctctagctcaatggttcttcatctgggttagtcagtggcttccctgaaaaggctatgtgtctatgcatttttcttgagaagagattccacgctttcattattttctataggatgagtccaggaaacctccttcatccccactcccccaaaaagttaaaagccacctctctagaagatgtgtgaactcttcacagggattctgataaacaattgctgacagatctcatgtaaaccttcctataaaagcgaatgtaggatttcatgaggcagcacagctggaattgttgtgaaattattccccacattgagtggaaatttatctctatgtaactttccccaacttcattttatttgtttgttctctgctccctaaagtaactgaaagtaagttccacccctcttctatggtcctttgaatataaggacacaatttgtatgccttccttaaggcgacttccccagggaaaagagcctttccaaacttttctcatgtatttgtgctttacagactcttccctgtgttggttgttttgtctgttttgtctttgtccctcataaagtcatggcagctagaattgaagatcgcatttcgggagtgttctgaccagcacaaatcagaatgctatcatctacaatcccctcgttctaggtaatatatttctagtaatgcccaattaactagtttctgtgatagtgcctcacactgctgactcataatgaactgttgattgctaaagcctcctccaagctgcgtttggaggtttggcatgtgaatctatttatacccacttttttatatttaaaaaaggcatcacattgatgcccaaatcaggactgttatgcacatgtatgtagatgagtaagtttccctttatgaatttaaaaaaacacacacacgtcatttaactttattattcttgttgctttgcaaaatattaaggacatcttgatgctttcagaatgaacaccaaaacccatgtaagtggtataatacttaacaatgttcacacatgaaaatacataagtggtttatttaattcatgatcaattatttgtttttgaaggaattttcagcattttttatttggacattctggaaatgaaatagtaaacatgattagttcaggtagcattgagaacttttaacggatataatacttatgaagaatttatttgcagcagaaagtggtcacttgctatttataagatgaggaagatagtgtgagccaagtaggaggtggagataacctcctgccaacagatgccaaaatgggagactgccactcggggctgcctggaatgcaactgcacctagaagcatactgtgttgtatgtgtaaacaagcaagaacatccttgtgtaaatgtgtggtggctctgctccttggagaaatagaatggtttctcaacatcattttcttataaattccttgctgttaaatcagtagccatttatccagatacttgtagtggagctagagatccccctctggttccaagtctataatgaattgtggataaagactgggctggcttaaacatcccaggcatggcaggcccctcatatgggaatagagtcaccaggatctatctccttcagaggctgcttctgtcggatgcactgatgaccagtgagagtattctactgtgtgtggtaatctggaaaggcccctgccttcatccacagatctgtctattcagggcagggggaggggaggaagagaacaggccagcctggaagcactgtttctctctgtctttctctctcgggattttctgggaatcaaaaggaaaatattttcctgatagtttagcaaaacatttaattaggggtggtaatgaaaagtgattacagcagcacaatgcgcttgcattatgagttcgagttaacatatttaggggtacttgcgcacaagctgtttggtgattagggaccaatccgctgaacatgaaaataaataaataaatgaaactgctgtgtgaaaaatgaatgtgctgaaattaggctgtgtataattgcaacgaaaccaaaattgagcagatacagttcccacagagaggtggaaaaccttgtcagggagcattcgccagcctgagctgttgtttgtggctgtgtgtggaatggactcaaagcccactgtggctgctggaaagtggtagggtgatttgatctattcagtcagaactagctgatgtagtgaccgaattatctcaagtgcttcccctcctgttatgtaggcaaaacctctaaattcaatgggttggattttttctaacctttaatcatttgcgtttgatatcatgtcttcattgccagtttcctccttaacccaacgtctttcatcttcaatcttcttaaactttaaaagatacaacccttcatctttcctttgatcttcacctgatgggcatgttagctgtgtccatcagtttcactaacctatttctatgaaaacagagaaaatgtttaacctagtatgacgggcctatagattataaaaataattgactaattttgttgtaaaaaaatactactctttgtaaaaacaaatcagcaaagctggagttttgtctttataaaacatgatgcttggttgcttgcttttttcaccttttaactggctatttgggtatcaagttcaactgaagtgtacttttgagaactgtcacagtagggcctccccattttatatggtagctcaccaaactgactgctgctgccagcacccttttggtttgctcttaattctattgggagccctattgctggcaagaaggctcctcatttaattcccataataagcttcattttcagcaatgcctccctaccctgagcttcataaagagtatcatgcctgtcgattttctttacagaaaggtgagcggtacttctgttgcccagtttgatacccagtagggagattcacaagatgccaagggtcttctacagaggaggtactagaagagtatttgtggagtatatgaaggaccaaggatgcagcaactaagcaatatgtatactgattatagatattttcttgattttggggggaaaaacctccagataagaaaagcagtctcattggagacctttggaaaaatgaacaataaatctttggagctcttctaaagttggtaagtctcaagtttctcccatagttctacgtaagagtactagctcattatttctcatagaaataattgagagactgaatttccttcaaagtatgaaattgggtgattgtatgagatcatgtgatttcatttcctctgttagggctttctcaccacttgtaactagaatttaagaacaactttgttgcacttgaaaaagaattaagctctgtaagcctactgctttccactggcccactccagttttaaaattgctttgcgatttttatgaaccacccctgtgaagttaataaaacacaaacatggtatgcattatatatgagagggaaatagaaaatgttcaacataaccgcttttatcattaagaacaggcagcatacagaatgatttaagaataagtgctaatgtttatgcatttttgtacctgcacatatattagaattgacttcaattcttagtcatggccagataaggacacaatggctgtaggaagggcaaagtaggaagaagaaaaaaaggggaaggaaaggagaaatagagtgaaattaatattttatgagcttccaaaatgtatcaggcactgtactaggcattttcacacacccaattccatttaatccttaaaacattcttgcaatatacaggcttttaaaatcccaataatattaataacatgtgttaggtacttagagagaaagggagggagggagagagagggaggatgaagaggaaggggaagaggaggaggagggagtgacaaagggaaagagaaagggagagtggggaggagggaaacccaacgcttgcctcattccaaaatatttgggcttgattgactttgggaacctgcattattgatctcatgattctgagtctcccctctacctcatgcaactaaattcaattgttaaattaactggatctttgtgggtataatatcaaattagaactaaagatacttgtttcatagtcaagagccaagtggttgacccagttcacagctcttcagctgctcttactacttctgcagaggctctaatttatttattatttttttttgagacagagtctcactctgttgctcaggctggagtgcagtggcaaaatctcagctcactgcaaactctgcctgctgggttcaagtgattctcctgctcagcttcccgagtagctgagattacaggcgtgcaccaccatgcctggctaatttttgtatttttagtagagatggggtttcaccatgttggccaggctggttttgaactcctaacctcaagtgatttacgtgtctcggcctcccaaagtgttgggatcacagacatgaaccaccgtgcccggccagaggttctaatttgaagaggatactcatttgcatcttcccacttccatgggaagctgttttttaccctcctcttctggttgcagatccttatcatcttgaacaattgttgatcctcataggtaacttttttttatgtgtataaatttaaggtttacaagtgcagttttgttacatggatatattgcctagtgatggagtttaggcttttagtgtaatcatcattggaatgatgtacactgtatctattaagtaatttctcatccctcaaccccttcccacactcccacccttccgaggttccagtgtttattattccacactctatgtgcatgtgtgcacattatttagtgcccacttataagtgacaacgctaggtatttgactgtttctgagttgtttgacataagataatggccgtcagttacatccatgttgctgcagaagacataatttccttcttttttatggttgcatagtatgccacggtgtgtgtgtgtatatacatacatgtgtgtgtatatatatatatatatatatatatatatatatatatatatatacacacactacattttctgtatgcagtcatccgttgatgggcacttagatcgattccgtgtctttgctattgtgaatagtgttgtgattaacatgagtgcagatgtctttttgatataatgatttcttttcctttgggtaaatcacagtagtaggattgctggatcaaatggtggttctatttttttttttttttgaggaatcttcatactgttttccatagaggttgtactaacttgcattcccaccaacagtgtataagctttctcttttctctgcattcttgccaacatctgttttttttttttccgactttttaataataaccattctgactggtgtaagatggtatctcattgtggttttaatttgcatttctctgatgagtaatgattttgagcattttattatatgcttgttggtcatttgtatgtcttcttgaaaaatgactattcatgtcttttgcccgctttttaattggggtgtttttttaaaaaaaaatagtgacggcaggtggtatgttcctcacacttgacttgtcatttacaactgaatttttcagctcacgatattgaaatccagaaccactttttctatagtcaagtgtgattcagcaaaaaataaaaccttcttgcattcatttggaagtaatatatgtccttttggaatttctgtgtaagtccttttttagtgagaaaaaaatcaagtccaagttaaaatgataaaatactaaattcggtgttgccaagtagagtttaatttcaattcagatactataatttataattctgggtcttaggagccaaagcctccttagaccatccctttaatccaggcctatcatttggagatctcatagctcccttcactgtaatcaccgtctggtgctagatagtggaactgagatacttctttgctaatgacctacttgctttcagatacagggcaaccagcggatggttcctgggatctcatctgatgagtgacatctttccggacagaactgatgactctctggcagtaaaagggtggagagggcagggcagatatgtttcacgagcaagaagggaaatagtgtgttgtaaagctttgctgtaggcctgccaggatctggtgaagtgggtgggcggggagagcttgtgttcacagaagagtcagatggttaaagaatttatgataattaaaatgacgtttctatgtaagtctgaaggaatacagccataaaaacataattgctgtaaaacatgctgcatcagactaaataaccacttgatgatggcaactatgcctgtgccataaagaaacctgtgcttttgtgaggagaaaaaaatatgtatttattatggctatttgcgtctcatgttaattgttcacaacaaagccattgattaagcaatgactccttacaagatggggctggatcaaataatgcacagagtacagcaaacaaaaaatggttgtgagatgaaaggatgattctgagaaacagggtcaagctgagaactctctgaactctccttgggcacctgcagtcatagttctagaagtgtgcggaacaatttgaatgagagattagatctgagtttcggggttttcttttcccaaattctactctgtaaagaatggcttgcctggatatggaagaagtgctaatggagggaaacaataaggactgtttcacaggaacctgccacacagggttcctgtttgaggtagagatttagtgacactgcctgaactcaatcagagtgaagccaggctttctgcattctgctagtttcactgcaaactgtggccagtggggccagcattcagtcagaaacacctgtctaggaagtcacaaggccatttatgattagtcttcccaatctggacatcatggagcagactcaggcacgtgaatggcgtctatttacacacacacacacacacacacacacacggctatactgttttcctggacaatcatttttcccacatttcctggaggaactactggaatcacaaatcacaatttgtggcttgccctgggtaatgagtcattggatggaatttcatttggtagatttaaagagagttagtgttgatctatgaagccagatgatttaagaaattgaagcagtaacaagtaaattgcttttctcttgtactgcaaaatgctttctaggcgtttttggcttttctttttaaaatggatttataatgccatttctctccacctcacggctcaagtaaacctctttgctctgatgaatcctaaatgactcctcatttcccacaaacagattgttcaaaggagttcttaatatcttgttttacactgtggaagctagaatttttaattctataggacacacaaatgaatatacattccctgttagaggctttatttattctgactcctctcatgaaaaattatgtccaactatgttcaaattccttgaccttataatcaaggcctgccactaaccaacctaaactcacttgcctttatttatttgttcatctggaagcaataggaaaggcttagaatctgccatgtagtatgctagttgttaaagaggatacagaaaagaaaaaggatctgggatacagataagtccagctgcttccttcaagcaatttactggccattggccagggcagatatgagagtggacacttctatgagatatgttgaacctgtgttgaagtgtgtgcaaaggactatgagaggagaggagagctgttgcttctcacagcagcacctcctctacatgggatgcagagagtccaagaatgctccaaaatggccttttccatcttcataatggccttccagccttcccatttgtgggcacaggggccccctgccctagcaaccttaaggtgccctgttgccagtacccttgagactccctcatgtttacggatagattgtaaattacacatgaaaaaggtctcatattaactattttaactttacagaaaccccacagaagtgcagcccacttggtcttgagctccttgaaggcgaggactatgtgatgccacatctgtaacccaagaacccagcacaaagtgttgcacatagcagatgctcaataaaagttttaaactgctgggggaagaaagtactatgggcatctggaagaggggccagctaactccacataggggactctggagctgtgctaaaaaatgtgtggtccactgcttcacttgaagagcctaaaaaatgtgtagagatttatgagggattaataggctcaagaattcgaaagggtactccagacagctcagagctcttgcccccagaatatgtgaggcatcgaaacaggaaagtaaaatgtttctagcagatttcttcccccctccaccccagacagtcttgctctgtcacccaagctggagtgcagtgtcgcaatctcagctcactgcaacctccacctcccaggttcaagcgattctcctgcctcagcctcccgagtagctaggattacaggcgcctgccaccttgcccggctaatttttgtatttttagtggagacggggtttcgccatgttggccaggctggtctcaaactcctgacctcaggtgatctgcctgccttggcctccaaagtgctggcattacaggcgtggcctaaaatgtttataacagatttcttatcaatctggttctctaaaccacagggaccacttggtgaacctgaagttttgtgactacaaggagatacataaatgtgtatttgagttaccttcatacagctacaatttggagaaggacgtccaggaagatactgagaggagaagtaatcatcgggtactgtttaagagagccgctgtcattactgcctttactgggttggggtcagagacaggtgggggaggtgctctgcaggttgtgttttatgtaattggtgctccgtcctcctccttctgttatatcactcatctgtgcagcttttcatctcatatgtattttccaccatggtggcctttgtaagacataaggtgagcaaactgcttattaaggtaagacaatggaggccccattttaaaaaggttaagatgtcctcaaaagtgtcagcgcatcccaggaatcattaacagtgtatggaatgcacagcctggtattttccaaaggccacactaaccttttcaagcatggaacaggctaaaaggaatggatttcttcaccatttgatgagagaagaaatctttttaaatgcttatttttatttgcttgctgagaatcatctctgtgaagctcaatatggagaaatgaattctgaacattttagcaactcacttaaaataccattagaaagcacttgggttattaaaagctgaaaacaaaggactaggagccctctggcactaataacacttagggagaaagcgagagccacctatgccctcatgtttgccaaaaatgtatttgaatttaaactcttcattgttaagaagggaagcttaagttttgccaaaccctttttgcctttcagtacaaccacttttccatgtaattggctcaacactgctatttgcataattgtcatatttttctgcttcccaagagggctgtaaagcgtaaaggtgaactgcaaagctttgacaaagtgcacatttatgtgtgatgtgcaattctcaaattacgaagaaaattatatctttttcattgagtttatcttacacttggaaatgaagtattcagaactcattgccccctgagatgagtttagcctgcttttctttaacttggccaaagtgcaatttcctgagccttgggtcttcaaataatgatgttgccacaggaccttgactgtatgaatgacctaaagcagaggcatttttctttaagccgcggaataacaataagctcttttagttggaatcagagatttcatcacagctgggccatccgttaagctctgagaggtcaaacagatcatttaacctctcaaagcctcagtttgtttaactgtaaaatgggcatgcctttaactcacacatgtattgagtgcttatatgtgaggaagtattttacccagggcttggtgcatagtaagtgttctaataaacacatgatattgcctcgttcctcttcttttatagcaggtggatggcatttaaatgaatgagagggcttgaactttggcacgggaaaagaatggagttgagtcctgcctatgtcacctttttagggagtgggaggatggggttgcagagagctgtgtgaccttgggcaggttacatagcaggagagcctcagtttctgtatctgccaaatgaggatggataatagaatgtgattgtgcatataaacagcatgtaaatgctcagtgttacctgtagttattaacatttcatccttaacagcggtcattatcaggtttaagatatggccctatgaggagttaatgggtgcagcacaccagcgtggcacatatatacatatgtaactaacctgcacattgtgcacatgtaccctaaaacttaaagtataataatttaaaaaaaaaaaaaaagatctggccgtgaaaacttatgttccctccaggtttgctgtgtgttgtcccatcacttttcacattggggagagtggaatgttcaacttcccttcctgtgaatgctcctggaagcctcctgcttacttccccaagtggggactagatttttacaggtttcctaattgctgtgtgcttctggctgcagcctgagggcatcagattacagtgccaaatggaggaatagtattctgggtgtgatactgatcagatcaggaagatatcaggacactagacatccggcatctgacagctggtcacaggggtcacttttgatccctagtttccccttgacaaggttagccactacatgccaagtgtttcatgggcagaattctagccaagcactaaactctgacagagaaggagaaatacaggctggcaggagggctggcattgccctaatgtcacagctggcactcacattccaatgaatgaatcttggatcaattgctaatgtacggggcccaacacaacattaacagatcaaaataagaggaagttggaaagtattcaagtttccagaaacaggtagttaaatatattaacgtaaatctacttgataaacttatctaatcattttaaaaaaatgaaaacatggtaattaatgttagaaaatgcttatgttgtaatgttaggtcaaaaaggataaaaatatatagtataattagaaatgtaaaacaacaacaatagacaaatctataaagacagaaagtggattagtagttgccagggtctgggaataatgagggttgtggaatcattggccaagggacgtggggtttgttctgggagtgatgaaaatgttacaaaattgattgtggtgagggttgcatcagtgaatatactaaaaaccactgaatggtacactttacatggatgtgttgtatgttatgtaaattatatctcaataaagctgttactgacaacaagaacaagtcttatacatacaaaaatagaacagaaagaaattttccagaaggctaacagtgtatataagttagtagcaaattgggactgatttttcttctgtattttttcacattttaaaatacagtgattaagtttaatgatcacatatgtagtctcatatattaaaataaaaaaactattggaaaggcaaataaacaaaaatgaattaatgccaacttttttagctcatggaattgaaaatataaataatttaaaaagtaagagaaaaaattatttttaaactagatgaaaatgtagcatagagtatgtggccccgtgtactctggattaaatatcaatacttaaccttttcattaatattttggcttgtaatgaaattgccaaacacaatggtatacataagacacatggcataaatattggaaaatctgtgataaaaaaatttttaataaactgttttctcagaattgacgtctatccttgtttagatttagagcttttgaaactttcagaatataaattaaaaattatctttgtaatcataatgcacccctaatttacatgtcctgatcttaaatctattatttatattagcttttatcaaaacattcagataagtgatcttcaaatgattagtacttaagtactggttggagatgaacttttgcaagtgaacgtcatacaatctattatttctattggagcttaattctgaagctcagagactccctagctctcctcgcctcaccatggtaatttattattatcctttgtctcctataatgtttgcttctttggcctacctgtagcataaaccttttggttgttctgcagctatttcagttaaataactcaagccctaaaaaccacagaaagaagagaatgtgcaaagcgatcatatttatggaccaccagatccttctcagcataattgccaggctttttatactgaaaggcaagaaacagctgccttgttctactttggtgtccaactcagctgtttcagattcatcctgttgctttaagcatctgttgacaggtgggaaagctcactgtgaagagaaacattgttgccctgggtggcttctgcctaagacaggcctgacccttttgtttctcccctggaaaaggaccgaagtgttccttccagccttattaagtacagctgtcgggtacattttagtagatgagaaccatttccaaagtatctcggttctgagaactgagaggcagtgtccagaaggtagttggacaagctcgtgtgctgtagaatgtctgtaagtggctgggacttacagaggagaggcccgcacgttgctagtcctccttgtcttggacatcttgagcctcccacttgaatatcctcttaggctctcattttgtaccagaaattctggaaactggaaggctattttgttggaaccccttattttacagattagaagaccgatgccagggttagttaagtgttttgttttatgctacaaagttggttagtggaattcttctgcctatataataacatcacagtatttcagagttgttttctgtcctctctttgtcaggtttctgggaaatctctttctcctcatgtttattatttggcccttaatccagcataataaaattacaggtacatatagtttgtcacaggatttccagttaggtctcagagacctaaaggaaagaaagttattgaaagttctggaaaaacaaaagtcctgagatagtttcttgacatacatcttctttgaaatctttaaaatcaaacaaaacaacccctagtgtcttccctgtcgcccccttcactaccttcttttgtattctgcatatgtagccattctcttgggcaatagcagaaaggtacatgtggattaatggaatttatgtattcactggcggtaaaaggcactgggaattcctgcactgggtgtaaaaacttgggccttggggacctcactaatgacttttcaagagcagttctttacagagcccaagtcttcaatcttgtaactggaccatcaaccccagtgacagcctactttgaaggaggcctcataaagacaaggttcaggctctttctaacggttttggctaatggaagacctggaggggaaaaatgaaattgttctcaaacttcttacaggtagaaaggagaaaatctctggaagttctgagaagtgacaggaatgtaaaattttgtgtttaaaatgtaagaagtagcaggggatgatgaagaatgcttaaaaatgcttgtttttattataggcagtggaaaaaatgtgagtctcaatttgcttgccctggaattgctccagctagcagaataaatcaaggctagaaccagatcagaatttcttacgagatgacagggatctgaaggactttacctctatagtcgttttgcctttttaggcactgggtgacctggtcccatgtccatcctagtgggccctgtatgatccaatccaaaggcccctttaggtttgcgttttatcattccctctttctcagaatttgatgtttgtatgtaaaagcactctggaaaatatttaaatcatggtacaaatataagagaagtcatgcaggtatggaattgctttgagaagtatcattttattaatttgtctggcttgataccaattacctgatgcagttgttaagggcagatccatccagaaacctttgggttctctgctccctgattttgttttgcaaattatataaccatacttcatagaaaacaccagtggtggctatgttgttcacagacacaaagtgattctaaggcaaccacaggagagagacacaaaagaaatcacacaaaaatctctcatcacaacataaatattgtgacaattgtgtggtactttttgtcttttttgttctctctgttccttttttgtcagtacaagtaagtcatcatgaacaaataagcttttgtatcctgcttttttaacctgacatgttcacagaacataacctagtcacacacgggcaagtacatcttctatccagtgatttgtttcaccatcaccctgcacatcacttttctcatgtttcaaatgatttcctcagaagagacatctggaaatgggattactgagtcaaagattctcaacctcttttaaggcccttgatatgtagtggcaaattgccttcctgaagggctgtgccagttgacatggctggcaggggcaaggcttgagtcttcctctggacctgtacatgggtacagttaacattaaatttttttaatgagtataatttacatacaataaactggacaagccttcagtgcataggcttggggaatttttacatacctacatttgggtaaatgccacccagatcccagatctctctctctgtagacagatagatacatacatacataaatacatagatacatagattgatctatctgagcagcatttatatttatatatgatatatcacatatgatttatatatttaatattatatatgatttatatgttagtatgaatcatatacacataggcttaatttatgcataaacatatgtgcttcacatatctttacatagataaatataaatataagtatgtatatatatatatatatatatatgttccttacctacaggatccaacacaagattaacttagatactttccagcttagatattaacttagatctttccagatcagaataagaggaagttggaaagtatctaggtttccagcaacaagtagttaattatattaacatgaatctactcgatagactattatgtcatcattttttaaaaatgaaaacattgtaattaatgttagaaaattcttatgttataatgctaggttaaaaaaggataggtgtgatttttatatataaaatatatgtacagcatatatatagctacatatttaaatatataaatacagcatatatatatttatatacttaaattataaatatatgtacagcatatatatacttaaatatataaatatgtatatgctgtgtatatatttatatatataaatcacacctatgtttgtgtgtgtatgtgtgtgtgtgtgtgtgtgtgtgtgtgtgtgtgtgtgtgtgtgtatatatatatatataaaatatgatatttccattatccccaggaagttttctagtgcctagttggtatgtagtgcccagtcggtgtctccacccacccccaaggtaaccactattctgaaagtccctcatttttgagtgatttcggaaatgttcttctctcatctgaaatgatttgacaggcagtctctgaagggagattgccatggctttggtgttgctcggatttctgccaccttacattggcaggctcaagaagatatgcacagtctttatttcattgatgtccagttgcctgtattgagcttagctatcctgtgcccaggttgccttagggatcactttgtgactatgtgcagcttatccactaccttttttttcccttcaagaattaacaaaaccactaccatctgttctgaaccatgtgcggtagcaggtagggggtgacaatgaaggtgtgttacagaaataaagtaggagccatgctgactttaaagaaacacccccacccccaaatgctcctggctgttttctttctatagatgagttaaaacagagggtatgaagtgcttggtttgcaaatcctgcaatactttgccatggcaagtccctaggaagtagattaaaagtggatctcccagagtgattaggattgggcagataaaatgatatgtttgttttggtcaattgagttcgaaatacaggttcagacagtaaatactcccttgctgagactaaacagtcattttgttgttcattttgatgaaaatcatggctcccaattttccgtgaaagctatcctttctgagatagactggctcttcatgagttatgaagcacctgaaatcctctctaacagcaaaatcgaggggcaacatcaaggttaggaacatcacgagcaagaacttacggctcagcagtggttgtaggtgtaaattcagtgtcccaagtcagaaaccaagaggtgtaagcccaacatgaaaggcaaagaggggaggaaattaacaaagatggaggctaggaacaacgttaggggctttcatatgtaataatccatttaatatttgcaataagtttatgaggttgatctatataaatctccctttaaagggagggaattgaaacatgtccagagtctcacagttacatttcttctttgcctctttccttccctcttttctttcttttttccccttttcccactgttgacacattccaggacacacatcctcctcctgttttccttttccttcacatctttctcgtcctttgctgtaacatcctgtgccataacaaactgtcacttatccagtgtggcatgccctgtgaagccttccctgacaccgtgaaccatagtaagtttacaggacccttcagtgttggagttctatcttttgcagctcccacagcacctatagaagttgtgttcacagagcactcaacaatttctaggcttgaataatgctgtgacaaagatggggttctgttgggaagacactgtagccactgtcagcataaagatacaaatggtccttgtaaatggatggagggcctttgagtgatttcttatcaatggaagtgccttaggaaatgcccagttgctgccttaaaatcaatataattatccaacattggtcactgagtttgttcctttgccaccctccccacttgcatgtggaaacctttttggccatattttattttagtatttcgccaaggagttttcagtcatcttaattaataacaaaaacacatcaagctggaaggagatggcctgaccatagtacattcctttaccaggactctgtagacaggtccccagctggcatacggatcaggagctcccattccctccaaggacccgtgaacagttcacacctacagtgttagattagaacagatgtgaaattcaaatgccactaggttgttataggtgttctctgaaaagaacagtggtaaaataattagtgcatctaattatcagtgtgttcacatgctttatatttttaaagggccacagcagtggccctttatatatatatataatgtgagctatatatatataatgtgagccatatatatatataaaatgtgagccatatatataattttaaagttttttagtagtcaatttaaaaatgttgaaacgtgaaattaattttaataatatatatttaatttaactgagtaggccccaaatattatcaccttgacatgtaaataatataaaaatattaatgagatattttacttgtttttgttctaagtcttagaaatctggtgtgtaatttatacttacagcctacctccttttaagctggctatatttcaagtgctcaagagctatatgtggctactggcgatcatattggccagcacaggcccaaagaaacttctagtggagtctttcttataaagatggagctacgtttgttcataggcaaaaccaaaaccaaaacaaaaaatgactctgtatgtttattggtcccatgctctgtgctaggcactagagtggggagacaaaagggtgcagtgcagcctctaccgtaaagcagtcacacgtgaaaagtgaaatcattttggttgtaatttataatgtgtccaagcacaaggcagtttttgtgattaattctcaagcaagtgattctggcagcttaggactgtgagtttaaaggagaaagtaatccctactatttgagatggtcatggaggacaggggacattggacaaagtataatatttgtctgagatggggaaagaggagaacaagcagttcatgtgggggagacagcttgaacacatctacagaagcattgtgacacagagagtagattagcttggctataactgagaattcacataaaggaaattgtggaaagaaagatgggattccttttggctgtattaaagagagttggactatatagagagatggctaagagacctcagttaacaacaggaatgaaaataataatcgcagctagcatgttcctgattagggtccagtccctgtatcaaattctttgcatttttttgtcactgaatattacaaatgagaaagtggaatctctagagaggtagaagtacttgtccaaggtcacacatccagaaagttggcctagcaaaattttgaatacagaaccttctgagttcagagcatttactttaaccatcaggagatatgctcctgagaacgttggaagcagtgatctctgtgtttgattaatgggacgccccccagccctattgacaaaggtgctgcccaagtgctgacgtaccacctcaacataggacagagaatttccaggccaaggattctctgcagtttgtgtcctctgaacagatacaaatgggccttttagcatgatgcccctgaaagttgactgaagtcactgactcaggtctttacaacccagtgttccactagttggtttcctcctttctctctcctcgtataccccagtatcatactagaatactgggatctcagagaccttttagttcaaggccctgttcttatagaacagaaaacagaggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaaggcctgaaatagctagttgctacttaatgtttgctgcttatcattgcatttgctgggacctggtgcttgtcatgcttatgcagtacaaggagggaccaaagaggcagaagacagtccctgccatagtgaagtgtagtcattttagaggacaggactaaaaaacacgaagcaatgaacaaaccccccaaaatacaatagtgtgctgaatgatgcagtgcagatacttcttagaggtatttaggtgtagctgggctagattgtttctgtattgcatcaatagattggtccatgttgactattccacttcacaatatctcagggatggacaagatggcagagttcaggccccaaatttaccaaaatagaaattttctccatcaactaatgagtggataaagaaaatgtggtatatataacccacggaatactactcagccattaaaaatgaaataatgaaataatgtcttttgcagcaacttggatggagctgaaggccattattattattattattattattattattattattttttatgaagtctcactcttgcccaggctggagtacagtggtgtgattgatatcagctgactgcaacctccacctcctgggttcaagtgatttttgtgcctcagcctcctaagtagctgggtctacaggtgggtttttttttttttttttttgtatttttagtggagacagggtttcaccatgttggccaggctggtctcgaactcccaacctcaagtgatccaccagctttggcctcccaaagtgctggctttacaggtatgagccatcgtgcctggcctagaggcattattctaagtgaagtaacataggagtgaaaaaccaaaattcatttgttctgacttataagtggaagctaagctgtgagtctacaaaggcatgcagagtgatacagtggactttagagactcagaaggaggagggtgggagtgggccagggattaaaaaaaactacacattaggtacaacatatactactcaggtgacaggtgcactgaaatctcagaattcaccactatataattcatacatataacccaaaaccacttgtaccccaaaagctattgaaataaaaaaattaaaaaaatatgtaagttccatttcagcatgagaaatacttcttagaggagtgttcataacataggttagtccccatgagatttgtgcataaagaggactccataggcaagccattccatatcttcctcttggagacttaaaagacatgttcgttcgtatattaaaggctatacagctttcaaacttttttatcaaagtcttgcagtttgtaactttgactttaacccagtattaaccaaactagtcttcctacagagcctttatttcgtagtccatgttccatgggccttgtggcagaacacacaatgggaaatgctgctttacagtggactcttggctccccagtaatggctaaatgcctgatttggttatagttctgtcagcccctgttccttccaaacgagaatcttgtgcaggaagtaagaaagagaaactagcccaagctattttgacaacaggcctctgactgaaacaacctccctgaatggttgataaacattttccctctcttaagggaaaatcatgcacagaaacaagcacatataaataatttaccaagctgtaatatgctgtaaataacaaccctgctaaataatgaattaacccaactgctgattcataggtaaatgtctcttgtaaagcagcatttttatggattttatagcttagttaatatccactcatatttcattaggacacttcaggtgaagtattggggtaataatctggatatatttgaaactgacatagcacatatcaggagtccaggcagagtttggggagctgccaggatccttttgtcttagctagagcatgaggagagattgtactgggccttactcttctccttcctccatggtcttggtttgcccagctcctcagtgcaagcctgagttgctgagcaggatgcggctctgatatcagagagggtgtcctctctgagaccacgggcagggatggaaggagaggtagctctgggccaggggaagaaagggacacagaaatcactttggcctactcgacagagccagctcttctgagtttttatgacacaggtgtgcagactctggagctgaactctggatatttgcatctttaccacttattaactttctgacttgggcaagtcacttatacactctgtggctcagtaccctcacctgttaacagggacaataaaagtacctactcctagggttattatgaagattaaatgagtttgtattgtcaagtgctggaacattgcttggcacataagcaagtgctttcatttatttattttttgagatggggtctggctctgtcacccaggctggagtgcagtggggagatctcagctcatagcaacctccacttcccagactcaagtgatcctcccacctcagcctcccgagtagctgggattacaggcgcatgccaccactctcagctaattttagtatttttagtagagatagggtttcgccatgttgcccaggctgatctcaaactcctgggctcaagcaatcctcctacctcagcctcccaaagtgttggaattataggcgtgaaccaccatgccgtgccagcaaatgctttttgagtacagtattagctgttatatttgttagaactggactcttttagattcttcattttggcattctccagctctggtgttggattctgagaacctagaccctggggattggagggcctgggtggggagggggtcaccgggatcactcagatgcctcttcttgcctctaaagaatgggaacgggggccaagtgcggtggctcacgcttgtaatcccagcactttgggaggccgaggtgggcggatcacaaggtcaggagatcaagaccatcctggctaacacggtgaaaccccgtctctactaaaaatacaaaaaattagctgggcgtggtggtgggtgcctgtagtcccagctacttgtgaggctgaggaaggagaatggcgtgaacccgggaggtggaacttgcagtgagccgagatcccgccactgcactccagcctgggcgacagagagagactctgtcttgaaaaaaaaaaaaaaaaaaagaatgggaatgggaagcaggaactatgatttcattacagtgaggaaaaactgcttttgatgatctctcagtaactataagtaagaaatattctcttatttaaaaggaatgttatctatctttgttaatgagggttttatggtggggggaggtgatgagaattatcagtcaaatcactttgagaaggaggagatctgaatttcataaataaaccctaatttgttaatgggaactgatgccaaaaacaaggagtttttcctccttgcggtgacactgaatgtcctgggctgtggagggtagaaacaggacattctcagtgttccagctcacaggggtggagttagagtaaatatcctgcccagtttgccatcacactaacactgcataccctatcatcagcctaatgacctttcaattctgattgaatggaagagcactccggcccttgatccaactcgtggttgattacagtgctcatgccccattaccccaaatattcctataaattaccagagcgagcattcacgcttatacaccatcatagatttagctcatgccggtggttctcgatagcagccatctgaagctccttttgcccacagctccctggatagctccaccattccctgcatgctagtcttgtggtttggtcttcagcctgctgtctgtactttctcacacgttgcatgggctttctccgatgcctacaagcaaaatctcttttccattcttcctttctctggctcctgggttcagaaatctctagggatcattatcagtcctctggctgccccctctcctacctacctccatctaccctagctctaggacagacctatggcgatgcccaactttctgcattttgaaataggggtgattgctttgacttgggccctatctattagggtctttcatctgtctattttggacaaagacaatagcagtgaagcagggggcctttgcattgagaggctcagactctcaaactctctcttaaaaaaaaaactgtctggcattaaggggcatagtctgcttgccttcaatagacctcaggctggggaggctcgaggtgcctactagggcagccagtttgcatagtgccttctaaaagcaggaagagccacccttgctgccttacagcctttgtccttgggccttagaatgaaacgcttcagagctcacaattaacatttggccaagcctcttcctcacccccacccccgtgaagtgggaagaaatacggtggcgtgacattcactttgacaaagctctttttcttttctctacttctcaaaaaagcctaaagaaataaaaacagttgctaagctactgggtgggctctatcggtgtgttttgttgcagtcttggcgttaaggactcatgctatcatatatgcagcagcttagactaaagggaggaagcaaagtgcttgagagggctctcttgcaagttcacttttttgtcaggtcaagtgcttggctctgggatggcaggggacatggagcatgacaactgcaattctctctccagatgggaaagtagaagggaggatttcttccaatcctcaaattcttccaaaagagaatgctgttttggaaccttgtctttctttaccatttatttcagaaaggttggatctctaggaagcatgggtcatactcttagttctctgggtattgtcttttgtacacatcacatgcagttggtgctactgatggggcctggacactagctagttctggtgagctcctagctcagtgtgccagaccgttgtactgtattgtatttaatttttttgtctccagcattttcttttcaaagctggtgaatcccaggttttgcaagttttcatttaacaacattcacataatccctaaattcagcatggtttataacttgttaggtccgtttgctatatacaaatgccatacctccaattggtactgaggaatggttccccactcctgatttaaaggcattaacactgagaatggtggaaagagagcctatttcccaacactgctttgcaacatcctctaaatctttcataatggcctaatccacccattgcgcgttggttctcagtgtggggacaatgggggcattactgattttaaacttgttttcatcaactagctcattctgtgtagagttgagtttagaaaaaaaaaacataaaaattaatgcagcctgggacaccctctgtggaggatacattgaaaatacatcttaaataaaaacccaggaaattgtcccttctgtctttcacctgtcagaatcagcaatagaattctatagaccattcagtggcatacttaattaagcaacctatctgctgaatgtgctgggggttggctgacagtgcttttcactgctgatttggatgacaaaggatatggtgagatactcaacagtctggtggaatggaaagaaactcccaattggtcacacctacctatttctcttggcatgttgcattagctctgataatacagaaaatagactggcttttatgcattgagaaagtcagtggacaccaacctcttgccttttgctcttccacagcaagccctgagttttgcacacatttccattacagatgaatacagattttagttgtaggtgagaaacatgagcttgtaattttcaagagacaaaacctccagctgctttttttaatcctagtgcagaatagttccttcctgatcatcattctatattttgatggcagttattgcctatccctaatgtatattattagtattagggacagttttgcagtgtttatctggtgccagacacatgccaaagcatcatccctcttgccaactctgtagggtaatactctattttgcagatatgaaaattgaggctcaaaaaacttaagtgacttgcctgaagtcactcaaccaaacagtaagtggtgggtcaagcttagaacatagagctcttctaccctgcagtccgtgcttttaaccgctctcttgcatcgtctctcttgaaagccgaaagagtgtcacacagtacaactattaataactaggggttggggcacacgtgtattaggattacaaaccttttgggagtctctcccacaaaattgggctcttcacctaggttttgtagagcctttcagtatccataaagcccttcaaactagatgcaaaaatatgtgtgtatattcaagggagataggccagagttttcatcaacttcttgaagaagtccatcacacacaagagggttagtaacttccacataatcctaaagtgcatgtagcacttgccaggcatgaatatgattcatgaatatgtgcatgaacttaagcaaactcatttcattctcaccatagctatcagaggtaggtatgattatcatgcccattttacagaaggggaaactgagactaagagaggttataaagctaataagtgacagcactgggatttgaggccaagcagtctagctcctgcttttaatcacttttgactgcaatttcctttttatttacttgcatatctccagcacagtgcccgacacataatgggatgtttattgatatttgttcaattgaattgatttgcacactgccggctctgtgtagatttcatcttaggaatcattctcaaaggtgtgactccgtaagtcttggctggacgaatgaaaagaatcaacatggtcaaaagataatttattagagtttctaaagacaaatggcttggcaaagcataggcattttactttcaatcagtgttccctggagggctgttacactgatttccaagcccattcttctcccaactggctcactagattgttccaattggttatgtggtgcccctgagtatgggctaggtaactctgcaggccccatgaatctatgtgatgtttcatttcctgattactatgcataatctcccctgccttttatttccaagtgaccaaccagaagccacccaaaccctctgcatattgacatgattcaaatgtaggtctctacaaggtatgccaagcttattgaggggaaggtggggggagatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacatgttccaaggtttaactttgtggcctccactgtttccctaattttacctgctgcgatcttattttacttttcattttattctctaatcaccgccaattagagccctgagtccatgctggttctgttgtctgcctctcagcctaatgggcctctttgtactgaggcacagaacccagctggcagcgagacttcctagggcccggaagcttcattactctttgttggcagtgaactctaaagttgctgtctttggagttgggttttctcaagtacagtcacttaacatttggtctcaaagttgttgtttttcagatttttttctcttttttcctaagtcaatcagatgcatgagctaattataagccagcaaatattttgagaaaacttccctccagtggagacccttgcacaaacttcagactatattcccagtaattaatatgctccttttatttcctttgaggtggaaaacagtcattgacaatcattccctacccatttggttcaaataactaattttgtacctgaagactaattacagtagtgacaccatcttttcctattaggtctctcacttgaagaactcagagcaatttataacctttgaatcttggggactagtttaatctgttcgtgggcagcatagcagtgaacattgttatcagaaatatagttaaacctctttaattgagcccctattaattcaaaaggtaataattcaaacagtgtgaagaacaaacttgaaacgtctatgacaagaagaaagtaagttggcaaaggggttatttaaactgccaagtagagcacacttttagaagtgccagttcacatgcaaagaactggtaagtacacacaaattgttccattaatagactcagaatcttaagattaaaagccctgtagtacaactgttcataactcaaaaaacatttgttgagtaatgctatgtgctggggcctggggatataatttttttgttaatagcttcattgagatataataaatacaccatataattcactcatttaaaatgtacagttcagtgatttttggtatagtcaaagagttgtgaaaccatcactacagtctattttagaacatttcatcactctagaaagaaaccctgcatcctttagccatcactttcccatccccctattactcacagccctaggcaaccactgtggggatacaaatttgactaaaacacagtacctgcctttgagaggatggcaagctattgaaagagacatcaggcaggtgaagcgtacttatcatagcatcgtagaatgttgatattgagaggcactaagaagatcatcagatataatcttctcatttcacatatgaggaaactgaggcccaaagacaagaaatgacttgcccaagaacaaaaagctaacagagccaaaattaaaactcatgtattgtgccatcttagcctgttgcaatgttaattacaatacaaacttctggagcatagtaacagttgagagcatggattctagagccagactgcgtggatttgattctcagcttaccttttataggctgtgtgacctcaggcaagttacttaacctctctcagcttcagtttcctcatttgttgtcttgaaataataattgtaactaccttataggactcttgtgaagattaaatgagtttctatatgaagtacttaaaatagtgtttggcacagaataatcgatacataaaatgattgttattattatttcattacctagttattaaatataaaaacatttcgtaatgtcctaaagtatattttaaatatttgttcttcaggttttaaatcctgactgtattcatacataatttctatttcgtttcttccaacatatatttttgagtgttaggggctaggtataaaaatgatgtttaaaacagagttcaaatgcctaagaagttcagtcaggtaaggaaggcaggtgaacagatatgtagctataaatcaaggcaagcaacaggaagtgccccaaataaagtatgtatgaagcataaagggtataagaaaggcttcaaggaggctgtggcatttgacttgggttttaaaatgtgagccagatttcaccagactgaagagggcgagagaagaagacattccaggctgaggtaacagtagaagtggagaaaagaaagtatttgccatggtttgggaaaggctaagtgttgtatgtgttcatcgcatagggttttgcaagatgtcctgggagacgagcctgaatatagatggggccgtgctcagtaggaaaagggaggagaatttatacttactgaacaccttttatataccaggttctgaggttgggcgcagtggctcactcctgtaatcccagctacttgggaggctgaggcacaagaatcgcttgatcctgggaggcagagaagtgagccgagatcgtgccactgcactccaacctgggtgacagagtgagacaatgtctaagaaaaagaaaaacaaaaacaaaaaaactatataacaggctctgtaaaataccaagtactagatatgtatgggtaactattttgattctcacaatcatcctgaggaagcagtgtagacaggtgatataaattgatcaatatcacacccaatatgtggcagactccagattcaaactgaagtctctctctgatgctaatgcttattccctctccatataccacaccaactcctgaacttctgtaccagcttggacgttatggaaaatgggagctttaaatgttcttgaaggccaggcacggtggctcacgcctataatcccagcactttgggaggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaaaagtcaattgtgaggcttttacggtaggtaaaaggcagcgaggacatgaactaggggcgtggtaatggagaggaggggacacatataagagagggattgacaagacaggacatgtgaccaatttgatgtggtcagagcaagagtcaaagagagtcaccaatgaaggcatgattttttcagcctgtatgttgtgatgggttgaactgatggactgagataagaagcctgggcatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataaggaaacggaggtcaacattgctaagcgctaaagaatggccaagttagatagactgaaaaatgtcccttggatttagtaattaagtaatttagtaattaaagaggttattgagtaataagaagcaaaccaagtagaatattatgggtggaaattatgtggcagtggtttggaaactgaatgaggaatggagacctggagacataaatgtagacaactctttctagaaacttgtctggtaaggtatagagagatgacagaatcttgaagacaaacagatcctgaataacttttttttaattatggagaaagttgagcatttattttggctgagaggagtgagtcagtgaagaaagagctagtaaaaggggagaaatcgggggataacggataaagattggagaggtagcaagaggaccaaaaggaaataggaaaccacagagagatggttagctatggacttgagcccttcctctgagatggggttttgaagcgaggatgcacaggggcacagataaactaaaggctttttccaacagagtctgaggtatttgtgattgattattttctttaatttagaattctctgcgtaagaaaccttgctctttttacactatgtaaaatccttatggaaacaagaacaacaaaaccaaacacaaaaacctactttatttaaatgtgggagaagggcttgaataatttctcccccccccaaaaaaaaaaagatatacaaatggccaataagcaaatgaaaagatgctcaacagcattaatcattagggaaatgcaaatcaaaatcacactgaaataccacttcacacccattaggatggccattattattattattttattattattattattattattattattattattattatttgagacagagtcttgctctgttgcccaggctggagtgcagtggtgcaatctcggctcactgcaacctccacctcctgggttcaagcaattctcctgcctcagcctccggagtagctgggattacaggtgtgcaccaccatgcctggataatttttgtattcttagtagagacagggtttcaccatgttggccaggctgatttcgaactcctgacctcgtgatctgcccaccttggcctctcaaagtgctgggattacaggtgtgaaccaccgcgcccggccaggatgtccattattaaaagaaaattaaaagtaagtattgttgaggatgcggagaaattgcaacctttgtgcactgctggtgggaatataaaatggtgcagctactgtggaaaacagcatggtgctttctcaaaaaaattaaaagtagaattaccatataatccagccattccacttatgaatacagaaccaaaagaactgaaagcaaggatttaaatagatatttgtgactatagtcaataataatttaattgtacattttaaaataactaaaagagtataattagattatttgtaacacaaaggataataaatacatgaggggacagatatcccattttacgtgatgtgattaatacacattgcatgcctgtatcaagactgtacaaacaaaatgtgatatatatatatatatatatatatatatatatatatatattattcagcctttaaaacaaagttctgacacagctacaccttgaagacattatggtaagtgacggatgggtgaactttgaagacattatgctaagtgaaataagccagttacaaaatcactgtatgattccccttgtatgaagtacctagagtagtcatattcatagagccagagagtagaggttgccagaggttgcgaaagggaggaatggagtatggactttcaatttggaaagatgaaaaaagttctggagatggtggtgatggttgcacaacaatgtgaatgtacttaatgccactgaactatatacttaataatacttaaaataagttttaccaccattaaaaaaaaactttctagagccaccattttagcttgactggggtctcctgggttgttcgtaacctagagtagtggctctttccactgctgacagatagcaaatccagagcagacacctcgtgtaagagctacctcttagcagaactatgattcaggtttgtgtgcattacatttaagccagctgacatatcactttctttctcactgctgtgtacacaatagtgacatgatcaaacttgaaagtgcatgagaaacaatcacttggagaacttgttaaaaatgcggattcacaaaatcatctcttccatcaaactaatgtagtaggtatatcagctagtttgtgctatataacaagccacccccaaaactaagtgatttaacataactgtttattattttatagcctatgagttggctggatggttctgctcatctgggccaggcttcgctgatcatagatgtactcagctgcagtcagccagtgggttaaccagggcttggcttttccaggatggcctcagttgggatgactttaatctgctctacgtggcctctcatcctcaaaacatcagcccaggcttgtttttgtgctgtggcaggagtctaagcaagcaagcacaataatatgagggaacaagaagaaatgcacatgagctcttcaagtttctgcttgcatcctatttgctaacgtcctattggccaaagcaagttacatggctgagtggagattcagagtgggaggggtgtacaaagagggcaatagcaaggatgtagagaggtcactgggtccactaatgcagttaatctactacagtaggtttcagtaaagcctcggaatctacatatttagcaagcttctcaaagtgatttttttctttctctctttctctctttctgtctctctctttctctctccttccttccttccttccttctttctttctcatgatctcactgtcacccaggctggagtgcaatggtgccatcacagctcactgcagcctcaaactcacaggctcaagcaatcctcccgcctcagcctcccaaatagctggaactacaggcatgcaccaccaggcctagctgtttaaaaaaaaaattacagagatgaggtgtcattatgttgccaaggctgatctcaaactcctgggctcaagcaatcctcccacctcggcctgtcaaagcactgggattacaggtgtgagccaccatgcccagcctaaagtgatactgatgcaggctatcccttaatattttcagaaatattattctagtatctcttaacaccaagattggaaccagcatcattgaacgttcagaaaacgaagactcagtggggaagggagcacttattcttctccttatttccagcttatgattcaggcctcttggtctcttagaggcagatgctgaaacgaacactctctgtctgcttttcagacaatctcatataatcatttacttgttacaaagaacaatggagttggattaaactgataaagtgttatttttcaatgcaggtcaggaaggcattgttggtttgttttgcattgctcattataatttctatttttgtcctggggaagctcatggtaatggaatgaagcatcgaggtggtttatgggccatgtgataggatcataaagttgaggttgttgcttggacaatacctttcttagaatagtaatccaagcaaagagaacatggacaggaaagaaaagaaacaataagaagaaacttcagttatttagccagttgtatgaggttttcattgctcagatccttagttaaaatgtgggatcagaggcctgcaggtaatgcctgagctcaggaaaggcagggaccatgatgcttttgcattcctgatacgaaccacagtgccaaccacattgtcagtactcaaaacgtatttgttgaatgaatttctgctaattcctgggatctattctcagagattctgattgagcaggataagtaaatagtttttcacagtgtggtccctgaaccatctgcatcagaatcacctacagggcttgtttaaaaaatgaatgccagggccgggcatggtagctcatgcctataatcccagcactttcggaggctgaggctggaggatcacctgaggtcaggagtctgagatcagcctggccaacatggggaaacccagtctctactaaaaatacaaaaattagccaggcgtggtagcacaggcctgtagtcccagctactctgtaggctgatgcaggagaatggcttgaacccaggaggtggaggttgcagtgagccaagatcacaccagtgcactccagcctgggtgacaaagtgagtgagactccatctcaaaaaacaaacaaacaaacaaaaatgaatgccaggatcccaccttctacttcttgcgtttgatgcatgagaaatcctagtttacacattttattaaatctgggactggttgtaactggcactaatgtagtcttgtgtgaaggtagtggtgcgatggtcattctctacccttgccccacctgagagcctctagagggaaggctgtggtccagtgcactgacctgaaccctcaccacatgcgtcccacacatatggaattgggagcagtcatttagcatctcttagccatttcgctctaatttctttgtttgccatttttgttgactttttccttgggaacctgaatttaaactcatgccacttttttgtcttccttattctagtgggtaggaatttgatcttgaccccaaaagcaatgataggttcctacagttctgtaaagtatccattgcttctgaaaggccttctttccccattgtctttgacaatttagattttccaagtgctaggattttggagaaagtggagccatgagcccaggcaagtggggtagcctgataatgccctcccatgacacatggggctggggatgtaaaaacttcagagtttccatgtcaaataatctcctttgccctgtggccttcggttacaggaatcatttatattacaggcacattttgaaatatcaaaacaaattggacactttttccctattaggaagaaaggcatgttaatttaagtgtggagtgtgacatttggaaatgtaaaaagaggcttttggggagtagttgggggtttgagtggaatatctccctttttgtatatctctcttgtttttattcatcctgtgtcttattcagatagtgattttcattcacctgcctgatcttctggaacagggattttagagaaagccattttctcagcagctccacaagggcgagatttccaaatgggcaaggaaaggctgcagagacacatctagcttggaagtaaatgcaccaagccagccaaattggaattgtcttatagggatccttgtgtgctgtcacagaagagttttcaggaggctttcctttgggcactaatggccaaccactgctgctgagtttctcccagccttctggagggaatgccagccagcgcactctcagctgtgacatgaccctcctaggagctgttcaatgctagcgccgttttgctctgatgcccagcaccctctgcttttagtcactttccttagcgtcctttcgcagtgcttgcatttcagccaaaatcgtgcctcgtgacttttcttttcctagagttttcgcttctcacagtgaagaatctatcagctgtttcctgaatccttctatgtcttttaaggtgttaacattttcaattttgccacattcagcatttttggcctactctgacctgagctcgataaagagcatcagaaattgagtaaagacagaaataagtccctataagcatgagccctggcactgtccacttcctcctcctcccctaccctgacagcactaatctcccttcagctctactcattggaccccctttattctttaggctctctttagtgatttatcttagtttagctatgagaagaatcaagctttttaagggcttcgctgaaaacgtaatgaaagttgtttcaactctttaaattttaagtgaattgtggccatctcaggcccactagttcatgtacctgatacaatttttatttggagccactgtattcacatcttcctgggacaggatttcacataattggggtaggttaatgagtgtggatttggcactccctttctatagagagtggtaaggagctcaggccttggagtcagtcaggtgtggttccaatcctggatctactattaggttggtccgaaagtaattgccatttcggccattaaaagtaaccgcaaatacttttgcaccaacctaatacttagtagctgtgcagtcttgggtaactcgtttcacctttcttgtgtctcaatgtcctcatttgtaaaatgggcacaatagtcccaatcacataggttgaagactaaaccaaagaccccatttcattagcttagccttatccctggcagataccatgaactcatatgtcattataattatgataatttacttaccctttcaattaggggtataagatgctacacagttttcctctaggacagggcccgcaaaccatggcctgcagcttgcctgtgagctaacaatgattttcatatttttaaaaggttgaaaaaaatcaaaagaagagtgccgtttcgtggcatagggaaattatatgaaattcaaatttcagtgtccataaataaagttttattggaacacaactgtgctcactcatttatatattgtctatggctgcttttgctctatcatagcagagttgagtggttgtgatagagattctatggcctagaaagcctaaatatttgccaccttgccgaccacttgccctaagacatttagccatgtctctggaacatcactgtgatagatagttcaggaattatttgcatattatcatcactgttattccaaaactctgactgcgtgtgtttctgtgtggagagtgatttacaaaggaagaaattatacaagtcataacaaaaagaaaaaaaaaaaattacacaggtccatgtaagacaaatgagatgaggcttttgtggcagttttagctaaggactcactttgtgccttcgagggatcagaaagaatttagaagtagtagcaatattggttaggagaatttacagattctcttgttttcttttcctctatcagtaccttctctgcaaggaggagagaatggatgttagtttctccttgtaagatgaattgaattgcttgtgttagtgtactaggactctgggttggttgtgaatgtggtataccaaggcaaagtctcatctgagcaaataccaccataacaccctgttctcccccaaaaggcaatctctgtagagaattataaaatcttagaatatcaagattggaaggagcctggagatctgagggaatgatattgatattaatatctccttgccgatgtagatacaatatcctgtttgaaggcaaaacattgtgtaataaacccagtctactcaatctattcaactaaggtggcctctagtgggtgtctgagtactggaactagatttgaatacttgtgagatattaaatttcatatgctttacaaaacgtgcagccatccgggcacacaaacaaaatgcccacttttggatgtgaaagtgggggcaggagtttttcccatttaggagctaaaagctctggagctctggtcctcagattcatcttgtgtctggcctgtggtcgcagtgagatgccttttcagtagggatgaggtatacttggggctgggagaggggggacatttggaggtctggcctcccaggggtaggtatgtgtttagccgggctatgcagatgaaccaatctgggtgtctctgtcagggaagaggctaggaaagctgctggtgagaggggtcagagactggtttgccccaagggggatgggggaggcagggaggctgtagaggagctgttgggccagatcttgttgagaaaatctctcagacccgagacttctcccctcctctcatttcctatatttgggctttcacacttaagggactggtcttaaggagagatgtactttttaacatttgatttgcccatgttgtgccccgtacttctgcgtaccaccagaagaccacaatgacaaagaccagcgaaggccaaaggtggccatgtgtgtatagaattgacactccaaggtcaccggatctgcaatctaccaaacagtcttgactcacaccctcaggtttcatatttgaacctcctttgcagggctggtcctggctcctttcaccttctagactgcctttcctttcttactgtcctctgagaggcacactgaacatctgtggacagtggcagttggtagctatatatatacatgtatatatatcagaatttcctctttgtacactgtagcagtggacttccattttgatgatattatacagggtataaatctgcctatctcaacaagttgctttaaagaagaatcagtttcaatgtccaaactaccacttcagtaaagtaacagagccaatgccctgtgtctttttcctttatttatttatttattttgacataggttcttgttctgttgctcaggctggagtgtagtggtttgatctcggctcatagcagcctcaacctcccgggctcaagcaatcctcccatctcagcctcccaagtagctgggactataggcacatagctaactaatttttaaaaattttttattttgtagaaatgaggtttcaccatgttgcccaggctggtctcaaacttctgagctcaagcgatcctcctgcctcagcctcccaaagtgctgggattacaggtgtgaaccaccatgcccacccccctttttcttatgaatgggtgaagcaggagaagagcagtgagtatggctagagatgctgacaccatgtagtatagcaacttgtgggcttctgccttcttcctcaagatgaggccaagaagagcactgggacttccagcctctggtgcatgtgtttcctctgggctaggtggtatgtggtgtccaggtatctgcacacttgctcggggcagggttctaagcagtggatggtggcaatggatatggccaacaagagacaatcatggcagtgtcactgagctgtgaactcccacagaatcttttggcctcccaagctcagagaagaagcttaagggagaaaacctgtcaacagtccttttgccatatttattcactggagtcacacttttataacaggcataggctcaaaggtgtaaataaagccaattattttagttcagcattgattttcatatataaattatcaatatagttttgatttagtaataaaaataacagcctggagttttatcccctgccatggccagtgagagctgtttttaagctgtttctttgtacagggaagcatgtgtcaaagtcacacctcctgattaataaaaacaataaccttttagtccttcctatgttccaggcattgtgcagagggctcacaaatactatttcatgtaatgctactcataattctctgaggtagattagtatttgtatacgtatgttatagacggggaagctgaggctcaggaaatcacttacccaagacagcagctggcaattctaagaaaatttttgaaattctaaaatgcatctgaggacctggcactgtggctcatgcctgtaatcccagcactttgagaggccgaggtgggtggatcacttgaggccaggagttcgagactagcctggccaacatggcgaaaccccatctctactaaaaatacaaaaattagccaggaatggtggtgggcacctgtaatcccagttactcaggaggctaaggcacgagaatcgcttgaaccagagaggtggaggctgcagtgagccgagattgtgccactgcactccagcctgggtgacaaagcaagactctgactcaaataataaaataaaataaagcacgtctgctgccttcacaccccattttctgtaccatgcatgtcaacttctatagggcccttctcttgtatgggtgtccattaggtcatatcttgcagatatggcagagctagagacctagaggtaaagcaagatactaggaaaacaagtaaaagggagctattttctgggagactaggaaaaagaagagactaggaaaagtaagtgaagaagctctaactagtagggggccaataaggggcaaacaaaggagagaagctggctgcttagctaaccaagtagagagcctcggatctggaaggaactggaccgaacatctgtaactgggcagggctggccttgggcctgtcttgacttccttgaaatgtctcttttacctggcctccttctcatggctgtcatcaagcagccctgttgatcatgttcctgaggaaggacagaatggggttggggagattaagtttattagcaaggcaatttcctctagggagaccccaaacctggcttggtaactacagtgaaaggagagcgtttgagccccttcccccttctgcttgatctcctctccttcaccaggctttcttcagacctggttccaatcattataaggcagatctaaagccactcttcctgacactgaaactttgctgagcctggaaaaatcacagaggctcagtttggtgtttttgcatgcaaaatacgagaggcagaggtgaaggtgcattcctggtgccctgcggttcccaggcagtatctgagtgcattttcacctgttatcgcttgcctttcaaatattcgttagctcccccagaagtttagccacgagtcatcttctaggggaaatagctgctctgctctgtttgtagaatctcatagtttattttggaatgaagatgtattttcctggaaaagtgttactactttacagtgtccccttcatctgcgaaactgaaaaggcaggcagccttgctgtatgagaagaccacacacttgcggacagaaaaaagatgcatccgggcttctcttcaagtccaagacaattgatgacaaaggaagtatgacacaaacttattgagatctgttattatccttgtgctgcccgggttttagacaaaaacaataagcagattacataagtgagtgtcaccacttttgcataaccaaggtttcatttttctcttctcacttggttagtcttccgtgagctaagcaacatcatggtagttttctgtagtaccacttatggctttccttgttatcatcacctgcctttgacacatgccttcattaatgagttgatatatttaattatatgttatacagatattttatattacaagcaatgttaattgcattcattcagaacagctcccaattaaaatctataaactacttagacctctataaaaatcccaccatttaccttacagcttcacattaatatttaccctggagaggataaacatctcatcctgtatttatctgttagatcatttttgttgtcataaaaaacaaaagccacatgtttaattggatcccttcggtatgaatttttaaaataatagtaggaatccttacttgggaagatggtttcatagggcatcctaaaaccatcctttgttccaaatcctttgaggatgcacacatttaatgttttccttcttactactatgctatgaacttaacagtgctacatgctaaagtacaggcagcagaagttctctgggaaagtggagatccctagcaagtaaggaacccaagagaaggccattctaagctgtagtcccttgttggaccaagggaggaaggaaacagatagcatccacctggcgctgcaattctactggcctgtggggtggtctggctttaggaagctcactgtgtaatccatcagaggacaatcctgccaagtcttcttttcaagtaaaaaatgttaatgtttctttccatactttgtctcataatcaatattcaattttcaaggcagtaaaactaatcaaagaatataaaatgaatccaacacaagagaaaggagggagaatgagtaagctgcaaatgggactgagcaagaaaataggaggatattataactatagaattttttttttttgagacagagtcttgctttgtcacccaggctggagtgcagtgacgcgatctcgactcactgcaacctctgcctcccgggttcaagcaattctcttcttcctgttggtgaatttctcccaggaggcatgagccaagatcctgtttcatgggtttctgggtataccccttgaaacaccagagtcaggagtcaggaacaacacctagtgtattagttggttttcacactgctgtaaataactgcccgagactggataatttataaagaaaagagatttaatggactcaaagttccacagggctggggaggcctcaggaaacttacaattatggctgaaggggaagcaggaacgtcttacatggcagcaggtgagagaagaaagtgaaggaggaacagccaaacacttataaaaccatcagatgtcatgagaattcactcactgtcacaagaacagcatgggagaaaccacccctatgatccaatcacttcccaccaggtttctccctcaacacctggggattacaatttgagatgagatttgggtgggggcacaaaaccaaactctgttacccagttagaaaccggccagtcagcatgtagtccctctggagctcacaattgcagatcatggtatgatggagttctccactgcacggtaggctctggggcttaggcaggcatatggggcagcagtcaacataggggatggtgggagtgaggtgctctacagcagtggtcctcgacttttttagcaccagggaccagtttcatggaaaacaatgtttccatgggcttagggggtgggagatggtttcaggatgcttcaagtgcattacatttattgtgcactttattttgataattattatgttgtaatatataatgaaataattatacaactcactataatgtggaatcagtgggagccctgagcttgttttcctgcaattagatggtcccatctggaggtgatgggagacagtgacagatcatcaggcattagattctcataaagagcacacaacttagatccctcacatgtgcagttcacaatagggtttgcactgccatgagaatctaatgccactactgatctgactggaggcagaacagagctcaggcagtaatgcaagtgatagggaatggctgtaaatacagatgaagcttagctcgctcatctaccgctcacctcctgctgtgtgacccggtccatggcctgagggttggggacccatgctctacagcactgttatggcatgttccagactcttgagaatcggtccttccttgcatctcacctcaccttcaactttattgttcacttttagttcaacctttgccagcaggtaaagaggtaaagagaacaatgtgtcctgtgaagtatttatgagagaagcagataaatcattagatttattgagaacttttgaagtgcactaggcatctcacacacattacttcattgaatcacctccataatcctatgtggttgataattatattatccccacattctggatgaagaaagtggagctcagagaggttatcatgacatacatactgctcacaaaaccattctgtggcagaagtagattcaacagctcaaaaataaaagagggctgggcacagcagctcacacctgtaatcctagcacttttggaggctaaagtgggtggattgcttgatcccaggagtttgagaccagcctgggcaacatagtgagaccctgtttctaccaaaaaatgcaaaaaacaaaaattaggcaggcgtgatggcatgcacctgtagtatagcttcttgggaggctgaggttggaggattgattaagcctggaaggttgaggctgcagtgagcagtgattgtaccactgcactccagcctggatgacagggcaagaccctgtctcaaaataattaaaaaaaaaaaaagtaaaagagaacatgatgatttatggggaaattgacactaaaaatgtcttggatgaaataaagtgacccaggcatcaggatttaggggcttacatgggataacactgttctactccatagcacctcacctgtctaattagtgtctaattagagacatttttaatcagataagtgcatttatgaacattgcaatttttcccaaagtttaaccatcagtttctctgaaaggacttctaaagcctagaaactcacctcttgttaatagtgctgctcttcctcttaaggattctgcccaggagttcaacaccagcctgggcaacataggtagaactttgtaaagtggaataatgctattctaataacttatttagcaaacatttactgagcaattaccctgggtcaggcctccttgcaaggttctggggacatagacatgagggaattctcacccttgaggccatcacagtcagctagggaagaaaagaagtaaacagatcattataaaaccctgagataagtgctactgtgaaggtatgtaactctgtcccctgggtgctttggaagtgtgagagcttgggacattgtagcaggatgttggtagctccatcagatctggagtcttttccaccttgaacttgagatcagcctaaagccaaacacttgacttttaaatgatttgattttaacagaatcaactttttattatgcaaactcaaaagatgtattctgtagagttttactgagccttttttccctttaaaataactaactatatgttttgacatgcttcaggggactttttttgtaaaatagcacaaataggacaatactggaatacatcagtgtgctgtgaagcctgaatgagtaatacacaagtgactgcactttcaaaaatgtaaagaaaagtaacatgctaaaaatcataaactacaaagaggcggcatagcttggtgagacaagcgttgacttgtgaacaggaaaaaaaggatccctgctggctattctgctgagtgaccccaggaggtccctgttcctcttgggacctcagtttcctggttggtggaatgggtattggatgagaatctcaatctgaagatctgcattccctttcaagtcgctaaaatcctggacttctacgataatgctgcatccttctgaggttccaaacaacaatatgcagtaggggccccttttgcttccttccttgcatgtatccaggcagtctcctgagagcatccagcattggggaggaatggggtgtattgaagggaaaagcaggtgccccattgggaatgggacactcccgccccccgccctacctccttctttcaacttgacttccttttttttttttttttgagacaaagtctcattctgttgcccaggctggagtgcagaggcgcgatctgggctcactgcaacctccacctcccaggttcaagcgattctcctgcctcagtctcttgagtagctgggattacaggcatgcactattatgcccagctaattttgtatttttttagtagagactggctttcaccatgttggccaggctggtcttgaactcctgacctcaggtgatccacctgcctcagcctcccaaagtgctgggattacaggcataagccaccgcacccggcctcaacttgactccctttcttgtcactgtttctagatggtcaactagatcaatactcagatcagctcttctttcagaggaacaaatgagaactttcctcttgttctccatctcctccttctcctaatgcacacacatgtgcatacacacactccactgccatcactagagagaaggaattaggtccaaacctctgttcgcactcagagtcttaaagtgacagctttacgtttacaagttaggcattaaatggaattccattctccctgtcaagtttcagacaggggaaagcccagaattccaatagtgatggtgttcttggcaagcgctttttacagggtggtaagctaatcagtctgcagttcggcagtctgaaggcttgagctttcatctgacttggaatatataaagggcttggcattgcagcttccaaccctatgacttagctttgagcttcgcatcttcccatcaacttcgtagctctctccatcaaccaagtacccactacaatcaaggagaaaggatatggcagattaattgaatctttgtgtctttttagcacctgtgggctatggacttcttgaaattggagttacttttattcctttgaattgagcccaataccccgcttcagtcagggtgcttttaccttcccagaatcctcttgctaaggacaagcaggcaggctaatcggggactactgaagttttctggctcaaagaacataatgcagtgtgtttacaaatccacctcttcgccttcaccctaaattttcctttcctttatatgattttagcactttgggtttacattaagctctcagttacttaaagtaggctgaagaaaataagaagtgtagtagtgcttcactccccagtgatgaaatagggggtaattggctccaaaaatcgttgcatgtcttgtccctttcagggactttaactgctctgttgcccttgctccatggattggggctgcatcagtagcctaatgtgaggggaatggttgaaagtaattgtcagagcccagagctccacttgccatggaaagcctattgactttaatagtgaccatctggctgggcacctctgaagatgtctcagttaaggcctatttggtgaatggacctttgcttatttgaaagctacactgctgttccaacctgatcattgcattttatgtgatgggcactggaagtccaaatgaaagtttcttagaaaacactcccattaaatttaccagtccatgtgtgattgccactttcagtgcagtcagagcacagtcattctctttttattgaaagcatatggtaggtacttagagcataccctaggccagactcagttatggtgccatcaagggcagcaagaattaaaaagaggaaaatggtatccaggtggcagtaggaattcggtaggttggatggaaaatattcatagttaacgagctttcataaggagaacagaaacaagttagatgtgatttgcagatccataggcaatcagtctctgctgagcagaggggaaacttggagaagattctcagaagtgtgcctcacccttgacccaaacctttccctgaacatgtgcaataaatattattaagctttgagaatttctttaaaataatatctgtcaatggtaagtgccacatgccaggccctatgctaccagcatcatctcatatcatcctcacatgtatcctgtgaggtggaggatactatcccaatgttacagatgagaaaactgagacttaaacattaagttgttcaaggtcatacagctaagaagtcacagagctgctttgattaaagttctgtctgaggctgggtgcggtagtgcatgcctgtaatccaagcactttgggaggccaaggtgggcggattgcttgagccctggagtttgagaccagcctgggcaacatggcaaaaccctgtccctaccaaaaaattacaaaagttagccaggcatagtggtgcacacctgtagtccaagctacttgggaggctgaggtgggagaattacctgagcctggggagcttgaggctgaagtgagccaagactataccactgcactccagcctgagggacacagtgaaactctgtttcataaaaaaaaaggtctctgtgacttcaaggcctttgttctctatactattaggaagtccagtaagtgaagaaaagtacatgtaaatttcactaaaggatcacagcttcttgtacggaagggctttgagcacgtcggctgtggctcctgtgcagccagccagatctgcctaagcagctctgggagtagggccacacaggaatctgtcacagggaggattccacattccttcagcccctatcagcacagtcaaagaatggtaagaagaatgcagagggtggctttgaaatactcacagccttccatggataaaccatggagacattacactcatttgatagaagccagacacaaaaggccatattattgtatgattccatttatatgaaatatcagaataggcaaatccatagaaacagaaagcagattcgtggttggtaggtgatgggggaaagacttcagcaccatccccttccctctcagtctcagtgaagtggaaggaaggagtagtctcagctagggaaaagaggggaaaagctgaagacgacagatttctatgtctcccagtttaattacctttccctttgctctcgcctatgaatgccactgcctgcaggttcttagggaatcaaactgggacttcagtctggaaatgtgctttcaggacaaagacccatgcatacgagacaaggtgacaatcctaaggtggcccccagtacttcggggcagtggaaaggaccttgcgatgggtgccagaaggactaacatcaaggccagctctaccatgtctgaggtgtatgactgtgggcaagtttcttcattacaacttctgcaactgcacagtgactagcataatcctttcccattaggcactgctggatcattgcaaagattaaatgagggccaggtgcagtggcttacgcctgtaatcccagaactgtgggaggccgaggtgggtggattgcttgagcccaggagttcgagaccagcctgggcaacatggcaaaacccagtctctacaaataataataataataataataataataatcatcatcatcatcatcatccaggagtggtgaaatgcacctgtagtcccagctaatcaggaaactgaggtgagaggatcgcttgagcctgggaggacagggctgcagtgagccatgatcatgccactacactccagcctgggcaacagagtaagaccctatttcaaaaataaataaataaataaggagacatatgtgaaagcatttccgaagtctaaagctccacatacacataagtgattataagaaatttaacaaagggtagtcacataattgacattgtcctttggaggagagaaaattggtgctatccccttggtggacaggttccctcatccttaaagcacatttccagagcagaaggaagccttcatctaagtccaagcgctacatttctgatatgagagctagtttgagatttaaatgaaccctgtctctcaagacacagctttgcatctattttgcattcaaatttatttatctagagacaaaattgtgcattctttaattctactcacagcgtatgcacgcagaccaaatgaggtgctgatccagcaaaacggcaagtagccttttgcttccctgaaattgctaattttacaaatggcagagtggtgaaacgtggcacggaatatctattttactagaatccggcaaaacgggcacatatggtcttgtcaagaatgaatcaaacacagtttcgggattataattaagtagttgaaattccaaaaggaagaagttaatatgaacaaagtgagatttcgattgcttttggttagcattctctcaggctccttcctttacacattatcaggaacatagctactttgatttcttgtcctgaaaaatgtttaattgtaaaatatcaaacgttttcaccccaactctaattgtacttgatttgacatctgtacaccatgctcagggtaccaaatattattaaatgtaataagtccaggcatagaagtcaagccaaatgttcctacgtaagtatttaggttgacaccttctgtcaacaaagctaaacctctgaccaattctgtagcaggccaataaagatacaggaggaagatgggaaccattagaagaaaacactctctcctcatctctctctctttcagtactgtttctacctgaaatcagggacatattccattctggtccacaagcccagcatctagcacaggggctggcatgtaaaaagagttgatttgggctgggcgcagtggctcatgctgtaatcccagtactttgggaggctgagatgggtggatcacctgaggtcaggagtttgagaccagtctgaccaacatggtgaaaccccatctctactaaaaatacaaaaattagccaggcgtggtggtgggtgcctataatcccagctactcaggaggctgaggagggaaaattgcctgaacccaggaggcggaggttgtggtgagctgagattgcgccactgcactccagcctgagtgacagagcaagactccatctcaaaaaaaaaaaaaaaaaaaaaaaaaaaaaaggagtttatttggagatttgcaacttgtcatgggaaacattcccagggtttcttctagagttgttgtggacctgattttgggtgctaagtggtaactcactatatcttaaaaacacatcagctaaaaggtggaagcaatctacatgcccatcaactgacgaaggggtaaacaacatgtggtatatccatataatggcacgctatttattcataaacaggactgatatatgctacaacatggataaactatggagacattacactaagtgatagaagccagacacaaaggccatttattgtatgattccatttatatgaaatattagaataagcaaatccatagagacagaaagcagattagtggtgggcaggtgatgggggaagagggagattggtagataatagttaaaggatatgaagtttctatttgaggtgttaaaaatgttcttaaattgattatggcaatggttgcatgactgataatatactaaaaacctcaaattttacactttaaatgggagaattgtatggtatgtgaattatatttcaataaagctgttatataaataaaagtttacttcagattattttgatgtgcacttgcagttcagaagcttgagctagattaacagttcctaaccttagttttggctcctaactcctgtctcctctcagatcttaggaccttcaggttccacacagcctaccttgctgctacctagtttttgaagttctaattcccgaaacaaagaactcccttgaagagcattgatgccatggcggaggagaggaaacaagaacttttggttttaagctgtgtctacacttaaccaccttgtgcccacttgggtaggtgctctatcattgaggatcaggacccaattattcccattctcatgtttttccaggacctgacaaatcctaattcagattgctattccctttgagagtgaaatagcttaggtacgtttcttctacaacaatgcagatattctattaatgaaaggagctgctacaaagtaatttttaatgtttatataggaaagtgtaactttttttttttctggagacaggctcttgctttgttgcccaggctgaagtgcagtggcacggttatggcttactgcagcctcaatttcctgggctcaagtgatcctcccacttcatcctctcaagtagctggaactacaagtatgtgccactacacccagctatttgtttgatttttttttttttttgtagaaatgggctctcactaggaaattgtaagaaaaaggagtagctttcttaaaaccctggtttaacatgacaaacccaaaacattgagctgtacacttcattggttaaatcttctttttgcttatttaaagaaaggacaagaaaaaagaaaagaaaaacttttttgctagttcacacctcaaggtacacccagtttctgactttaaagggaatcagtccaaagtaacaaaatattattttgacatctgaaaaagaaaatgctcgttttataaattggatagtgatttctaaccattgttgatggacatagatatcttttgttaaagcctcatcaataagctcatatttctaggagatcatattgcgatgagaattatgaagagggaactggaggtccatgctggaaagtcagtactcctttaattcaactaaaaatatttattcaatagttaaatattgactgtgatatcaagtattttgaatgttggtaaaaattaaaggttttggcaaaatagacaatggtatacttacaagttttctgagggtggttcccagaatatattacccaaaatactatacagtgagaagtgatagtcaccattccatgtctttgaccacaaacatatcttaagattttctttgaagagggttttttagctttttgagacagagtcttgctctatcacccaggctggaatgcagcggtgcagtcatgggtcactgcagcctcaaactcctgggctcaagcaatcctcctgcctcagcctcccaagtagccgggactacaagcacatgccaccacatttggctaattaaaaaaaaaaatgtagagacgggatctcaccatgttgaccagactaggctggtcttgaacttctggcctcaagtcattttcccaccccggcttcccaaagtgttgagattacaggcctgagccaccacacccagcctgaagagggtttacaaaattatttcaccaacatgtaagaaaatgtaataggcattttaaagtttaaccattgtcagtcactcttttaatgccttagtacccagaacagtgctacttttagagatacgtatgtatctattttctgaattcatttttggttgcaaagcatcattctacaaacattatgaaagagagccaaatactgtgacttcaaggattatccaatactctataattagtttcatgaccaaaatgctttgaataactgaaaagatgagtgaatgactggatacatgaatacatatcatccatttatatgaaaatacttttgaatacaggcatatcttagagatactgcgggtttcgttccagaccaccccacaataacatgaatattgcaaaacagtgagtcacatgaattttttggtttcctagtgcatatagaagttatatttacaacatactatgttctattaagtgtgaaataacattatgatgactaaaaaatgtacatgccttaatttaaaaagagtttactgctaaaaaaaagaggctatcatctaagctttcaatgagttgtcgttgttttgctggtgaagggtcttgcctcgatgtgcatggttgctgactaatcagggtggtcgttgctaaaggttggggtggctgtggcactttcttaaaataagacaacagtgaagtttgccacatcaattgactcttcctttcacaaaagatttctctgtagcatgtgatgctgtttgagaggattttacccacagtaaaacttctttcaaaattggagtccatcttctcaaactctgctgttgctttatcaactaagtttatgtaatattctaaatgttttcttgtcatttcaacacgattattcacagcatcttcaccaggagtagatcctatctcaagaaaccactttctttgctaatccttaagaagcagctactcattccttcaagtttgatcatgagattgtagcaatccagtcacatcttgctcctcctctaattctagttctcttgctgtttccaccacatctgcagtgacttcctccactgaagtcttgagcccccaaagtgattaatgagggttggaatcagcttcttccaaactcccgttaatgttgaaattttgacctcctccattgaattacaaatgttcttaatgacatctagagtggtagatcagttccagaaggtttttactttacttttcccagatccatcagaatcaatatggcagctatagccttacaaaatgtatttattaaatgataagacttgaaagttgaaattattccttgatccgtcaactgaagaatggatgttgtgttagcaggcatgaaaacaacattgatctctttgtagagctctgtgtagatctccatgagagctctcaggtgaccagatcagtgagcaacaatattttgaaaggaatcatttttctgagcagtaggtctcaatggtgggtttaaaatattcactaaatcatgctataaacagatgtgctttaatccaggttttgttgttccatttatagattactgactgagtagatttaacataattcttaatggccctaggagttttgaaatggtaaatgagcattagcttcaacttaaagtcatcagctacattagctcctaacgagagagtgatgctgttcgttgaagctttgaagccaaatatagatttctctctagctatgaaagccctagatggcatttacttccaatataagtctgattaatctacattgaaaatctgttgtttggcatagccaccttcataaatgatcttacctgtgtcttctggataactggctatagcttttaactcagtacttgctgtttcactttgaacttttatgttctggagacagcttatttccttaaacctcatgaaccaacctctgctagcttccaacttgtgttctgcagcttcctcagcactcttagcctttacagaattgaagagagttagagccttgctctggatcaggctttggcttaagggaattttgtggctgttttgatctatccagaccactaaaatgttctccatatccgcaataaggctgttttgctttcttatcatttgtgggttcaccagagtggcacttttaatttccttcaagaactcttcctgatcaatcacaacttgacaaactgtttggcacaagaggcctagcttttaccaagaggcctagttttcagactatcttggcttttaacgtgccttcctcactaagtttaatcatttccagcttttgatttaaagtgagagatgtgggactctttctttcacttgaacacttagagaccattgtagggtagttactggcctaatttcagtattgttgtgtctcaggaaatagcgaggcccaaggagagggagagagatgaaggaatggctagttagtggagcagtctgaacacgcacaacttctaccaattaagttcaccagtttatttgggtgcagtttatggtgcccgcaagtaattacaagagtaacatcaatgatcactgattacagatgaccataacagatatagtaataatgaaaaaatttgaaatattgtgaaaattaccaaaatgtaacacagagacatgaagtgagcacatgctgttggaaaaatggagccaatagacttactcaatgcagggttactacaaatcttcaatttgtaaaaatcccagtatctttgaggcacaatgaaatgaggtatgcttgtctctactttctgaatatgcttttggttgcaaagaatcattctgcaaacaacatgaaaaaagatccaaacactgagacttcaaaggttattcaataccctatcgttagtttcataaccaaacaaagagaaatgccttgaataaccaaagggatgaatgaatgaatgatggatagataaacacatgtcatcaattcatccaaaaatacctcttttttttttttgagatggagtctcgctctgtcacctaggctggagtgcagtggcttgaactctgctcactgcaatctctgcctcccgggttcaagtgattctccggcctcagcctcctgagcagctggcattacaggcatgtaccacaacgcccagctaagttttgtattcttagtagagatgggggtttcgccgtgctcaccaggctggtctcgaactcctgacctcaggtgatccacctgcctcggcctcccaaagtgcagggattacaggcgtgagcctctgtgttaaaaatactttggagtatataggccaggcacggtggctcacgcctgtaatcccagcactttgggaggccaagacaggtggatcatgaggtcaggagctcgagaccagcctggccaaaatggtgaaacccccatctctactaaaaatacaaaaattagctggacgtggtggtgggtgcctgtaatcccagctacttgggaggctgaggcaggagaatcgtttgaatctgggagatggaggttgcagtgagctgagatcgcaccactgcactccagcctgggcgacagagcaagactctgtattgaaaaaatatatatatatattatataaatataataatatattataaatatatacatatatatacatatatgtatatatatgtgtatatatatatgtgtatatatatatgtgtatatatatatgtatatatatatatatatatacatatatatatacacacacacactttggagtatatagttttaatggtggtaagtgctctaaaagaagaagcaagtgctatgagagcatatattagggacctttgacccagcttgggatttatgtttaatttgagacgtgaaaatgattaggagctaagaggggttaggctggagagagggtccaggtagagacaatatgtggatccaagaaggaagaacaaagggatcaacaaagtgatagaaataggccgggaggggtggctcacgtctgtaatcccagcactttgggaggctaaggcgagtggattgcctgaggtcaggagttcgagaccagcctgaccaacatggtgaaacctcgtctctactgaaaatacaaaaattagctgggcatggtggcaggcgcctgtaatcccagctacttgggaggctgaggtaggagagtcacttgaaaccgggagccggaggttgcagtgagctgagacagggccttggcactccatccagcctaggtaacaagagcgaaactctgtcaaaaaaaaaaaagtaatagaaacaaagacaggaagcaaagagaaagaagataatgacaaggattaaagatgcagctttgaggatggcaaaaccgcagagaggagaactattaggatggtgcaaaggtaattgccagtttcaccactaaaagtaatgacaaagctcaaggtggtggtaggagggacagctgagtgactcctgagaaaatgtaaagtgctgaacctttgtagtttggaagacttggttaaccagaatgattcattccccaattatgccacatcttcaagattttactgtaaaagcaagcaggctggccctggcattcctaccataagctggtgcttcaacttccacatctggcagaggctctagatgtcacataaattgaacatagtcatccagctcaaagggggcttggggtcattgagtccaattttcattttatagctacaaagtactgataactaaaatttacaaagtaatgcacacgtggcagccactgttctaagtgtttactgtgtattaccccatttaaccctcagaacaacccagtgaagtagaaactattatgattcccatttacagatgagggaactgagacacagagaagttaagtgacttgcctatggggtcacacagctcattagtggtgctgtagaccttgggtataatcacttgtctgtatctctcaaaaatcatacagctggatagcagcagatccaagaatggactcggctgtctcccagtgcagtgccctttctactatggtaaccagaactcgacggtgctccctcagttggttgtaaataacataatcccatagtaattgcaaggatgagaatgaacttttcagtctccctgtccccacgtttttggaatggttctacctctgagagcacatgaactcagcctagttttggggctggtctgcccccaattttaacttccatcatggcattgccatttgaacagtgagtgttttggagctggcagaaggtatttttgcgcttcaattcaattcagcgatcgtgttagaagccatcctccaagtgtccaatgatgttagtgtgtccctttgggagtgatttatagtcaaatgggctgcattatagggtgatgtgctgaacaggggaccaaagtatgaccagcaatgctagagattagatttcaaggtcgttgagtaaacctgttgtcaggatttccagggatgatttgattgggaagaaaatgcatctttgtttcatcatttcaaagcaattttatgctttggttctccccgtttctgtcttctgaacacttccaaggccacacttgagcctcagcatcagcctgaagtcttgtgtgatagagttgccatgcaaggtctctctgggggtatgttgaaagctaccagtaagacttgactttgataaaacgtttaattgttttcttttgcctcaattaagttgagaagactcaaatgtagcttttaaattgaaaagtgtaactgagtgagaaggtttatatcaaatattgaaaggctaaggagccttttaatacattgttagctgtcaatgtgtttcaacaaattgtttcagtcactgttgtgtttcagtcactattacaactggggcctgcaatctgaagtgactcaggggtccatatctctggacaaggatatccacttttctgaaccgaaccaaggacgaggtagagtgggacagaaaaggacagattctagagagctttcccaagggacacgtctggcacctggaagtggtcgagcctaatgtgtaaagatttcaaataccatctggtcatttctttaggacctcatttgacaatctgtgggattgttttttgatgtggtgccagcccgaccaaatgaagtttctttcaatggtgtggttggtgtctgctgagaaagcagaagagggggctcttgtttagctcacaaccattgtgtgttaggcattatgcttgagcattttacatgttctggaagtattctcaaccctggctgcgatttcagtcacccagggagcttttcagaaacactgaggctcacacctgtgatcccagcacgtttggaggccaaggcgggcagatcacttgaggccaggagtttgagaccagcctagctaacatagcaaaaccctgtctctactaaaaatacaaaaactagccaggcgtggtggcgtgtgcctgtaatcccagctacttgggaggctgaggcaggagaatcacttgaacctgggaggcgccggttgtggtgagccgagagtgcaccactgctctccagcctgggtgacggagcgagactgcctcaacaaacaaacaaacaaacaaacaagcaaaaagagacattgaggctcagttcccatatcctaagattctaattcattcagtcttaagtaagaatcggggcgtttgtaattttaaaggcttgtcagatgactcatgtgcaaccgaggtggagaacccctaacttagagtgtcttgttgaatttggggatatttttctgctctgctcatccatccgcttgcaacttagagggagagtcacattcttcatggtgacaagagtgagaagtgtatacgttggcctcaatactccgaatgcctgtgccaaattccttcggcaccttgctttgatggtttggattgcctccctctcctgcctgattccagctaatattgctagctttccaggcgaatatttttggcaacccttgccttctgcattcaaaagaattgcttgccttcattactttatgactctcccagtgtgcaaaagtctatggagaggagacttttaggaggccccaagcaaataaggcctcatcttccatttaaggcttcattcccaggaactttcccaatacaaacctcagtgctcctgggctggccttgctggagagggcttcctgaggcggagttattgggacctgagggaggggttcctagagtgcagcaattccagactgaaattcccaggcttggggtctccctgggaattccctcaggaggaccctgtgtgcatttgggtgaaagaaagctattgttgaggaaatttgccctgccagggaccccagggcctactttgggtgtgtgtgggtgggtagagatgaaggggaaagttccagctgcttcagatggtggcgaatgacttaaacaaacaaggactggggcttggaagaggagagactgcacgtgcctgggcaggtttcaggttcctgacaaagagacaaatctgagagagatttacagacaccctctccatctatcacacaaatctgtgtcaagattttgagtctgcaaaacagcaccagcattatttcattgtctctgtgatttaggaaatgagattgaacacttgtggaatacccactgtgtgccaagcaccaggcaccagggtattcattcacccatatgttaccctagcaaatgatttgattttcaaagtatgccctgaagtgcctatgattactatcccaattttatggatttagaaactgaggcccaggtcactgacatgatttactcaaggttacacaaactgtgtaagaacctgggttaacctgacatataattgaagttatgcttcttttacttcacctctcatgaccctcttcccctatgtctttttaaaaggatatacatattgttacttttcttctcctaaatgttgcctagatttgctttctccatagtttcacctttcattcttctttggttcctgaatctggcttctatcccagcatctccaatgaagcagtactcctgtaggtcatttgatgaccaaaccatcaaacccaaccctaatcagtccttatctaacctgccttcatagtatttagcatgaatggtctctctctctctcttgaattggactatctcattcattttcataggtgtaccagctctatgctgatcaatctcaaatctacctctgcagtcctgacctctctcctaagcttcaggcttatccatctactgcctactagacttattcatctgggatatcctacagaggctccacacactcccaaaaggaatccagcatttctcctaaccaccaccccattcaaccccctttgcaggatctatgaagccagcaacttgggtgtatcttttccctcacccactcatctaaatcagtccatcaagttctctccattctgttttgtgattatttcttaaagacgatctctctcttctctacgcccaagactccttctttaagtgaggattcttttcaagagccttctaaaaagtctctctgaatctgcttcactgcatgagtctgttttccatgccgctgacagagatcttttgaggtgctaattaaactgttccatggctctcagaacctctattttccaaagtacatttgcaacctatttttccaggatactctgtgaaaaataggaccactgtggtcaagtagctttggaaactttctgtgtactatactttttgtttccttttggagattcagatagcatattaaatgtcctgagaatcccttaagttaaaaacaggcttacatttacatacttcagcatcccaaatggatttcatcatggaatcacccctcctcccaaacactcatatttttaagcatgagtcctgctcacaaccttctgcagaacacatttgaaaccacaggatgaatgctgtgatccttggcctgccatacaaggctcttgttcatctgacctctgttcacctgttgatatggttaggctttgtgtccccacccaaatcacatcttgaattgtaatccccataatccccatgtttcaagggagagaccaggtggaggtgattgaatcatgggggcaattcccaccatgctattcttgtgatagtgagtgagttctcatgagatcggatggttttataagtagcagtttcccctgcctgtgctctgtctcctgccaccatgtaagacgtgccttgcttcccgttcaccttccacctcaattataggttccctgaggcctccccagccatgtggaactgtgagtcagttaaacctctttctttataaattgcccagtctcgggcagttctttatagcagtataaaaacggactaatacacttgtctagccacctctcccccttaaattctcactactctcaccattcttgagaatactcatcttcctcacatacctctgtgttgtggttttgtttttgttttttgcttgaaaagctattcccctcccctcaccatctcggcctgccttcaactcatcattgaagacccagctcaactgtcttcccctctatgaagctttctcttattttctgcaagggagaagtagacaccccttctttttacttagaatcttcctttataccttgaatattacacttaggacatacgaagttattctatgtctacctagccttttaacctttcaaaccaattgggttattgtcttatatcttttcatgttatgactacctttatctcctgtcagaagtttggactcatcactgacccaacagaaaacagtcttatcctttctagtttttggtaagacagtgtatgtgagaaaccttacagttaggtatgggtggaggacatgtcaatccagagtgtttgctaatgtgttcagctacagtccacaatagcatgtgccacagtatgctgtctcacctagatggtgtgtagattggcttgattgtaggtatatggtggataataacatcttggcacagaaacaaaacccaaaggcaccttatcccctgctcctaagacaggctcaaggctcagcttcagctagttagcctggatctgtattcagttttccagtcatcttgaggctgggggctcggagtagcagcccacctcatgaatcctgctcgtcagtaaggggaatattcattgtcaagggcttactctgttcaggcactgtgctaagtctttgcctgcattatctcatgtcattctcacaacaactccattaggtggaaactcttattttcatcatgtaacagatgagtgagcgcactgaggctgggcaagtaaaatgacctgtcaacgagccatagcttcaggccctaatccagcctgtggcactgccctgatgggttaccttgggcaaatcaattgatctaactgagactcaatgtcgtcatctgtaaaataggaacaatactagtgtctatctcatggaatagttatgagggttcaatgataggatgcatgcaaagtgcctggcatagtgcctgacacttggtaagtgctctataaatggtagctattatgcgctcacatcagagacgttgttttcagccaggatgaagggaggcatgagggcagttttatactgaaggagagggtaggtctaaaaattatttggatgatgaaaaggtcacaatcctttgggaggcaaaggaggaaaaatttatcttaaacacagggagggagatggcagccaggtaccagaactcttgatgtgtaaagggctggccatatggagactgaacaaagtcagtgaagcttggctcctgtgcaaatcagagatgggctcaacatgtattccatgtagctgatcttgcatgtgcacggtggtttctgatgcctcccccgtaagggcagcttcatccactcctgtgagaaatgcagctcacagatgtggaggaccatctggagaagggatgtgagtgaaggtgggtgactgacagtgggtggagctggagctagggactcaggcggcagacctactgggttagaattacgactgtgccacttgctagctgtgtgggtttgggctatccactatctctctgagtctcagtttccttatctgtaaactggcaatagtaagggtaccaaccttatagggttattgggaggaacaggggaatttattcctgtgaactacttagcacagaccaggcacatggtaaaggttcaagaaatgctgatttttcatcattattatgtgttctggacgtggcaggggagatggggccaatgtggaggatcatagggcttgctgaaacagtcccaaatgaatcttcttcaaattaacctctgcaaatattgcctctgcctccattaatttagagaagctttgcattcttttctcttaagtttattttgcagctcatgtcttaatgagctaaaaaaaaaactatagaggttttgatccaatttcagactaccctgtaagatatcagcatctgacagttctgctgtactctttcaggcattttacttgaaatgatagtaatgtgatatttgcatccagtgcaaattatgaattttcactaattcttagattagatggggcttaactgctaggatgcagcttgcacatttaatctacttcagagcagcttcacttactagatggtcctcatgggtctggggaaaggatgtaaaatatcatcaatgaggtatgaagcatgttttaaaagatggagtcttgttttcagagtggattgaactgctgctaaatcacagccattacccaagcacacatagcatgtattccagcctgagttgccaccagtttttccttgtgacttgatccagtcctccattccctgctggcagtttgtgcacccctttgcttttccctgtgctgctcaggcaggtggttgctgcctaattaaacacccacacagcaattctctctgttttcttcctccattccaggatactgtttattcttgtttttacatttttttggaaaaatgttttgaagcaccttttgaaaaaagaaacatagtgctgatgatcagctaaatgtttttatagcttttcaggaagtgtgaaatgttctgatagctggcagccaagtgtcaagaaggccttggagaaaaagaaaaggccaattccaactcctttaaggcaacttttagaaaagatttagggctttaaattcagcttcacatactacctcccaagtcctctctaattagtagaaggtaaaaacattttggccgggcctgtaatcctagcactttgggaggctgaggcgggcagatcacgagctcaggagtttgagaccagtctgaccaacatggtgaaaccccatctctactaaaaatacaaaaaaaaaaattagctgggtgtggtggcacgcacctgtaatcccagctactcaggaggctgagacaggagaatcacttgaacctgggaggcggaagttgcagtgagccaagattatgccactgcactccagcctgtgcaacagagtgagactccatctcaaaaacaaaaaacaaaaaaacaaaacaaaacaaaacaaaacaacgttttttgctcaatccagcatctgatatacattttaactactttattgagttgaatttatatttaatagagttgtattctgcatgttgaatacatacatcattgtatccagaggccattgtttatttaaagaacttatagaacaattgtctattttaatttattatagaagctacactataatttggttgtgattgcctttatgttacatgcatagtcgtatctgtgatatacttggagcctaatctctggtcaagattgcagcattattttcatgggaaaatgtatgccatgacagtgacatgacttctggcctgcagcaataaatgcatcataccaaaactggagaagtgagcatagcccggtgtctgctgcataatcggaattcattcaaagtctgctgaatgagtgaattaattgtctatattctgttcagacacaactacgtggaacatgaaagactgagaactgttctctcaagttccatcataatcgacaacttcagacaagcccctcaactactcgctgtccccatttccttagtaagggctatccatctcataaagatcttaagaagaaaggacatggagcattagtctaaaatgccattctttaaaagtgatatttaggccgggtgtggtggctcaggcctgtaatcccagcactttgggaggcctaggtgggtggatcacctgaggtcagaagtttgagaccagcctggccaacatggtgaaacctcgtctctactgaaaatccaaaaaaaaaaaaaaaaaaaattagccgggtgtggtggtggcatgcctgtaatctcagctactcgggaggctgaggcaggagaatcgcctgaatcctagaggcagaggttgcagtgagccaagatcgtgccactgcactccagcctgggcaacagagtgagactctgtctcaaaaaataaataaataaaataaaataaaagtgatatttaaacttcattaaaagtagaagaaagccaaatgcatcattttaacttattttttttctttttactcaaccagatagttggtgacatataatcaacacacatttatcgagggatgctattgtaggtactcagcaccgtgctagacacagggaatgccaatgttcctgctcagacagcttccaatcctgttgaagagacaacccttctcaacactggttctattgacattctgagctagataattctttgttgtagggggttgccctgtgcattgtaggaagtttagcagcatccctggcctggccctggcctactagatgccagttgtacccccttcctagttgtaacaatgagaaatgtctagacatttccacggccttccatttcctctgtgatgcaaaatcgcctcctactgcaaaccactggtgtaaaaagtgatctgtcatgcaaattagtatgagacagtcaaatgaggaagtaatagggagtggaattcactggcgtgaatgagctggagtaatcagagacttaaactggacctttaaaaaactgagtgggattttgataagtggcaagattattgcaggtatagaaaattgcatgtgctatggttctaagactgcggtgctgcaatttggtgggtttgtgggatggcctagtgactaactgactggcttgagtgaatggagaggaatgcagatagtggacaatgaggcgaataaggtaggctggttgccacaatgtcagtttaaaagagcggcaggatgcagggggggtttggatagtgactctgccagtagtgtgtaggatggtttggagtgaggatggatgggggaagggctgtaactccccttatccatgcttttacaaagagagaggggaaaacaagttgaaatagtgaacacagattcctaatgcagcaatagcatctcctaagctttgtgtgcactagacatcacatcgctcatgtcatagggtagattctgcagatttgtttttctttcttctttttgcctgtgatttggagatcagaagatgtagatgccacagatttgtctttgaaagtaattgtcttgttcttcacattaatatacttcattaggtcttttagattagctcctgggactaaaatccatattcttcagacagctctctttgcaactgtgtcttgcgacaattctcttttcaattatgttgtgccactttcatatttctttcaaaatgttctcaatcaattttgccggcactttctctcctccaataatatggcaatgtattatcttattcgccatccaccccatgatcatacaattgttgcaagcacctggaaaaaacttttttttcattttgtcaaacttcatagtatttacattgatgagtttaacaactacatggcatgtagaatgtccatgaagaactccacataatcagcatctaaatttgagtatttgaatgtttagggcaacaacatgatctcaggacttctttttttcaggacctaagacaaacaaaaatggctgcaaaacatgagccttgtactgtggctgatatcattgaagcacgagttagctgcaagaggaaaattcacttggtttagtagcggaaaggtgatagagaagatctctagcacaactaatctgaaaattattaaaatctaaaaattaaggtagaaaatggcatgagaacagttttaaaagtcccatagttctgttcagtgaatctgagctcaatcggcttgccatttggtaatacaatgatgtggccttggcagatggtgagtcagtggaaggctcagtattattcaagctcagtttatataggaaagaagcagaaacaacacccccgttttcttgcattatgtctcataaagaaatctttttagtaatttcacttagaaaaggaaatactcaatgtaccctttcacatatctgaggtaggataagctcgcagaatcagtactagccctgaagcttctacatgcctcttattgtgtgagaggaactggaggaagagcggcaaaccatatgatcgctgacctcaaggagctcacgactgagctgaggtaattgagtagctgtgtgtggcacacctaaggtcactatggtctggagaactgtagaaagtttcctggaggaggttgaatttatacttggttttgaaaagtaatgtagagagaaaggtatgggcattttgagtaacatgagaacagaactagcgtggtgtctatagggaaaagctaggtgctctgctcagctggtggagggaagcagagaagctgtatatttagggaaagagtggaagtaaggctgatggacaggatgcccctggctgtgatgagagtgttttggaaaacaggctacttagtgtcgtcagcagtggtaaccactgcagtccatggagcagagatggatcatgaagaaaacggtactttgggccgggcacagtggctcacgcttgtaatcccagcaattttggaggccgaggtgggaagatctcttgaggtcagaagctcgagaccagcctggccaacatggtgaaaccccatctctactaaaactacccaaattagctgggtgtggttgtgcacacctgtaatccccactactctggaggctgaggcaggagaatcacttgaactcagaaggcagaggttgcagtgagccaggaccacgggactgcactccagcctgggcgacagagcgagactccagatcaaaaaagaaaaaaaagctactttgaaggggaaactcctttaaaactggagcagtcctaaagtgttcaacaacccaagtttacataaaatgaattgtgatgattcctgtaaatctgtaaatataggtcatgctgatctgttccctgaaggtgcttaaaccaacctcaacttcagtcgtccatgcctttcatgactcactctggctttccccagatagataaggtctctctgcatgagaagctgggatttagcttcatagcagttttgagacacggtctgtaggagcaatttttcaagaagcaagactatttgcacttcgtcctaaaaataaatgtttggggtggagagcagaaaacagcaaatagcactgttttataaatgaacaaggaggttcaggagcttttctctcaaccccctaaaccttcttctgggagttcctccaaacctaaagtcacacccatctgccagattgtgtaaagctgagtcctcggaatgtgaaatttatgagggcagggactttgttatgtccattctttattcccagcccttaaaacagtgtctggaacacagtagatgttctacatttccccctttaaatcatatgctgtggaattcataaactttccatttttgacacagacattatttgaataatcatctttattttcagttcatccatttcatattgagtttttaaaatagcagctttattgaagtacaattcctaagatacacaattcacccttttaaggcatacagttgggtggtttttagtttattcagagttgtgccaccatcactactaattctggagcagttttcacacctccataggaaatcccataattgtcagcaggcactccacatttccttttccctccagcttttggtggtcacaaatctgcttactatctctatggatttacctatattgaacatttcatgtaaacagaatcacacactatgtgatcttttgtgtctggcttttttcatttagctaaatgttttcaaggtgcatccctgctctagcactatcagagcttcacttcttttttgtgaccaataacattcccttgtatgagttaatcacattttatttatctatttatccattgatggacatttgggttatttccatttctcagctattatgaatggagctgctatgagcattcatatagaggtttttgggtggacaggtgatttcagttctcttggatatatacctaggagtggaattgctgggtcatatgatgatttcaaatttaactttttgagggactgtcagactgtattgcaaaatggctgcaacattttgcacttctaccagtagtgcatgagggttccaatttctccacatctttgtcaacactggttattcctggtcttttttatataaccatcctataatgttaatgagttaatgttgacttttggattataaatatattatatgtatatattatattataaatatataatacatatttattatatattacatatttataatatgcattaatatatattatatagtatatataatcaatatattcacatgattaatatattaatatctttaatattatatatttataatctatttatagattgtaaatctataaatatgaaagtttatgttaatacattataatatataaacatatatataatctattatttttatatctttacataaatatataaatataaaagattacattaatatattatatattaatatataatctaaattatatattaatataattggattatataaaatatattatattttatattacataatatataatatatgttatattttatattatagactatattatatgttatattttatattatagaatatataatataatatatattatattttatattatatcatatataaaataatatatatattatatattatattaagtatatattatattaataatgtagttctatatttttatatattgtatattaatcattacagttaattatattgtatacaatataattatattgcatacaattatattgtgtacaatatcattatatagaatacaattatttatattgtgtacaatatcattatatagaatacaattatttttattgtgtacaatataattatattgcatacaattatttatattgtatgcaatatatacatatattaattatatatatattaacaagtgtgaaagtcttatactttgcctcagaaatggccttgccagcacaatatttcccttcttgcatctttagtttgatgtgttgttgttttatttcctcataaagcaaatgaaaaagagggattggggatctgctaaaccagatgttagcactttttaaatttagagtgtggtggtcacaagaaaacacaactgggccttgagacggcatggaaaattctagaaatgtgtcatttcacagcatctgtgcagaaactgcttctgtgccagcatgttacatttgaaaccacattttgtgtgtgttcaacttttacacagatctcgagaaaagtgaaattgaattttatgcatctgtaatttgatttcagtccatgaccaggccatttctttataataattataagaatgtatccaatatatgactttcatcttctggtaattacaacaatttaccatttatagaacacatagtttaagacaccataagtaacatttcatgctaattgcttttctgaaaataaagggctctgttgtacacatccaagaacaatggtaggagaaaagaaaattgattgatacatcacatcaaagaggagatcaaaatgaagtcatccaatatatgccaaaggctctcataaattacaaattttgaactcactccaaactttatttttaggcaaatacagtatcttcaagtctcattatgaaagttacttcaaagatgatttgatgtgacagtatttttcccaaggctttgcctgttttctattcctaaggcttcccatgcgagcagggattcctggggcccaagctcaagcaaccaacttatactttgaatttgaactcaaaggacaagaagcccatttttgtgatgtgcttccccatttccttcttttgagcctaattgaagaattaaaagttgtcttcatttctaaagttatatgccgaacacaaaggggggtttcaacagctgcttcttgtcatgctgtgggaaaaaaataacatctcatctgaaaaatacctccaggttctccagatagttcttgcttttctcactcacatttttctctttacatgaacagatttggctcctcttcttcttttgtaggtagtatccattcagtaagatatttttcagatattgagagtaatacattgttcattagaaaacaaagttaaacatccataaaatactaaaaagaaaataaagatcacctgcagtgtcacaacccaaagtgtatcattttgctttagtttcttacactgtttgtttgcttgcattcattctttctttcactcgttgcatatttactgagcacctactatgtgccttgcattgtggtaagatacaaattgtgatcctaattttctttataataattaggtttataattgttggcatagtccatgcctcctctcctagactttagtgtctgggaccatcttactcaccatacatcgtattatgaccatttaccaggtcattaaatattatctgaaaataaaaagtttaatggctgcataagacttcactttcagcatctactagaatttactatttccttattgatcatttaagatattttctttttattctgctatttttgataattataattaattaattccattttgaacatcatttgtaagggtatacacatttttatggcttgtgttgtattagccacactgcccaccagaagagccctactaatttaagcatttaccgcagtaggtgaatatttctcaaatgaagttgaaggaagttccaaaatggcagacccaaggaactgaaagacttacccaatacatccctttgcctccaaggagagacagaatgaccactaccaccagaggggaagccagtttgtttaagagaattgaaaaacaccagggagagctctctcaatataatagtactgggatttgggggcaagaataagcagtggtgcaggttgtttatttacatacgtttataaattatctttacagggctaagagtgaactggatgaatggtgttggcataacctcagagaggcaatccaaattttattaattctctgttatgtgtcagagcttgagttaggtgctatgagtgatgcatggatgaactaaacacagttcttggcctcccagaatgttaaaatccagtagcagggaaaagtgtgtgcgagctggaatttgaatgacctgggttccaattctgattcttctacccattatagcagtgactttggagaggttacctgatgtctctgatcttctgttttctcatgtgtaaaacagggtgaataacagagttcttgtaagaaggaaatgagataatgtgtataatgttcttaggagagtgtgtggcacataacactatagcagcactcaggagatgataactaccattgctttggtaatgatgtttcctatcttccaagggttttgtgatgattcaatgaagtaacaaatgcaaaacacttagtgctactacagtctcaaattaagatgacgatctgatgataatgacaacctttttggtgaagaacatatcacaagcgagttgtaccaaacataaatgagtaacaaaagggtagcttgccccttgtctcagagaaagtgagtctcggcatgggttgctgcagaagacagtgttggctctccacatcctgtgacaccaagacttattaaaaccagacattcaaagcaattgcaagttctgatctacacaactgttggtcacttccgcttttgcgcctacctcatttgaggcacctggagtgtgttttttcttggtagaaccgtgacaacatgcctattgctggcctggaattgtctaccaagcccaaagctttttagcagtgggtgatatttgtttcttgtgccatcgctgaataatgacttttgtagtctgaaattaaacaagcattcaagggctctaagtgtctggcaaaaaaagttagtggctggaaaagctgcagaggatgtctatgaaatgcaattgatgaacacacttttccccctgagctgctttcctgttaggtggtggaaactggtctatttcggtgatgtgtgctgacttcttcccttctggagcccatgcattgggtgcctccaggtttcaaaagaatgaggacaaattaactgttcttctaaagtactaatgctgcaggcccttctgaaataaaacctttgcagaatggaaaatattattgtcttcttgctttcaaaagttacttgtttacctgttgctcataaaatgcaggataatttgtggttgggaaaaggtattctttgcctgatgggtttaatttcagcaccgtagacttccctgaagattacaaagctattctattgctacacatttatagagctcaccccgaggaaagggaattagtgtctggcattaccttcctgcctgccaattttacctcactgattcaacctttgaaactgatttaatcaatggatcagcacattattcaaaggtggaaatgttattacagagaagctttcaggagggtggatgattcgtacaggcactacacaggacttttaatcacaccacataaaagaagcaaatttgaatgttgcttatgcccagaattttgatgaaaagtaaaattttgatgaaacgtgaaaaggagtactaggagaagcccatggcttggatttatgttggcagacatttcttctgagaaagaaaactcagtatgttctaatgtaaagatccacaaaatccaaaaaccacaccaatgggtaagcctattgaaagtaagagagatgagaggttgaacatgataaggaagctgaaaagccaagcctgttcccaatagtcactacactccagtggaagaattctcagtttttgtgcagagtcctgcattttgcatagctcagttgctggacaagtgaatgatcattttcctcatctgtcaaatgggaatagtaatacttctcaaggtgtttgtgaggatcatcagatactaaggattttacaggtttttattttccttatatgatgtacacgttctttacattgaaaaaattatttctccaaactagaatcttaagttccatgggtatgatgggtctgataaagtatttggcatctcttttactaggtagatcccactcaccctgagttttttttttttttttttttgagacagagtctcactctgtcacccaggctggagtacaatggcatgatcttggctcactgcagcctccacctctggggttcaagtgattctcccaccctagcccccgagtagctgggactaaaggtgtccaccaccacacctggctaatttttgtatttttagtagagatggggtttcaccatgttggccaggctggtctcaaactcctgaccccaagtgatctgcctgcctcagcctcccaaagtgctgccaccctgagatttgacttaatggagcccatgggagatatagataccttgggtcattagcaaaaccttcaacgtaaagatgtatcaactctgagagaccctggctaggtctactaagttaagtggaagcaccacaacatcatggttaaaaggaaagcctttgtgttgagccaggtgttgttttgaatctcagccctcctgcttaggaattatgatcttgggcaagttacttaacctctctgtggttcaggttcatcattcaaaaagtaacaagcatcatactacccacctcaaaggggagcagaaattaaatgagattaagcatgcaaagcataggagcaccatgccgagcatagaggcacaataaagggcagttgagaggagtggcggcctggcagggtggctcatgcctgcaatctcagcattttgggaggccgaggtgggaggatcacttggttactttatcaaacccaccatacccatggaacttagattctagtttggagaaataattttttttcaatgtaaacaatgtgtacatcatataaggaaaataaaaacaagtaaaatccttagtatctgatgatcctcgcaaacaccttggaaattattactattcccatttgacagtgatcacttgatcacttcaagaccagcttgggcaaaacagcgagacctcttcactactaaaaatttaaaaaatcactgggcatggtgatgtgcgcctgtagtcccagctactcaggatgctgaggtgggaggattgcttgagcactggaagtcgaggctacagtgagctgtgattacgccactgcactccagcctgggtgacagagcgagaccttgtctcaaaaagagaaaagggagaggagtagcaggattgacagcagcggtggcgttgccccttgaggatggaaggtctcagtcatcttgaagtctgctggagcattagttccattgaacctctctttgagggagactatgttctttgtccttggccttttttgcctacctagaactggctgatcttgcatggactgctatagaagtcctttgtaatcaggtcgttgaggtcagataatcgagttccaatccaagctctgtcatttgccagctgtgtgacactgggcaagttgagttactcaacctcgcagagccccttgttctcagctgcaaaatgataatacaataattatttgctgcatagggttattgagagaatgaaataggataatccatgtaaaagtacctcaaccattcactggaacatggtaagtgcctaataaagatatcttctgagtatggaagcaagacttcattacatgtggtattgatttacaattgagtgcatttcatgatattaaaattaggtgagaattggtggtatgaaaatgcaaccacatcaccacaggcctcacacccatgcttcctgtgcagtctgtggaactgtgcatcaattaaacctctcttcttcataaattacccagtctcacgtatgtctttatagcagtgtgagtacagactaatatacctggaaaagttgagtgctctaggtcaactggcctgtttagtggcagggctaggattagactgtcaggaccccaagattccactttgtgacattgtcctccagagccattgccttcgcatactgattcaccttcctttctatagtttctgccctccatttaaccacttcttttgttcccctcaaatcccagatggccagccttttaggcctgcctttcttagatatgatatcaatcatatcatttcaaaatataaaatgaatttgttattttagttagttaaattaatggtgaaagattcatttaccaataattttgactgctcttcatttgttctgggatccctgtagtaatattctagctttctccatgcaagtgaatgctgtactacagtgattttcaaacattagttgaattagtttcaccttggggtctggttgaaaatacaaattcctgtgccccatataacaggattctggttcctgagtctgggccgaggctcagaatctgcacttttaacaggctttgccacgtgagtctaaggctagtggtatatgcagcccacacctttagaaaactgcttggctttgagtcagactgcctggcttgaaatccaggctctgccattgactagctggaagtccttgggccttggtttcctaaacttaaaaaggagaataatacatactagtccatgtaaggttgctatgatgattacatgagataataaatgtggagcacttagtattgtgctgaacctacagttggcactcaagaaatgttaagtaatattattttaaaatctagggccgggtgcagtggctcatgcctctaatcccagcactttgggaggccaaggcgggaggattgcttgagcccaggagttgaagaccagcctgggcaacaatatgagaccgtgtctttacaaaaaacattagctgggcatggtggtgcatgcccgtggtgccagctactcgggagactgaggtgggaggatcacttgagcccaggaggttgaggcttcagcaagatatgttcataccactgcactccagtctgggagacagtgcaagaccatgtgtcaaaaaaataaaaataaaaaatagaaataaatctattgaaacacacacacacacacatgcacacacacaaagtctacaatgtgtttttctggttattaaatggtaattagtgttaacagaagattctccttgcattaacacacgtgtgtctccacacgcattctttaaagcttagtgctaatgttctcttgtccttgaggtgtttgtgatcttcctcttcactggaataattgttcattttatatctctcccacttgtgcctcccatagaaggcattttgttctgcaacaaattctagtgagaattttgcatctctctcttccaggcttgcaagctgctgaaggacaggggagcagttgtagccatcctgcaccccaactcatacaccgtggcccaggtcttacccagtgcttagcactctgtagtacttaaaaccacacttgctatattcacctgaagttctggaagtgagaagcctcaaatgaaatactcaagaccagaatctctttactctttctggtctgagcaagtgggaggtgagagaataaaactgggaagtgttggatcttctctggcttgtttgttctgcagtacgattgggagaaaatgtccaaaaatgtagaattgagaagaacacccccaaaaccaccccagcaattactgttgttttaaaaaatcgtaaccagatggaagacatttcctgaaatcacacctttgtttcttggagaaagaaaaagcccattcctgtgagtgggtgttcattaacttggtaagtagggaagattgagcttggcctggaaggaggtggatttttgcaggggcactcaacagacaattaaataaggaggggcatttcccatcagaacacatgaaacaagaggctggttgaattttctgcaactgtctgcttgaaggtttatattcaatgggtgtcaccacaacttacacctcatagaacagggatttggtccccaagagatgtaatgcaaatgtcacatcataaactcccagactgccaatactgaagggattttaggaatcgtctagaataagaagtacagaccacccaccattgttttgttagtgttaccaaaatgtcaatggttgttcaaatgcctttagttgctgttttactgcatattttctgattccaaaatgattagtatttcttggatttatactctggctctgccactgactggctgtgtgaccttgggcatgtcagttgcccttttgggacttcatttccttttataaaaggagcaaactaggttgaaagatcttaaggttctttttagctctaaatatgggagagtctcccagaaatagaaatgcaccactcctttttttggaaaattcattctttcctaatgttgaaatgctggcagtccagtgagtcaggtaaccatgttacaagaattgtctcacaaattctgtaaggaggtagggaacaaagatacattctgatgtatgtttcttctattaaatctattttggtattccaagtgacatttgttcttgcacagcttatgcttcacaccaacatgctatctgtcagggcacacactgattaagacctattctgagaaaacatattctctgtgattgaaatccaaacgtattgattgttttatttccatcaggagagattgctttctatttggtgatggatgacaactcttcacacctctctgtctgccagctggacagaggatgacacaagcagcctctaagtcttgtgtgggctgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcccagctcggtgcagagagaacatctcgagtctgcactgtctgctgtttctccgtaccacggtgtgctagcaggaaagccttcaaaggattaaaacccaagtatttatgagctaaacataatgtttccctctctctgggaatgcccagtgagaataccacttacatctgcacagaatgattgcatttcgcaaagtactttcacatgcgttagctcattaaattcttaaaacttttactcgtgggaaatagatagacactacatttttaccatgttacaaatgagtaactaggtatgccctttaatctctgatccctgaccccacaagccactcttcaaggcttgaacccatggcttctagtccggtctttccatcatcctgaggtgctcagttattcgagcctgtagctaatgactgcaggacacataatcatagcaactcacatttattgaactcttactatgtcccagacacttcacataattttaatttaatcttcacaacaacctagtgaggatcatatcattattgtcatcggcattttacagaggaggaaaatgacattcagagaggttaagaaacttacccagggtcacatgatagtaagtgacagagttaagactgaagctgagtcaattgaaaagtagaaaaattcttaaccatgatgctctgttgctggcaactccctgtcccttaccctttccaaaaacattaagaataggaaaaaaaagaagagtgagttttccctcttgggctatgctagcaacagaggcccaaggggaaatgctgttttaagccaacctcttggaaagggtcattagcagctgacatgatgccaatatggaccaatatgtctgaaagcttgtttctgggtcttttgtggtctctgccattcttgtccctgtccctggcctccacattcctttccctctggatcctcagtaacattgtcatcctactttggacatgcaccactctccattttaggtgagatatgtagggttattgtaaataaatatttcagaatcagtattatttattccccacctatttctgaaaaggatctgaataaaatctgtctattaagtaatttgaagtttacaaaaagatctgaaaccttgtggaagaaagtcaagggagaagaagacatgaacaatggttctatcaagaacttggggtggaagtcatctcacacatttcataagcactgtgaacctggccctgggattgccactaaaaatacagagctgagtaaaacatggctcctgccctcaaagagctcaatatctagtagcattagaattactgaatttgaacattcaatttgactttgagttcaaaccaagacaataagtgaaacatgatggattatctagtactcatctgataaatggagtagtgtctgttcttcagaagacacaagctgcttataatgctgaataataatgatgaattatttcatatcagtaatagctaatattctttgagagctcatcatgcgccagctattgcactaagcaatagctgcattatcccatttgcatgcattatcccatttaatcctcacaaatgtcttcatgatgtatgcatataattacccccattgtacagatgaagtaattagggtaaggaggaattaccttgtggatccataagtaatacaaggggtgaaaacttcaatggagtttttacagaagattcagacccgtatttcataaggccagtgcacacatttctcggccatttctgtcttccctgtcactctacgggaagtggctatgaatatactgtctccaaaggctgtgactgtagccattgtgcttcggtattgccatttgggacctaacggttcagaagatgtaataactctccttgcatggaccaattacagaaaaactccctttgtaaagcaacagcatgagccagaacaggcacttcattatctgcctctgcccacagggaagtagagacgctggcgagaggatgattgacctgggaaatggcagggcttgggatccatgctttcagggtcaaaggccttcgtgcccacttccaggattggcttctcaggatgccctggtgctggctcgccccctgctggggtgggctcctggggtttctctctcagtgggatcccattggcagtctctcccctcccacagcagcaggcccattgacttctgggcactcacttcccaggacccttttcagtccctgagaatcagaagttcttttcactctgagagtttgcagacggtgttgcaccaagaatggatgtactttgcctgtagagggctttaatctagtgaattgtgctcagacagataaagggtaattttgcttcattttctgtacctttctgaaagtttccagggtcagttagccaggtctctgcaggcttctcagctccaaagcagaggcaaaagtctttttccaccatttattccttgcatatatggaagattcttaggcaaaaagtgattttttttcacccatatcttatcccagaaaacaatgccctctttttagttaaactgaatgactacaaatcatatcaccccaaattgagtaattgcaagtcttgttagttatcaaggttttattgagccttatttcagttgcttacatatgtttttgtttttaaagaaaaaaaaagtgtaacgcctttggcccgggcctcaaattcctttttttccctcaggcaagcacgcttacaagtgagggattcccagcctacaagggtgagttatgtgtgttgagagcagagtggaaaggtgggcatttactcgccctgccccctccactgaactcgaagtgctcattctctcccatgcctgtgtcctctctctcttcacacatggtcatgtatacacacagttgtacatgcacactttctccttgctaaaacttttctttgctctgagtagatgcagtccgttctcacactgctacaaagaaatagccgagactggataatctataaagggaagaagtttaattgactcacagtttcgcagggctgaagaggcctcaggaaacttacaattatggtggaaggggaagcaaatatgtccttcttcacatggtggcaggaaggagaagaatgagcaaaaggggaaaagttccttataaaaacatcagatgtcgtgagaactcactgtcacaagaacagcatgggggtaaccgcctccatgattcaattacctcccaccaagtccctcccatgacacatggggattataggaactgcaactcaagatgagattttggtggggacacagccaaaccatatcatctactctctccctggcctcaccccacattactgctctggtggccaatgctgtagtcacgaattctgccttttctcatgtctgccatttcaaggagctcaccccactcacctcaaaaaccgagcttttatagacgcagaaaactcttcctcctatatgcacactgattgatcacctacacatgccatcaagagcatgtactctggaattagatagtagtgagttggagccatgtctttacttattagccatgtgaccttgaggatactacttaacttctctgagcctctacttcctcagtgaatcataaatagaacctacctcataggattgttgtgtggggattcagtgaaatagggcatgtaatttagtacagtgcctggcccatgtgatcaataaatgtttgctattatcattaagcgtggtgatcttagctgattgtattgttgttgttgttgttgctgttgaagattttgcatcttctaggttatgtttctttgctgctcaggaggcagaacaagtttctccattgccaaattgtttgcttttttttattggggtgaaattcacataacataacattcactatttaaaattatactattcagtggcatttagtgacactcattatgttgtgaaattatcaccactatctagtttcaaaacattttcagcaccccaaaatgagacccgtatgcattaaacaatcactccccatcacccccacctaccaaatctttttttaatgttgctttcagatcatatgccattccataaatctgagaagttcaggaaggctagatagtgagcttttttccaaaaatcaatcagaaacatattcctaaataaaagaaatatactctgatattctgggactgccttatcagagagtgaagtgaaaaatcagaagtgatatagtctcattcaggccaacacagaaattactcctttaatacttattgcccatatttcacattattttctttgcctggtagctgagagagaaaaggagcttgaaactttgagtaaggggagggaaagattttctaaaccccctataaacaaatgatggtaaagcctaggaagaggttagcaggtcagcctctttgcatttaatttccatcttgccacattccaaggaaggaattttagtcttgggaggcaccaaataaccctcaggggaaatgtgaccctttgaagctcctggttgtctatttctgcagctgcccatctactcacaccacccaggttggaggggcccagctcttcagcactcaaatacagtggagctggccacttctttgcacggggatggtttataggctttctatatcaggctgtgtgcagacgagacaggcttgatgagtcagctgaaaaggggaaaggaggggaactccagttggcttgatgctcaagtgagaagtgggaagaaggaccaacagttaagaggactcggtgaaaatactacgggatttggcaaatgtatgtgaaggcttttgtaggtcagccagtttgcccttggagctgtgggcctgcctgagaaggcttttgttggccttgggagctgaaagggagaccctttctttaggctctgcaggctacttggcaatcaatgttgaggcaggttttctgcttctgtggggtgcaaagctttggtcaatgtcatcaagagcatcctcttcttaggaaaccatgaccttgccttgggcaacttttctgtagcctttaagaccagaaaagtgagtagagaagactaacgtaattggacaaaccttgctttgatgggtggtgattgggactctcatatgaattccagaaggaaatatatgaagagtgtctgtaacttgaatgtgcttcctctgttgggtcttgcattaaatcactgatctgcacactttagcctgcagcagaatcacctggcgaggaggtgcctgttgaaaaagataagaagtttcattcagaaaagatgaccctgaagtaagtcttctcactcatttctatttattcacagttcctactttactaagaaagtttttaattattggccattatccgtgactgaaaatacattaagtaaagttgcaggatgagttttaacatttatgagttaacttcatccacatcagtaaatttgacaagtatttttgaagacccatctttgggttttattaaatagaaatttctgaaagttgtatgcccaagggtattttgtttttctcatgtgtgttcaaatttgggaagaatgaattttgcctcctattcactcggtaggagatttagtgtctccttctgaattagccctttctgttcctgaaggaaagtatttatgaaaaatcagactccattctggaaactgaatgatttttgtattttgctgcagttagatggagtcctataaatgagcccaaaacatgctggctaaatctctcataaaaggcaaatatcacaaagaggaatggcccaagtcttattttggcccctggcctgtgtttgtctaaaaagacttttagaagtgtcacaaaacactaaagcactgcctaaatcatcccttcctaactttttgcttatgggggtgcaagggaagttgcacgtggtgggtgggggtgctgagagagagagagagagaacacaaagggccagctcccacttggagctcccctcgtttctctccattttgctcttcaggatgtccccaccccactctgcattctcaccacacccacacatgaacccagcatctgcccaggtgccacgaatcatattacaactttgctccctggcagagagtggccagagagaagtttctggaggtgaggaagtgagcctgcctgactgctttggtggcagaaaccaggggcttaaccagtgactctgtgctcgaggcttgtttgtgaaatcctttagcaactcttcagaagcctctcctctctgacttctcagagatgctggctcttctactttgggaagttcctttgctagtaacacatttgaggtgagttaaatgtcttcctccttcagcctcagcttcctgtgcctaagggtgagttaagcaattagtcctaaatagccccagctgttagggtttctccagaggatgctccttgtgactttgattgcttctaatgaggctattggctttatctgtaatagacaatgttagattacacatctatgtcttttacagcaccttttacccccagggctttacgttttctgagaccactcttgagaaccttggatccagtggcatttttcttcttgtgaataaaaaattattatctttcctgttctccctgtgagatcagccttgttcttgttctgctctggggtactctgtatttagggaaattactcatgactctcgggtactgaaaagacacacacacacacacacacacacacacacacacaccatgcacaggggaatgggagagcaagaacgtgtgagagagagccacttgaagagagacagggagaaagaaagagagtaggagaaagcaataaagaaagcgagatcacagtcaggcctgagaaggtgacagcaagccagtgttttagaggtagggaaagagcccaagatggatggagaaagctcatgcaggagcaagagagcacacatgggagtgccagcaaccttgaaaaaaagcaccagtgacagcaaagggaatctatgaggccaggaggctgggcgagcaaaagcaagagagtgcaagagatcaagaaagggggaaaggaggtgggagagggagagcgagccttcagggcaaaggagtcaatgagagagatcagcacattatttgtgggcagatgaagagaaagtctaaatgaggagctgctttcccctcatcttgttgagttggtggaagaggaagagaagatgcacagggcacagactccagctttcattaatccaaaatggaatttctgggacatacatgctcaggatcaatgtcatctttaaagacccagattccaattagaaccacaagtacacctccccatccttcagtattatttgaaattttagaacaactgccattattctacacaaagtaaaggatgatcattttggagtatgtttttatcaaaccacctccctatccacagacctgtgttagacagcttaccttagtggttgccaaacaccagaagtagatcattgtcatgattttggagggctgggccgaggcctggaattctatggctttaatacgtggctccattgggagattccattgcccaggaagacactggccttaagctacaccctttttcagaaagcagtaacaaattcagttggaccactgacctgaagccagattgctttccaacaaggcccaaactaaagggggtaccaaaaaatcagtaatcaacataaataacattttaatgatatgattttttaaaagagaagtttctacttatgttgcccaggctggagtgcagtgtctattcataggcgcgatcatggaactcttgagctcaagtgatcctcctgccttggtttcctgagtagctgtaatgatatgttttaaagacttaaaattaatgtagacaaatccaaaatgaacaaatatcaaaattttaaatacagtttccaactctgcccttgcacacccctgcctctcttgacccaccctaacaccatccttggttccagttaaactttatatacagaatcaggcagccatcctgtgggccatattttcttgacttaaaaaaaaaaaaccattgccttaaatatcatttattcaagtagaatccaaatcttgtttgttttctaatactgtttttcaataaaagcaaccagggctccttggagaaatgaccgattccaggactgaggcagaaaatacacaagataagcctggaacatcttgtattgccagaaagtaaggaagtgttaacaaatacacaaacaaaaacaaaaagcagaacatcacaggagccaactaaaagagctaccaacagccaaaggtataaaaacttgagaaaatatactagtattattggactataacccaaagtataaaataaacatccaagagtccatactgatataattaaatggttaaataaatggatgatagacacatcttttgtgcagggtaattccaaataatttgtgtagattctctgccctcaaggaggtggagtgtaactcctcactccttaagtatgaactgcgaatagtgacttccttgtaaaagagtatagtatgggccaggcatggtgccgcatgccggaaatcccagcactttaggaggttgaggcaggaggattgcttgagaccaggagtttgagaccagcctgggcaacatagtgagactccctctctacaaaaaaattaaaaattagccaggcatggtggcatgtgcctgtagtcccagctactcttgaggctgacatgggaggatcacttgggcctgggaggttgaggctgcagtgagtcctgatcatgccactgcactccagcctgggcagcagagcaagatcctgtcaaaaaaaaagggtgcaggccgggtgtggtggctcacatctgtaatcccagcactttgggaggccgaggtgggcagatcatgaggtcagagatcaagaccatcctggctaacatggtgaaacccagtctctactaaaaatataaaaaaattagatgggcgtggtggcaggcacctgtagtcccagctactcaggaggctgaggcaggagaatggcgtgaaccaggggggcggaggttgcagtgagtcaagattgctccactgcactccaacctgggcgacagagcaagactccgtttcaaaaaaaaaaaaaaaagtgcagtatggaaagggaaagacaagtatccttaccatggattaacctgacaaatactgcctcagccaggtgatcaatgtgaacatcaccaatcataaatcatgctgattgtatgtgtctttggatatgatgagatgcgaatggcactttatctctgtggtcttcttccctataatccataaccacagcctacttatgagaaaaacatcagaaaaattccaatagaatgggattctacaaaatagttgaccagtactcctcaaaattatcaagtcatcaaaatccagaaaagtctgagaaattgtcacagccaagaggagctcaaggatatgtgacaactagatgtaatgtgggatcctgcaaccgaaaaaagtaaaaactaaggaaatctaaataaagcatagactttagttaataacaaattgatattagctcattaattgtgacaaaggtaccttattaatcaagagatgtttatgtgggaaactgggtgtggggcttatgggaactcattgtactatttcacaatttttctagaaatccaaaactattctaaaatacaaaacattctttgaaaaagtatcttgatggctgaatgttttggtgcccccttaaattttacacacaaggtgagcaccttgcttgcctcaccttcatcctggccctgctgtctgagtgcaaaatacatttgtagcactggatttcctaggagacacctgttgtattagtctgttctcatgctgctaataaagacatacccgaaactgggtaatttataaagtaaagtggtttaatgaactcacagttccacatggctagggaggtctcacagtcgtggcagaaggcaaaggagaagcaaagtcacaccttacatggtggcaggcaagagagcttgtgcaggggaactcccatttataaaaccatcagatctcatgagacttattcactaccacgagaacagtatggggggaacggcccccatgagtcaattatctccacctctccccatgttgacatgggggattattacaatcaaggtgagatttgggtggggacacagccaaaccctatcacctgtacacactgcattctctttatttgtatataaataaatccatagtattctttcctccacaaccttctccttagcataagctgaattacattccttggcttctgacaaggaatgaatttagatgaagctcagtgtgcacttcccaaagttgcagttgtacagccctgtgaagagaagaggcagtggttggaagcctaagccacagaaacagagtatagtccaagaaaggttataatgctgtgcccagcagccagagcttctcctgcagctgctttattcctgccaagcaaagccatgagcttctcctgcagctgatttattcctgccaagcaaagccatcctcgcaaagagcattggcccctctgctgcctgggcctgcctctcagatagagctctggaagcctggacctttgtcctagaaaatgacatgactaaagtgggttttgtctttcctgttgctctctttcctcctttccctcttttcacatcaataccaattagagaggacaagtgttcaatcaagacataatgtcataggcacggacttctcctcactgtcttcctcagggcgaagaagctgccagcctggagcagaaagctgggtagagacactgctttaactttattccctcagggaaaactgcagccatgaaagtacaacattgagctgacttgacttggcagaaagatgtgttttgcgaggaattgggatctgggagaaggtgattctgatactaactcacagagcataccatcccatttctgatcagcgtctgcgtgagaagatcgttcaaagctaggcagtctgagtctcattggaagaagtggctaaatctaaatctggtgtcagttctttttttttttttttttttgagacggagtctcactatgtcacccaggctggagtgcagtgatgcaatcttggctcattgcaacctccgcctcccagattcaagcaattctcctgcttcagtcacccaagtagttgtgaccacagatgtgcgccaccacacccggctaaattttgtgtttttagtagagatggggattcaccatgttggccaggctggtctcgaactcctgacctcaggcgatctgcccacctcggccttccaaagtgctgggattacaggcatgagccaccatgccaggcctggtgtcagttctttaacagttccaccacatgggatttagcaggggaaatgctgcagagtgaatgccagagactttgtccagtttcatgtatatgaccattggctctggtttcagagagacttgggtttgggtcccagaatttcttaattgtgtgacctgggcaagtcatgtagcccccacagagccacagtgtctttatctataaaatgaggatgctggtagagttgctgtgagattaaaggagctaattcaaacactcatcccattgcctggtgcaggaaaggtgcctactggatgatagctctcatcgttgaaactctgaagcttgggactggggtaggggacacttccactagagtacagacccaggaataactctggagacatgttgcaggaggcctgccagctttgttggagtgtgtccttcgtgctggttaatacatgggaaatggctcaggaacaatagcttgctcttgggagaatcccggaagtgacagtgtgaaaaatgatggttttccaaggtggtattccctagggctgagatttcttgtccttccttttccatgctcacaggaagaaggggaggtatttggtcaagaaagggtttccagaagaaagtggctcagagtcttgctcctccttcctcccctgtctgtaaattctttgcatttggaatgtgtgatgacccctgtctgggctttgcactcagatccctgggagctaggagcagccctgagaatgggcagcatcctgcatctgccttcccaggtgcagtcctgagaatgtgctgatggagtttagttttaatgacaatcataactccagaggcctgctctttactgtttttgattgtgcagctgaagactagatgacctcattgaaaagtgggagacagaagcagctgttgccacaggaaataagcccccccgccccgccccacctcaggagacacactgcttctaagagttctttggagtgggggtggatccagaatggcagctgtcctctacccagatctttctttgtgtacccagaggttgggctgagctgtgggtgactagactgtggattaagaaaccatgaatagcgtttccagaacaaattcttggcctgtgaaatctccatttagcttgctctaccaggaccacatgtgtctatgatttgcctcctttctctttttggattagagtctgtgccctgcacctcatcccctggttaagctaccatccctcccactgtcggcttggagctggtttgctatgctgtcaaagatctgagtagcaacagatcacgcagcctggtgtttgtggcttattacatactccccaccttggctgagtaaaacatcaagagagatgtactaagcttccaagcacaggggtgaatactgaagccgaaggcttggtgtactaatggtgtaatttgaggtcccagctacaggttagaggtggtggggatttagagacaggggaatttcctgggtatttgttaaattgcagtatcctgagagctcctttatcttctgtagacaacattatgcctgtttggggaacttcacacatatatatccacgtgattctacccagttcccatacccttggcccatcacaccacaaaataaagtgctggagccaaagaaactctaaacagatgtctttagatgaaaacaaagctagcagcactactgtacagcccacatattgttgtagttttaaaagtagattgttgtggcttttggtttacttgctcactccttaccccatttcctgttggtgtgatactgaccagcaaagtcgcctttgcagcgtttccttggatctcttttttttttttttttttttcttgatgggcatctttcacttctaggaaaaccaaacaaaaatttcctccaaaaattcaagtcagtcaacatttattgagcacctaacaggttcatggtgttgtaccaggcactgcaattggagaagaatgttacaagtacacatgcccaaactcgactgtgtccagtctggagagaaggctggatctggccccacagattgtggtgggagactggctggggatgaggctgttggctcttggtgttttgcaggaaacttcaagaaggaagctggggggtgtgtcctccctaggccccccaccccggttaatttgctttgtttctgaaacacactgaccagtagctaaatgggcctagctcatgttcagggctgcgtgctgaaacttcattagctcttttcaaagccctttcctattggtatagaggttcctcttaacactgccagcttccttgaaaggtttttcagctgctccttatagaatcacttcgaattaaaatgcttcattccaggggagattttatttacagccaagcaactgtaactagtagcactccccccaccaggctgcagtgactatagatctttgatactgctgaatgactctgtcaagggttccaatttgcttttatacaagtgcatcacccaattcaaaataaatgcatccagactcccttgtcctctcccaacccccacacactattccatttcccataagcacgtggcctgcggctcaggggtgtcagtcacttagccagctgtctgttgcctgacacagacatatcaagttggttcaccttaactaagtgattgagcttgattgccaaccatctggtgagtttagttaagggaattgtgatttctagaccagtctaacacggccaaatatgtacctccccaagcccccaaaacaagtgtgtctgtgggaccacattttatttgtacagttacagaattttatggctggggaggactgctttccaacttcattgctgaagtctgaatttaccccttcaattcaagctctgaaaattttatgggctgagcccaaggctaattgttccaatattagatgaagcccctgtcctcaagaagctcacagtcactcagaggtaaaaggcagtcaccacttggctctaatgtaatgtaataagtgccatggtagcggcaagaacaaagtgtgctgtgagaatccgaaggaaggatggattactctgcctgtgaggggagagggtcaggaaaggctgctcagaggaggtgatatttgagctgggtcaggtgggaaggctattccaagcgaggagaactgtgtgagcaatggcatgcatgcatttgccatatttggggaatctcggtttagagatgagaggcctcccatgggcacaggttttccagagaataaatgaaatcaagagtgtctgaggctgggaacagtggcccacgcttgtaaccccagcactttgggaggcttgcctgtgttatatgcctttggcaggtggattgcttgagcccaggagttcaagaccagcctgagtaacactgcaaagccctgtctctacaaataatagtaataataataaatcatctgcatgtggtggcacacacctgtggtcctagattcttgggcagctgaggtaggaggattgtttgagcccaggagatcaaggctgcagtgagccatgattgcaccactgcactccagcctgggtgacagagtgagaccccgtctcaaaaaaagagcatctggctgtagaaaggtttttcccaagtatgatccaagcgttaggactcagctccatcctggtcagcattcgtagatggccaagtgtgtgtcattgtggatggctcctccctgggcaccaaaggttggtatgtagccaccttcctttaaattgtggcaacagtggtggcagccaaggacagctgctttgtgggagagaggagttaaatgtgagaagatttattttggttctattaccagcggtccttttctgagtgaggcttaacaagaggcaaacgcctaatgacctcctgagtatcaccaaagtgttcaagataggcttgaaaagccaaagaagatgaaaagaaagaaagaaatcaaagggtccttcaaaagaaaagaagtagacagtaacggctataggatttgggatcactttttccctgcttggcaggttggaattgcagcttaggtatgttgaagggtagttcccctctaatggtattattgatactagactctctgttcccacagagagagctatgttggggaagaaagaaaatatttgatgtctgattcatgaacacgctaactggcccatgcattgtggcagagaagtaacagctttattttgaaaaatgtcaaccttttaaaaaaaaatcaaagaaaataacataggatttttgtcactcatggcatgccttccacatggctttgttttccaaacctggccagcctgcagtttccttcccatagtggggaggagaatgagcctcccacctggagagtgtggagccccaagaagcagcatcctctggtggtcccaacatctgcaaatagatgagacagctgactcctctctggctggacttttgtttttgccctgtgcctgtctaaccttgggcaagcaaaagatctgagagcattagggctggaaggggccttggagaacattgagcccaacctccctcccccttgtacaaatgggaaaactgaggcccacagagagggagggacttgctcatggtcacacagccatggagatagagccaagatttgaactcagggttctttcttctagtctttgcaactatgggctgcagtctctctcagcagtcccaagcagcagattagtctcctggagaggcaggggcatgctttaattgctgccaatagggaaagttatagaaaagagggacagacctacttgctgctctcctcccttaggtaaacagccttgtctatttctagtcacatttcccttccagcgagctttcctatgttatatgccttgtaagtagagaatcaatgaagttcctcagttacagaggagattcaggtggacaaagccatgttatagacctaagtccccttgtggcacaggttttgtcctcaaaccatcatactgaggcacagttcatgcatcacctcctccagggagcatttcctgatttccaagactgagttgcacaacccctcctcaccttagcctttatcaactgtctgtcatggttgactcatctgtctctttctctgggctttgaacttcttgaggacagggaccttgtcttctccatgtcccaagtggatagcacggggtccagcccaaagtagacaatcagtgttttttaaatgaccgaggactcagattcccatggtaacaaaagtttgactcttgtttcctcggtgaattgaaaaaccaaccactgtaggtagggaaatgggaaatccaaacgagttgtttgttattcactgggcaggatacttcatgggactctgctagctcaagtcctgaagagccctgctctgtggtggtatgtctgccataggcccacctgtgcaatccctggtgggtccatgggattgtttcgcttggatgtctgtgactgtagacttcaggaacaggatacaggttgttcaatagatttcagttagactgaaaggccatggctgaattctgttgtccttcacctaaacattattggagggaggcatcttcctaggcagagggagtgaggtggggattggctgattatgaggaggccagagcttcaggtcagaatgttttttctcatctaaatgtattaggttggtgcaaaagtaattgtggtttttgcccttaccttttttttttgagacggagtctcgctctgttgctggagtgcagtggcgcgattttggctcactgcaagctctgcctcctgggttcacgccattctcctgcctcagcctcccaagtagctgggactacaggcgcccgccaccacgcccggctaatttttttgtatttttagtagagacgggttttcaccgtgttagccaggatggtctcgatctcctgacctcatgatccgcctgcctcagcctcccaaagtgctgggattacaccgtgcccggccgcccttacttttaatggcaaaaaccacattaacttttgcaccaatctatagcttggttttcattctctggccttggagtaagccctacaggtttacatgcaaagatattcccattcctaaaagccgtgtaccgtaggatcctgggtcattggaggcagtatcttttacttagactcatttgctccaggaaagtgagcaaaacatctctttttttgtactgtagccaaggctgttgtaggaagcgttgtctgtcattctcaatgctgactgcacattcaaacctttttatgtaaagttgaaaattcacctaagattttaagtaagaaaaaaacagaaactgataccagagttaataagaaaaacaattgttgctcaggccctactcataccaattgcgtcagaatctcatgggtcagccttggaaacactctctagatgttttttaatatgcagccagaattgagaaccactgatctaagtagaaggtgataatgtgttctcttcttgttctcagttactttctaagggattctaaagccagtgacccttgaaaccagaactctcaggattttccccaactctgtgaaggtttgagacacaacagattttgagagaaatactcattctgctctcacctagagctttgcttcagtctaagttgtgtctgggtccacatcaagcacatgggtaagggtacaaagtatttggggaaggcaattctcttcccactatgctttataaggccccagacactcataattttgacttcgatttcattgcttgggcagagtatctagtcctttctcacagattacagaatttcaggtcttaaaaaaaaaactatcggggctgggcgcggtggctcacgcctgtaatcccagcacttcgggaggctaaggcaggcagatcctttgaggtcagaagttggagacagcctggccaatatggtgaaaccctgtttccaccaaaaatacgaaaattagctgggcacagtgatgtgctcctgtagtcccagctattcaggaggctgaggcaggaggattgcttgaacctgggaggcagaggttacagtgagccaagattgtgccactgcactccagcctgggtgacacagcaagactctgtctcaaaaaaataataataaaaaaacctgtggatattttgctcagtacctgggtgatgggatcattcttaccccaaacctcagcaattacacaatatacccaggtaacaaacctgtacatgtaacgcctgaatctaaactaaaagttaaaacaaacaaacaaaaaaacccaaatcataaaaaagttacctccaaagtacattcataatagtatagccagagcagttctaagtaattttaaacggtgagtgagagaatgtttgatacctggcttccattcattcattttctttggtctgaatgtgtagtgggcacatggtggaaacagatctttgactttggggcttttgaggtttgaggcttacagagagagccctcagtaggaggaggggtgtgtttacataaccctggggcaccctgtcaatgtattctgtgcagccaaacagatcaatagagtgaaaaaaacaattcagctgagtgaactgataggctgataggttatttgattgactgggctggtggagccactcaagaagaaactacagtgctataacttgggaggccagataaacagctgatgccaaaagcatctgcttagcaatcactggagcccagttgacacaagctattggaaccacatttgagtaaaaaagatataaagtgcactggggtaccatgactatgggtgaatcttcttcctcatcatactgtagtccttcagatctcaggggccgtgtagcttattacctccaagtttcttcttaaggagagaagagagcacagctctgtagtgactctaaagcttctcagctgtgtggacttgagcaagtgatttgacctctctgagcctcagttgcttcctccagccataggagtaaatatattatgtacttcatagggttgatgggagagttcagtgaggttagacacagaaaatgcttagaaaaatgcttgatgcatatacataggaagcatctaataaatggtagcattgatgattcttataaaatagaatgctgcaggccaggcatggtggctcatgcctgtaatccaagcactttgggaggccaaggcaggagatcacttgaggccaggagtttgagatcaacctgggcaacatggcaagacccgtttctccacacacacacacacacagacaaaattagccaagcatggcagcacacctttgctcagtacctgggtgtcacagctactcaggagggtgaggtgagagaattctttaagcccaggagattgaggctgcagtaagccatgttcacatcattgcattccagcctgggcaacagagtgagaccttgtctcaaaaaacaaacaaacaaacaaacaaaaaacgctgcaattggtgcagtggataggacacagactttggtgtcagatgatctgggttcaaattctggctctaccacttcctagctgggtgcctagggcaagtcagtataaaatctcttggtaggtcccacttccctcgccctctctcatagctgaagggtgaggtgaggtaagcctttagcaatgggcttggtatgtaagtggtcaataaatgctggtttttatgattatcaatcgccatcaatatgatagttactgggaaattgccctagttcttcagtcactcctcagtaggacgcaatttccttagtgctagtcattgcagtcccctttttttggttgtgttttggtttgccatttactcccatgtggagtgtgggatacaaaatgaaccctagatccatgccctggggcctagccttttcataaccctgccccactcattcctgtttgcttatgcagagcttcccgtcaatgaaagccccaaggtcctattgtaaggcctgctgtgaaaccaggtctcccccagcttctagctaattgatattctaaaaccttggattgcagcttgacctttatccttgtcaaatatctcttgggttttggcccatgattccagccagtcattggctctttgtatcccactttcttgattattttggttgcgttttttaattaggcgttgtgtgttgcagagacacatgatggtgcttaatcatgccaccatctccctcattgctctttgtggttttgtgagtcttgaattgacatgtgtgctcctcatttagccttcctgaaaaccctacctgctgcacctatactttcaaacatgcactgctggtcatctggaggcatttacctgaaatgttaccatggtgcctagacaggactctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaagatttggctggttacaataaggctagatgggctagatgaggatacacaacaatggctcaccccaatttggggaagtcctttttggcctttatgcaatgggctctctaaaggactagccatgtggtagcctgtctaggggtggggtacacagtgggaggagcccttattgatggtcttggggtctggaacccatttcctgctaggcaactgactcatcctgtgacttagggaagcaagccattgcccatctctgggtttcagtttccagagggtgttagattggaaggtttcttccagatttgaactttgactattttagtgacttaagagaaacagctgaatccaagtgcaaacgtctgtcttgcacctttaaaaagaaccaaaaccacattgtaggcaaacgatccccagtttgaaatagcagcttccgtctttggattgtgtcctgctgcccattctttctcagacctgcctggttccacacactggctgaccatacaagaccttttcatctcagcactagatgtgcacgtcttttttcttgactgtgctctcagaatactgggagagattttttacaatactgttactactgccatgaatagcacctaccaatgactgtgtcttgtgtgacaggcactgtgctgtatgctttgtgtacattttctcttttgatccttataatatcctatggagttggcattgttattaatcccttttacagatagagaggagggatgactcatggaagtgacacacagctagtaagttgcagacttagtactgccagatcccagggtcttaatgagtattataagtatgctttttgcatccctgggtggaacttggatgtattaataataacaacagtggcagtatctcttatacgcagtgaggtaggtgctgttatcctccattttatagaggaagacagcaaggctgagagagatgtggtaacttgcccaaaactgcataactataagaatccaagctgaaacgaatctgaggctaattgccctcaaacccatgctgttggccaggcatggtggctcatgcctgtaatcccagcactttgggatactgaggtgggcggatcacttgaggtcaggagttcgagaccagcctgaccaacatggtgaaatccaatctctactaaaaatacacaagttagccaggcatggtggcgtgcttgggatgctgaggcaggagaattgcttggacctgggaggcagaggcttcagtgagccaagatcacaccactgtactccagcttgggcaacagagcaagactctgtctcaaaaaaaaaaaaaaacaaaaccaaaaacaaaacccgtgctgtttcttctacaccatgctgcctttagggctagaacaagtcttaaagaggctgtgggtttgctttctattctctgctcccaggaactgtggcactgcttttctgaatggctttgccggcgcagctggccaggcttgggcaattcagggttcccatagtgcaagagcagcatccacccgactccatctcccagaagcatgcagtacttactgacaattgtatgcccaaagtaggtaattttgccttttcaagcacaaaaaggtaaatcaaattatacccaatatagagcagaggaaaagaaggaacaaatgaagtaggaagaaatgcattcccttctgtgactctcctcagccactgtctgtgtcactgtctataatatatactccttgcttttcatttccttgcatatcagtgatccatgttcccagtggtgtctaaaggccacctgtattcaactgttagctgccttgcatgtgcctatctctcagtttcagcagctgcttcctcagtttccctagtcttggcaggtaggagctttttacctaaccaatagaggattgccatccagtggtacatattgggaactgcatggctgaaaaaaaaaaagtcctgaatttttttccccctttctaaaggcaaacaccacccattcctcaatcctacttaagggattaactatgccctttcttctcttttttcttagtcttttgtcagctttgctgctcattagctcttatacaagaagcagagcaggagaagtaaatgcagggaaatacaaatcactgccggatttcagcacccccacacccccgctattgtgaatggtttgctgggagagaagctctaggaactgatggggttcagctcattcagaaaatcctgttctcctttggtattgatggctgaaaactctgattacatctgcagagcagtgtgaatagtaggttctaaaaggggctgatacaaaggacaattcacaacagattacgtacaagtaggtaataaacaaaaggcaaaaaatcaacttcacttgtaatcaatgaactgtaaattaaaactaacaagagaaattatttttgcatataaaattggctgagaaatgttaaaatcaaaattcccagggttgacgaagatttcgtgaaatggttgtttttctacactactgctgggagtcataaattactcagcctttatggagaacatgttgacaatgtaatcaagagaattaaaaatgtctatgcgctttgaccccatagctttgttactagatttcacataaagaattcatcagacactactgtttatgtctacaaatcttaactttccctattataatagaaaaaaacaagactctgaatgtctaaaaagtgtttcttaaactaaggcataatcataggctagaatattacatagcaatttatccaaaatcatgttcttagcaaatatttaaggatttaaggttttaggaaaacgcttatggcataatattttttaaaaaattctctcagggtacaaaactaatcatatctcctctttgtacgatataccttttttttttttttttgaaatggagtcttgctctgtcacccaggctggagtgcagtgatgtgatcttggctcactgcaacctctgccccctgggttcaagcaattatcgtgcctcagcctcaggagtagctgagattacaggcacccagcaccacacctgactaatttttgtatttttagtagaaacggagtttaaccatgttggccaggctggtctcgatctcctgacctcaagtgatccgtctgcctcggcctcccaaagtgctgcgattacaggcatgagccacaatttatagaataaaaaatgaggctaagggaatgatagtccagcttaaacacacagtcactactaagaaaatgattaaaagcctgtacattctggactcatggagttagaacttaaaaggaccttggagtacatctagtgtcagccccaccaatgccactgaaatcccctcggtgactacctgacacactggttcaggcagtctctctttaaatactgtggttaaggaacttgctcaccgcctctggcaaccgcttcttcaaagtaaatgatagtgataatcccatccctggtgcgcgtctagtgatttatagtctgtgaagcttctaaaggcacattttcctctcacgaaccctgggaggcagggagaacaagtacatttatctgcattttccagatgaggatcctgagttgaagtgactcccagtggtaaagtgacttgtgtagctggtggataagataggactgcagtccaggtttcctgactcccactctgaggcttgttccagccctccacaaaatccagggtctagtttcattcaagtatctccttttattgagtttatgttggtcttgctatagctgtgacccctcccatgatacctcatacatcgtctcttagaccttgaaagatgtgcttggatgtggggccacatgctagctagctaaggtccagagtagggtgaacatggaaagagctcagggggagaatgaagaaaccaatgagtccaccttgctgcaaattctagcagtctccacacaggaatctgcaaccatatttatgaaacgttgttttcataaactgctgcttgttcaataaggcataaaatagccagtataagatagttatttgctctacaatatcgtttctgcaacacagcttcaatgtcatagcagttactgcattttgtttagtttcttaagagatgtgacacagtagattaaccattgacatcaaaatgcagaggttcccttagagctgtcagcaatcttgttccattcttttcccacaactctgcatcccgccttgggaaagcatttgtacacttccactgcaaggtctagtcacagacccactcggatttgtcaatgtcatgggaaagcaacaggcaggaagacaactttctatgaccttgggatgctatctgtgagttaggcaaaggaagctgagattcagtccattactggttatccctgtacacggatggtccacatcccattccagggactatgaagaagggcaaggaagacacagtagagttttccttctcacagaggtggcaagagaaatacacaggaaaggaagaacaagccagaaaagacaggataggctgactcttccaagtgcagtgagagctctaagagggaggtgactcactgagggctgccggttcaggtcaggactaggtcagaaacctgctctggcctagacccaagggttggcagagaacagaaacagctcagtgggtttgagaacaggatgggcactggccacgggagccaacaccatgaggtcctgatcaaaccctgcaggcgtcttctctggtgcagaggcacctacttccaggaactcagtctcagaactcagcaggaagtcacaccagccctcccacgcctaatctgccagctgctgcagcgggcacttgcctgccctggctttggagccttcattcttgccctagtgggggcagggtatgttctaactagagaaatgccaaacacctatgcttgccccttccgctggtttgactgttttcccggaatggacctgagaaattcagtgaaatgattcaaagaaacaattagttgattccattagaaagttagtcaaactggtatttaagctgaatttattctggcagatgggcttgcaggggtagactcctgccatagttcctgaccatctctccccaccgtgttgctaaaggtgggaggaactagaagataaagggagggccccagtgggaacgaatggaaataccaaaagctttgtgcgtgtctgcttccatccagctgctaactgttgtcccactccattagcccaatcttgcccagtaagttctcatgacagcagtgcacatcccttcccaagagcaccagaaactgttgtctagcagatgttaggatacgtaaggggccaagtgagttaccacgaagggactctcaggtccatacattgatatgaagactaggtttgaagccatttttcactatgttcttcagtttgtccaggttcccaaagcccaggttattctcagtctaagatttttttgctcgactccccacagggtcgagctatgtgatctatgtcaagtggtacctcccttctgagcctcagggtctccatgtgtaaaatgagatcgttaagtcagatgagctcagtggtaccttacagctcaagcattcattctgtgaattcaggtttgtcctcttttggtccaaactgaaattgccttcatgggatgacccaagtgtcttgttcctaccaatattcttataaactcaattcttttctatctttttaattccctaccaatgtgggcatatgggtccactttgttcctttcacaaagaaaatggtctgcattgaggtttcttttcaagaggggcaaggaggaatctcgtatttatataagatactcaggcccatcacctgataccacccttccatcttaggtgtgtttgatcattcattcatgtatatatttattcattctctcattcagcaatatcaacggtgtgactacctcatgcatagtatcatggtgggcaatgcatatgcataagaatatacagcatgatcacttttgtaagatgggaggtgattcacaatgaaccctgctgccatcctgagctgtcaccctactggagtcactctgcgctactacataccacccctggcagagaccctgaaacttacaccatatcattagaaagacaagctacctgtgtttaagagtattgcaaatgatcaattcataggctaagcaatctagaatagagagtacttaaaagacgttaaacctaaaagaaaagaggaaaaattgtgcaaactaacagaagctatatgtgtgtgttttcattcctttgatgggacactcaggagactttgagtatcagacctagtgttaagagggctattcttaagacctttgattaaatcagtcaaacttggagtcagatgctttcaatgatactcttgtataattcttacccctttacctgttttacagaaagggaaactgaggccctatgtggccttcactataatgtctggttgcttagaacacagttgcagttgtccgggcacggtagctcacacctgtaatcccagcactttgggaggccgaggcgggtggatcacttgaggtcaggagttcgagaccagcctggacaacatggtgaaaccccgtctctactaaaaatacaaaaattagccgggcctggtggtgcacgcatggcatgtaatcccagctactcaggaggctgaggcaggacaatcacttgaacccaggaggtggagtttgtagtgagccaggatcgcattactgcactccactctgggtaacagagtgaaactccaactcaaaaaaataaataaataaataaataaaagcacacagttgcagtgctgcaaaattcctctttctttaagggagaagatgaatagtgctcaatcctgatatcaggaaaagtcacaaggccctgggtctccagctccaacagttctttctctgtggcgtcctcgggccaaagcccagctatatcccagctccatgtgggcatccagagaaagcagaactggagaaagccttgagaccagccttcctgtttaagctgtagtgattgacaccaggaactttcctcacacacctttatttcagattactggcctactcagacctttgcaaccttcctgaccccacaggcatgattaactgcctgaattttttgtcacgggtcggttttcccacctggtgtcttgcgtgcttttttccttggaatttcttggaatctttacacgtttttgacacctgctttgaccttctagatcctggagcttttgcccaaaaggctctgaaacatgcatcttgcctatggagcccgcatcctagcctgccttacttgggctgccttgataccatcccccatcagtgtgacaatgatgattctgggcacgtacaagcctctttcccaggaagctggagcaccaaatgacagctgtgtttgagggatggctccgttgacaactgattcagaatattgacaagacttcattatgtttttgctcttgtgtttacatctttcaagtgtgtttgaaaaatcaagaaaacaatacaatttggtttcccaaattgaaatgacaatgaaactgcctttttatttatttaatttttgttattctcatatttctctaggcctcttctcacacacaccaccagccaccaccccccatccccatctccccaccaactttctttctggaaaagacacatcccattgtagctgtactgatctctagtcacatactgtatctttgcagatctctctgtcattgctctttctgttctcattcatagatgacacagctaaagacggtatccaggcctatgcaggtttggctgaaagggccaacatggcattttcttttcctaaagatggtgctttggtttgtagctgtttgctcctgcctttctgtttttcgggaagcctgttggctttgcttgtaaagagacagcctgtaaggctatggtgattgaaaccagtcagcccagtgcaattcaattcggtggaagaacactgagtgcctattacaaccaggaatctaaaggaagggggagattcacccttaccttgggagcccatgtggggaaatgcatatcttcagagaggggaaaaggctgtgagagttcacaagtgggagtgacttggctctctcacctagttttcaccaactctgaccactttatttcacctcccattttaaaatgctatcttgtcttggcttgattgatatgttatttctgtgattttttttcctgcttttcttcgttgctaggtcttctttctccctctctctaactgggatttcttagatttcttaaagacctcatggacattcctataagtatgtgttgccaaccttctagacccaccaatcagaaaccaaactcatcatcatgccttcccgttttgttaatgaagtgccacttttttgtccaagatagaaacatcactgtcatcttgagctattccgtcaccatcctttctctgccgtctgcatattaattgcaagttttcttgattctattaagaataaagaaatttgagagctgccagtaacctaagaggtgatctagtatggagttttcattgtctcagggagtcagaggattagtagttaagctgagactagaactcaagtctaagattcctagactgttgcttttttttttacttcacatgaccctaaaatataggtaaagttcatagactttagaaagaaatgactaagttcaagtctccactcatctctaccatttgctagctttgatcgtgggtaagtagcttaatctctgtgcttcatctgtaaaatgaaatgaaaataccttatgtaaaggaatggttgttagaatcacatgagaaaatagcataaaacacttagcatcagatggactctacatgagatcacctcagttccagatctactgctaacactcttctagacctttccatgcttactgttaaatcttatctttctaatatggaacatttagactctaaagctttttgctgttctgaatcctatggtcttaactatgtaaggaattcaaattgaagtagagtttcaacatcttttgaaaaagagagtttctgcaaatgttaatacctcagattagctcaaagaaagataaaacagagagctcattagtaagtacttgtgaggtacttccaaaattctgctttgttaactttgagaggcaagcaaaagagacccgtagctagtctagacttaagccatgtccagaaagagtggctgattggtttacttgtgaggtttgggtagggggaatagtatcatactagatatcctgtttaatagcctgttcttattttcacttaacaatatatcttggtcatgtattgtcaatgagcaaataactccttatgagccctagtgtacatgcacatttagtaggggaaccctaagagattggaaaatgcatgagaggaagagatttctggaactgcagggctgtctaaaggagtgggaatatccttggagccattgagaaagggacagagacagctgacatctttctgagagtagaggacaaagggaggaaaggtagaggaagaaggttgcctaagaactcatggctctaatgtccttggtgattgcttggcctaaaacacttcaagccttacaaactgctttttaagacaaaccagtgtcatttaaaatcactgctagggatagcctttctatgtctagttaccttagattatcagagctgaaagaacttcagagatctctttaaatgtaatatgaggaaactgaggcccagagagcagaggaatagttcaaagccctcccaatggtttgatccttggtagcataatgagcagcatattagctcattttcatgctgctaataaagacatagccgagactgggtaatttataaaggaaagacatttaatggactcacagttccacatggctggggagccctcacaatcatggcagaaggtaaaggagaagcaaagtcacatattacatggcagcaggtaagagagcttgtgcagaggaactcccatttataaaaccatcaaatctagtgagacttaccaccacaacaacagcataggggaaaccagccccatgattcaattatctccacctggcctcgcctttgacaagtggggattattacaattcaaggtgagatttggatgggaacacggccaaacggtatcaagcagtatttaactggttttgtgtgtgtggagagggaacagatgaatcatttgtattattattcctatgcctaacgaaactaagtcatatgtgtacttaagacagagaaccaaaaccttgatttttctcttgtagggggtggctaaactggagttagaagcctactttgcctgacctttttagctttgataaaggcaaccttgattcatgatgcatgagcctgggtctttgaaaccaataagaaatggtttgttcattgaacgtgcaaacaaattactttccaaagactaaaatttaaactgacattaagctccaagagcatctatatttaattatacgtaaaggccagaaaacaatttgtaaccttaacatagtaaaattaaaagagaaatcccacctatgcaaataatttatttcagtgcaacactaccctttaggattgccatcgtttgcctgtattagcagtgctggctttaccaatatttccagggcggccctgaaatatgagtttagattggaaaaaaagcagtcagagtagctcccagggcaggctgatgctatagaaccacggagtgtgctggcttccccaatttccttttttttttccttttcttctgagacggagtctcactctgtcacccaggctggagtgcagtggcgcgatctccactcactgcaagctccgcctcccaggttcacaccattctcctgcctcagcctcccgagtagctgggactacaggtgcccgccaccacactcagctaattttttgtatttttagtagagacggggtttcaccgtgttagccaggatggtctcgatctcctgacctcgtgatccgcccaccttggcttcccaaagtgctgggattataggcgtgagccactgcgcctggcctgagtgtgctggcttctaacaagatttgcctcttggtaggaggaataataatgaaataccgtctatgataatatatttctctcgggatgtatcttaggggtcaaaatgtagtagaaggaacacaggcaagaaagcacagagatctgggtcctaaattggatccagagcaactcccatctccactctggccctcaggctcttcatctataaactatgaggcttggacccagtcagtgattacattggaagaaaagggagagaatgtgaaatgaagaggatgaatcaaataaaagtggcttcgttatttctgaatgctccctcaccttcctccactccttgacatacacacatgcatgcatacactagttttcccctcagttgagcatgagagtcagttcccctcagttgagcatgggagcatgagagtcaggatatctgggttctcatcccagctgtttcttgaactctctgtgtatcctaaagtaaatctcttgccctctatctctgttccccatctgtaggatgaggagagggtgttgggttttcattggtacccaccaggagtgtgtatatatgtacacacacacacagagtccatccccagctaactaaagcagggcttcccctggggcagggctctgcaggtctgtgtgtttcaatggcttcccaggtcactctgatgtgtacttctagcttagttccctggctggccagtctctgtgggccttcccagctctgccattctggaagacgaatgggcaattttaggggccttttcaggaactgtgtgtcctgctgctgtattctggtggcacagggattagctcaactgcattttcagctcaccccttccgagcagagtgatttcacaggatgggagctgtgcagagggcaggaggcacaaagaaacactctgtggagtcacaatgtggcaagccgccatgacgctgctcttaacctcccagttgttgcccacgtgggcttttcttgaactatgcaggaacctgattaaattaattgattcctggcttttcgaaaatccctctctggtgggttgcatgctgcttatcaagatgttctcgggaagctgatgccaggttaaattccttgcactgagaaggccagagccggcttgattcagacatggatatggtagaggagggagggcagcctgttgcctgcttttctttccttgtcgctttagcaaacatggagcattacaggccaaatgtgcttgctgagtggaaaccaggaggcactgagcgggtggctcagtctggaacgcacagggcgtagtgcttcttagcacagcttctgagcacagaggagactgcaacaaatgatagctgctgtgttattgtagtggcagcgcagtgtaagggaagagaagctccctgaagaagacttggatgtaaccccagctcttctgctcttcttgacttgcagatccaaaattctcagcttccttaagtttcttggtctctaaaatgaggaggctggactcaatcaattattttcaaacttggactctcagggttctgaggaggcaccctgagggctgcctcaggggtatggaaggtggaagaggaggctgagcaggcagaacccagaccctctaactgaccacctagagcctcaagaacaaactgccattcacatcatagtctatgtcaccagttctcaaacttttccatctcaggactcctttatactcttaaaaatgactgaggacctcaaagagctttggttcatgtgggatttatctattgatattgactgcattagaatttaaaactgagaaattttcaaaaatatgtattaatccatttaaaagaacaatagtacctattgcatattaacatatttttattaaaaataacctatttccaaagtaaaaaaaaataactgagtggcattgttttatattttgcaaatgtctttgatatctggctccatagatgatacatggattctcatatcagcttctacatttgatctgttgtgatatgttgtttcggttgaagtatatgaagaaaatccagcctcacacagacatatatttggaaaagagaggcccttacggactccctgaatgattctggggaccaccagtgtctttataccacactttgagaactgcttctctacctgaattgcactccctggagatgtacagtgcccatcctgctgggcaatgaatggcagctcttctctcactccctcccccttcactgtatcccctctttatttaaagcagctcagtttttctattttatataatggagatcctggaagattttatttgaaaaaaggagtctgcttctaaaagtgtttgaaattcacccaccttaatcttaggttactgaagatataaggatttggaagctgattgagatcctatcactcggatttttctcccctaaggatgcaaactcttgggctttgaggagggtcctttggcattgtgcctcagctcttcctggacagtgactggcatgtcatcttgacagtgacagtcttagcacatgaaaatgccactgaatgacttgaaagatttaatgccacttcacaatgggactgacctgcccagggagtgatacaggctgaaggtggaggggattcaatatttgttgagctgtctgatcactgaagcagagagatgggccataagggcaagtttcagtgatatacttctatgtcgtcatctttagagctagacattcatcatcattatttatttcctagatttatgtcgaactttcattccaagggacaggagccagtgttgaataccatgggatctaagtgccttcacaacccattgaagcttcctccaatttcttgtttaataaagaaggccgtgctcttctttcccttattgccagagtcattattgatttcatgttattccttttataaaatcacctcctgggttttcctaggcttggctcttatagccgagaatgttctctcctcagccttctgctgggcctgatgctgtgaatcccatctatgtgggtcaggggacaattccacagccatcttgccaacatgcccgcgttaggctgtgagcatgcgcagaagtactctcagagctgtggaggaggggaggctcccacacccgctgccttgtccttatttgttttgtttctcccaccagcctaggcattaattaagaggcccagactcaaaagcccaccgttagggtcaatcatttgggctaattgagtgtttccaatttagtggaactcttctctgaaagtaagaaataaaactgaatccctgggagaaaccggaacccttgtccattgctggtgggaatgtaaaatgttgcagctgctatggaaaacactttggcagtttctcagaaagttagagtattatatgatccggcaattctactcttaggtatatatctaagagaaatgaaaacacatgttcacatagaaacttgtacattaacattcatagcagcattaatcatgatagtgaaaaaatgaaaacaaccccaatgcccatcagtggatgaatggataaacaaaacgtgctgtgttcatacaatggaatattgtttagctgtaaaaaagactgacatgatgattggtacatgctacaacatgcatgaacctcagaaacttgatgccctaagtgaaagaagccagacaaaaaagaccacatactgtatgattccatttatatgaataatccacaatagacaaatccatagagacagaaaacagatgattgccaggagctgaggggagggtggaagggagagtgactactttacttaatgggtacaaggttttcttctagggtgatgaactagatagaggtgacagctgcacaacatgtactaaattccactgaattacacactttaaaatggttcattttgtgttacatgaatttctcctcaataaaaaattcaaaacaaatgaacaacaaaacaaaacaaaacacctgaatccgtggctgctaccctctttcgagctagtttctcttatgaatgtgtgtggaataaggaacccaagcctgggccgtgaactcttccagagtgggaaatgggcttccaataactcgtagacactcaatagttatatactattgagtatataactattatcatgtatggagatatcatatatggtttcccatattgctgtcttcactgtaggctcatggaaagcagggaccatgtcttattcacccttgaattccaagcgcctaagcaccattcccagcacataggagacaatagatgtttgctgaatgaatgaatgaatatgtttgtgactcctctttattcatctctatgcccccccccccaataatgctagtaatagttctaccacagctggtgctcagaacagatctatggatttgtcaagtgagtggggatgagattgttttagttttagtttttttttaaggttatttatttcaaatgaaccttaaagtaaacttaagttccataaagagtcatattggggttttgattagcgtttcattactattcactaaaaacacttttttcaaaaatgagatataaaaattggacaggatgtagaaaaataggagatttggcctatggagattcaaaaagagtaagagagagatctcagctttaataaggggatgagactgattagatgcattttactttaaaaaaaaattgtggatatctataaaatggaacattatccaggccatgaaatggaatgaagtactgataaatgctacaatatggatgaaccttgaaaacattatgtgagtgaaaaaaaagccagatacaaaaggtcactgttatatgattacatttatttgaaatgtccagaataggaaaatccactgagatggaaagtagatgactggtagtaggggctggaaggaatagccagataggccagggacagctaaagggtacagggtttctttggaggtgactgaagatgttcagaaatggactggtggtgatggttgcacatgtctgtgaatatactaaaacccattgtatactttaattggatgaattgcatggtatgtgagttataccttcataaagctgttagaaatttagataaatgtcagaaaagtaaagaatacaatttgaatcaaaaacaagtgtgactgtgttttgggagagatcttcatctaaaatataaaataactgcctggctagattcaaagggtttctctaggaaaagattcctttactttttattttttattattttttcatttttaattttaattttttgtgggtacatagtaggtgtatatatttctggggtacttgagatgttttggcataggcatgcaatgcataataatcacatcatggaaaatggggtatccatcccctcaagtatttatcctttgtgttacaaacagcctgattacacacctagttattttaaagggtacaattaaattattattgactatagtcaccgtgttgttgagatatcaaatactaggtcttattcattctttctatttttgtattcattaaccatccccaccttccccctacccccctccactacccttcccatcctctggtaactatccctccactttctatctttatgagttcaattgttttgatttttagatcccacaaataagtgagaacatgtgatgtttgttcttctatgcctggcttatttcccttagcataatggcccagttccacccatttgttgcaatgacacggtctcattcttttttatggctgaatagtactccattgtatataagtaccacattttctttatccatccatctgttgatggacaccttaggttgcttccagattttagctattgtgaacagtgctgcaacaaacatgggagtgcagatatcttttccatatactgatttcctttctcttgcatatatactcagcagtggaattgctggatcatatggtagctctatttttagtttttgaggaacctccaaactgttctccatggcagtcatactaatttacattcccatcggcagtgtatgagggttctcttttctccacattcttgccagcatttgttattgcctgtcttttagatataagccattttaactggggtgagatgagatcttattgtagtttttatttctctgataatcagtgatgttgagcaccttttcatatacctgtttgccatttgcatgtcttcttttgagaaatgtctgtttaaatcttttgcccattgcttaatcagattattagatttttctgtaaacttgtttgagctccttatgtattatgtttattaatcacttgtaatgtcagtagtttaaaaatattttcccttcactttattatattattatattatattatttctctcttcactttatttattatatcctttgctctgcagaagctttttaacttgatgtgagcccatttgtccattttgctttggttgcctgtgcgtgtagggtattgctcaagaaatctttgcccaaacaaatgtcctggaaactttccctaatgttttcttgtagtagttttagagtttgatgtcttagatttaagtctttaatctattttgatttgattttcatatggcaagaaataggggtctagtttcattcttttgcatatggatattcaggttttccagcaccacttattgaaaggactgtcttttccccagtgtatgttcttggcaattttatcaaaaatcagttcaatgtccatgtatggatttgtgttggggtcctctattctgttccattgacctgtctgtttttatgccagtgccatgctgttttggttgctatagctctgtagtataacttgaaatcaagtagtgtgattcctccagttttgttctttttgcttaggatagttttggctattctgggtcttttgtggttccgtagaaattttaggatgatttttttgctatttctgtgaaggatatcactgttattttgatagggattgcatcaaatctgtagattgctttggtagtatggacgttttaacaatactgattcttccaatccagggacatggaatatctttccattttttggtgtcctcttcaatttccttcatcagtgtttcatagtttttttatagagatctttttctttgactaagttgattcctagatatttgattatatttgtggctattgtaaatgggattactttttaaatttcttttttagattgttcgctgttggcatatagaaatgctactgatttttgtatgttgattttgtaattgcaattttactgaatttgtttaccagttctaatagttttttggtggagtctttaggttttaccaatataagatcatatcatctgcaaacaaggccaatttgatttcttctttttcaatttggatgccatcatttgtttctttcttttcttttcttttcttttcttttcttttctttttgaaatggagtcttgctttgtcaccaggctggagtgcagtggcacgatctcagccgcagccacgcgtgatcccaggttcacgccattctcctgcctcagcctcccaagtagctggggctacaggcgcccgccaccacacctggctaattttttttttgtatttttagtagagatggggtttcactgtgttaaccaggatggtctcaatctcctgaccttgtgatccgcctgcctcggcctcccaaagtgctgggattacaggcatgagccactgtgcttggccaaaactacaagtttcattctcttgtctgattatgctagctaggactttcagtactatattggttaacagtggtgacagcaggcatccttgtcatgttccagatcttaggggaaagactttcaatttttcctcatttagtatgatactagctgtggctctgtcatacatagcttttattatgttgagctatgttccttgtatacccagttttttgagggtttttatcatggagagattgaattttatgagatgtgttttcagcgttaattgaaatgatcatatagtttttgtccttcattctgctgatacgatgtatcacattggttgatttgtgtatgttgaaccattctagcatccacaggatatttctcacttggtcatgatgaatgatctttttaatatattgttgaattcagtttgctagtgttttgttgaggatttctgcatcaatattcattagcgatattggcctgtagttttctttttttgatgtgtctttggttttggtatcagggtaatactggcctggtagaatgagtttggaagtattccctcttcctctatttcccagaatagtttgagtaggattggtattagctcttctttaaatgtttggtagaattcagcagtgaggccatgaggtccagggcttttctttactaggagtcttttattacagctttgatctcatgacttgctattggtctgttcaggtttaggatttcctcatggttcagtcttggtaggttgtatgtgtctaggaatttgtccatttcttctggattttccaattttttggcatatacttgctcatactggccactaatgatcctttgaatttttccactatcagttggaatgtctcctttttcatttctgattttttatttatttggatcttttctcttttcccttagtaagaaaaaccaactttttggtttttttgtttgctttttgtttttttttttttgtttttttatttttaacataattttattttaatacacctatatgtttgaatatttgaaatctcaatcaccttcacagcacaatgattctacaaagcattctttcctttagcctcactgtatattttatcaaatgacatgactgttcctaattcataattgggacctaaacctaatggaaaatactatttcatgtattcaaaaatatttgtggtctttttctactatgtatatctggcattgttctcaggactggactctattagttttattatgaaaatgttaacatttctccatagagttgttttacaaaaacacctgtttttcaaaaacattctggggaacaacctgaaaacttttaaataacatttagagcatggatttattttaaaaattacctgatcccttttttaatgcatattgtgactttctttaatcatgaaaagttttcaacattattttggcatacctgaaagcttttaactgtccttaaaaaccccaactttgcaatagtaaattatttcatgcatcacaaaatagtcttataaaccaactttttgtttcactgatcttttgtattgttttcttcatttacattgcatttatttctgctctgatcttcgttatttcttttcttctactgttttgggtttggtttgctcttgtttctctggttcttttttttttttttttttttttgagacggagtctcgctgtgtctcccaggttggagtgcagtggcgcgatctccactcattgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgtttctctggttctttaagatgcattgttaggttgcttatttgaagtttttcctcttttttgcaagaagggtaataagccatatttattttaaaacataaatttaaaagtacctacatcaattattattaaattgaaccagcaatatataaaataaataatgcattgagtccaatttcagttgggttcacactagaaaacctaattagtataattcaaccacttcagcaaaaggaaagaaataaatatttcaatggatgggggaaatgaatttttattattccaaaataattcatgattttgaagaactcttagcaaataaaaattaaaatgaactttcttaacctgataagcagaatctaatgaaagcttacaacagtcaccccaaatggcaagaagttagatcattccctttgaagacaggtttttcctcttttttgatgtaggcacttatagctataaacttatctcttagtactgcttttactgtatcccataggctttgggatgttgtgcttctactatcatttgtttcaagacgtttttcaattccttcttaatttcttcattatccactcttcattcatgagcatattgtttagtttttatatatttttgtagttccccaaattcttctcattttttatttctagctttattccattgcagacagaaaagatgcttgatactatttcaggcttttaaaatgttttatggctggttttctgacctaacatatggtctatccttgagaatgatccatgtgctgaggaaaataaagtgtattctgcagccattggatgaaatgttctgtaagtatctattagatccatttagtctatagtgcagattaagtctggtgtctctttcttggttttctgtctggaagatagatccaatgctgaaagtgggtgttggaatctctgattattatcgtattgggacctatctctctctttcactctaatggtatttgctttatatatctaggtgctccagtgttgggtgcatatatatttaaaattattatatcctctttctgaattgacccctttatcattatatagtgaccttctttttctcttcttattgtttttgtcttgaaatctattttgtctgatacaagtatagctagtcctactcttttttttttttggtttccattggcatggaatatctttttccatccctttattttcagtctatttgtgtctttataagtgcaatgtgtttcttgtaggcaacaaatcattgggtcattttttttttaaataaactcagccactctatgtcttttgattgaagagtttagtccatttatattcaatgttattattgatgagtaaggacttactccttccattttgttatttattttctggttgttttggaaagatccctttaaattgggctttcctttcagcagcaattcatgtgagtttccagatcattacctacttgatgaggggctaggggcagagtagcttaaaggcagagtatgaagggcaactgccaactgttgggcagttggagattgatcagaatgtatgtcagtgggaaactaggattcgatttacacaaacccagctgcctgatgatttctgcactgcctgtaggatatatggggtgtccacattttcatgaggaggaatgagcaagcagtctaatgatgtgccacttatacaattagcaattcagcaagttcaacttcaaataagcagttctgaattcttcttcctactccaggggccgtccccactacttcagtgtctatcagcttttctgaaagaagagacaccatggctacagggaaaccatggtggggctgtgtgtggaggcaagtactgcctagtgttggatgcagactgcagctgtatcctttgcccttaggcaggaagaaactcccacagcatcatcccagctagagagtagcttggatgtcacagtcagacaggcagccccagcaaccttaggtggtacagcagtttctgtggggagattataaagccctctgtggttacgaaggagttgacaagctattctgatggctttctgcctgttttccttggatcctgaagacaagagcagtccaaagttattcctgggaagtgagaatcaggcatcagccaaggctttgtcagatctgggtttgcagatgagggctcattcaatgttccttacaattgcaaaaaaatggacatgtgaaaactcacttgtaacttgaaggggcatcatttctaattgggagatagccacagagaaacgaaggggccaaaacattgctagtgtgaaaagcacataggctttggagtcagatcaacctgcaagtcccattctttatgtcttagatgcatgaccttgtccaaggccttcacctctgagccttgatttcctcacgtgtaaaaggagataggaaagagcatcctacaggggctattcttctaattaaacaatgtccagtcctcatgcctggatctccgccactggctctcaactcacctttttcctcctatctctctagcatagattgctgcgttcattttattgtagagggaccttggtacttttaagattcctgaactggaattcacaaggtctgagagatggttttgaccctgttatgactgtgtgaccttggttgagtccctttctctctcaggacctataaaatgcagagtttgggcttgatggtctttaagggtaccttccaactttgataggtttctaaacgatgtcaaggtcaaattctgaatggcctggttcactgtgctagaggatggccctgatcatttggcaagcacaactctttcccaaggcgacattgcccttcttaccattgtagttacatgggccctgctggaatgagtcacatactctagcttcttccagtttcttcccccccttggttaacttggcttggacattttggattctgtctatatgtaatttgattgcattttcctatagataagaaatataggtataatagcaaggagcacctcaccccccactgcttcaaagagagagagagagagagagagacctgatctgtctgccaacttctctttccctgtgggtccctggcctatccactgctacctgatttatgtcctaggggagcagcatagctatggtgaagatttataccaggttttcatcttcaaatgagctactacctctgttccttgtgtattcaagtgcttggcactcatagccaagcacttgaattctggaattcaaaatgaaaaatagtcccatgagaggcctaaagagaggcaaacaggaagcacttcagagtgtgctgcagccttgtacagtaagtaggatgcagtccccagctctcagtggaggtgtgatatgcccagagagattatatacagtgatccctctccacattagtgccttgtgtaggcatggtacacaatgcattagaattagacaaggcgtaggatttggagacaggaaatattgaatattcccatctcagcgccttcacttattaactgtatgaccttgagcaaatttctctttgagcctctctgacttccctgtaaagtgagaagaatgccgcctacctcacagggttgctgtgaaggcaaaatgaaatacagttagtacagctgagtggctcatgagcttggtcccagcaccctacaactctggatttgaatccagactctaccacttatcatgcaagtccgtctgagcctcagttttctcatttaggcaatgagtatagacttttgttcaggatgaaatgagataattcctatagtgtgtggcatctggcatatagtaagcactcattaaatgttagctaatggtatgattgttattgtttgtcatttaggtaaaatttccaataattctagaaaagatattttgtgtactgtgccagatggtttggcaaacttggtccatattttatatgcttggggaaaaagcactgggtatttttttggtcctggttttgaaactacaggtaagacatgaaactgagactcttccaataaaaggatacctgtttcctcatggaaagcaagtttgcgctcacaatggtgctacaccttcatgtagacagttgtctgcagcccacaaaactgttgaagtggtcatgatatttcaaaagtagcacctccatcgggagcagcagtgttaatccagttatgaatattacacctgccaaacagaaagaatcctttagccacgggtctcaagcacagccctggatgtgtggatttgccacagtgacaaagactactagcaaggtgcatggggacaagaacagcaatggcttaaagcctttttcatggatttttgacaatgaagttaattatccagatgtttcatgtacttgaccccggacactcagatctttggaaacatctggacaatgtgggggtagttttcatatctttcatcaaaaccgttggttgtattaaattcagcaggtttcattaatcacctggtttgtgccctgttaggtattattgatcacaaggaagtcacagttttattgagaaaaattagactaacaggtttgaagtgaccaatgaaaagtaggagagctgggatatgaacatagttccatcaactcctatgcttgtgctcacttcactctagcacatggcctcttttcatttggggctggctgaaaggaagtttcagaccaaatccagtggttcccaccatgccttgacttcagcagcgacctaagctcctttgctgaaagcaggtgacatatatccaaatggaccatttcatgtgtctccattgtctgatccttttagtgacttggtggaatattccctgagaattatcttgatccttattttagcactagccaaatcattacttgttagggagtttttcgttctctgtgttttaaatgtgtaaaaatgtgaatgaagcagttatatcttgtgttggcagcttgccatccttggtctgtgtcagcataaaatattttggattccatagagtagcagccccttgcgaagctgtgtaaaagatacaatgaaaaccttccttctgatttgaaacagtgctgaaatagcatcatttgtggaccttccagacccaacgatctgaaacatggaaatgaaatgggataaaataactcccagtacacatatatatacttaccttgtaaatgaaacttttcggcctttattaacagaaagcaggccctgttatacccagaaaatttctaagagattccttattcgttctttctttcctttaagtcaaaaatactgtatgtatatgatcaaactgaaatgcatcactggaacctaccatacaaatacaggtgcttgcgtttggagaattccaaaacacatatgaaaatcattgtcaagtttcagttgaagaagtcagcctgtacctatgcacattttttttataactcaactagctcccccacatcatgagtggaaaggcttctcagaagggaaaacaagccaggttttattttatggccttcaattttgttttatttcgttttactttgtttgttcaatggcaaaacatccttttcactgctttctgaaagactaaattgtcaaataggtgctgtggtaatgttttcagaaacaatgtatcctgccatagccaaggacaagttatagacaaacccgttttccacggaaacaagaatccttcagtgtctagattgttaattagatcagcactagagggcactcttatgatgccaaaatgggaaatttttactaaaatctgctgggcaggggtgtgagagaggagatgaggagggggcagtttctgtaaggactgcagaccacagacaaacagcttagacaagacatgtgcaactgagaattgactggatcgccaacagataaaacactatttgaaaagggctgtttggcagtgttccctatcagatccacttggtttccaaaatgcagtcggtgctttggcaatacacgatccaggtataaggcattatttctcaaaatgaaagagatataagaagctctgattgttaccatgtgatgtagtaaaagcacatttaggcagaaaacaaaatgtggagagaagcataggagaatgtgtttacaacttaacagctactgagaaagaagaatttcaaatccttggggtcttttatggttgttttccccatcttttgcagcccttgctctgtgaattgttctgaagggttgtgtgattgagtctgggagagcaggtgcttgcttgtctgctgcccctaggcaggctctgatggacacagggtggatgatgtgctgtcaagtaaagggacaaatggacttggttttgtctctggcattgatgtgctctgtgatctgtggcaagtccctgccctctcaaagtctcagggtcagggaagagttgggtgacactagaggtctctaaaagatcactagaagacatatccccgagtttgtgatttatgattgcggaaataacttttgttttgttttggttttagagacagtgttactctgttgcccaagctggagtgcagtgacatgatcatggctcactgcagccttgaactcctgggctcaagccgctcctcctgcctcagcctccagagtagctgggaccacaggcacatgacaacatgcccagctatttttcgtattttttgtagagatggggtgtcactatgttatccaggttggtcttgaactcctgggctcaagagttcctcccaccttggcttcccaaagtgttgggaatacagacatgagccactgtgttctgccagaacttcccatatcagtcatttatagcagccacttgagttctgaatcgaacaagatatggtaggcaccctggggtagaaggtgactctatgctgtcagtaggatggtaccgaaatgatttgccagcacagaggggcttatttgcctgtattagtcattgctttaggtttatggctcagtccaaatataacctcagagagtgaccacactaagccgtcagtaggtcccctcaaattcgctcattatgtccaagttaagcctgatccctcacttgtgtgctaggcaccagccagaatctcaggcatgcccatgtgtccttccctgaggagccagtgtggggcaggggctctgggcacttgatgggaagagtggcacactgaagacagacttatctactctgactttggccccagtgtttgctagagaaatgcatgagtgtttttgtttaagtctctgcttgtaagaacccaggctatccttcataggaatgttcctgattgagtcaaattcattataaagtcttagaatgttattggccgggcacggtggcttatgcctgtaatcccaacactttgggaggctgaggcaggtggataacttgaggtcaggagtttgagaccagaccagcctggccaatatggcaaaaccttatctctactaaaaatacaaaaaattagccgggtgtggtggcaggcacctgtagtcccagctactcaggaggctgaggcaggagaatcgcttgatcctgggaggcagaggttgcagtgagctgagatcatgccgctgcacagcctgggcaacagagggagactccctctaaaaaaaaaatgttatcatgaacagggacctttgggaaatcagctagtccaacaccatcactgtagagatagggaaacggggagccatcttcatttgggaatggggttgcctagggtttcacagccagttaatggcagagctggcattggggtatcagttttttatttctattccaggcctctttctgttaccttgtgctatatttttctctctcctgcaatgtccattctagggaataagtgaccaatggctctgaacctaagggtttttgacatagctagaatagctccgtgtttatggattgtgtcatttaaggtagtacaagtggaaagatatgaggacacatccctatcaaaaatatgtcctgtttaaatgtcataggactggagatcaaaccaatataggatcattcctctggatctagaaggctctgaagtcttgagatgctcttgcccaaaagcaaggatcaggttggaatccttgtcagctggcagggaacgaaaggatgggagggtaggtctggaaaccaggtttagtatctcgggggagggcagacactgtgaaaagagcagtcaagacaacctcagggaacttcacagttgtgccaaaggctattccttgggaggttaaaacaaatactcaaagaatacatatttgaaagaatattctgggttccagtattctcatgccaaacataaggagctccctctcatgaggtatgcatgatttccagtggacttggcatggaacaaggaggaattaagagcggtcaaacagtagaacacagatgcaggggacaaccctctcccatatcagtgatgtggttactttccgcatggcctttaactgcacgtgtctttgagctctgcttttgaaaagctggttcctttcccagggcaacaagatggctcaggtacagggggctgcgagctgtgtggcaggcctgccgcagactcactatgcctctagacaattctctgattggtcttcctccctaggtgacagtaataatgcctaaaacgtattgtatgatgactgtggacctgacattctgctacatgatttacaggcatgatcacatctaatcctcccaagtactttaggaactacccttctagactgaaacacatgggcctacctacccatgtcgtttgctgttggtttctcctctgatagggctgtcttttcttctgattggtcagttccgataccatatctgttgttaaagatggtgatcatcaccagtgtaggcattatacttgtccccactttgttttttgctgttttttttgttttgttttgctttgttgagacagagtctcaccctgtcacctaggctgcagtgcagtggcataatctcggcttactgcaacctcctcctcccgggttcaagtgattctcctgcctcagcctcctttgtagctgggaatacaggcgcctgccaccacgccaggctaatttttgtatttttagtagagacgaggtttctccatgttggccaggctgatctcgaactcctgacctcaggtgatccatctgctccgcctcccaaagtgctgggattacaggcgtgagctaccatgccccaccttgtccccattttctaggtgaggaaatcagggctgagagattaagttgccttttcagtgtcatgcagttggtaagtgaaagagctttaggaccagattccagtctgtgtgactaatggacttatttcatggtcccacaccacctctcaggactgtgcataagcaaaaggctgaggtcaagcattttaacactttgcaagtaaaaaagaccagcagcttgttttgcatagggccttaagaaacacccaggccctttgcctggctcctccattcacctccaccagtttgagcaacagtccttagcctgggactttgggggcaccacacccctttccatttagggaaataaaatttagcatgtattaacataaggcattttttgctaggatatactactgtatttggccttcagagatcaaatgaggaaggtggcttgagatacaaaaggaagtggtgggtttctgagcagcaatagagtaggtgaagaccagaatgatggtggaagggcattctacatgggagaacgtggaaattctaaaacacgtcagctcttggtgtggcagttaaagggagggtgagcacaccagttcagtgtcagaaagcagagaggttgaatggaccatttgcttggcagctctggaacagtggtaggcagttatttatcatagagtgtactatctgctgcagatttgcaatctgacccaaacagtgttggtgtgggtttcttaacaacttccttctctctagctgttatatggaagtgtgtggctgtggaggtctctgctgttgaacagccatcaccaatatcccaggctcctggcagatgaagaacctgcatgaacagaaagagaaatgtggagggtggtggcggtgcaagagggtcaattgttcatcaattcgatttttcttgtttttctcaattaagtttccttctataatttttccatcataaagaatctgccactctatgtttcaaattaacaaagctgtttctctggacagaatgatgttcagctgcatttaaatttggccattatgattttggacatactctcatttactcataaactcttcgaaggctgtgctctgggctctgtgaactactaatagcatgttgtactgagaaaatgactagggattggtatacttctaagtaacatcaagggaaagctattagagaatgaaagaatattggaactgggggaattttagaaaccatcttgtcaagctcgttcatgtcatacagcccactgggagagtggagaagagaatttgcccaagatcaaatgagtcattggtaaaacctggattaaaaaccagggatcctgattctcagtcaagggctcttggatttttacctcatcctgggttttccaagtcttaatttggatccttcatacaaaagtgaatcgtttcactttcatttctcaagccctaagcacccaccctgagaatgtaaatgccaagcataagtgtcatggtctgaggttcctgattaggatgaatccacatctggagcttttggattcccaagtctcccgctattcccattactccagtgctatatatgtgttctcttcattttcatcttttgccttccctgcttattggatgcttagtcagttgcctaagtaccatttgagtgacatttagtcacatcttctggaacctggctcagaggaaggttattcctatggctttttctccagccagtgtctgggtcatgggcatggtaaccacagctccttttgtccttccagtgctgctgctttcccaggatgtggcttgctgagggctgatgaatcccatcttagagtgtcagccaggccagctgttaaagaacatgacagcaacaaatgagaaagactctgttgggatgtgggactacagtattatgaaactgccacttagaggcttcctgtttttacagtatttcaaggtgcaagcaagtggcattctctgggcagcaaatggcccagctgaaaagaaacctgatttacagcctgttgggagggctttccacaaggagaaattatgaatttgtaacgtcccttccaatccaaaagagaattctttctaatgcaaatgtttaatctgatgccatcgagtatgttctccatacataaacaaaggcataaataaaacagggagaaactctttcctagaattgataatatacagtatatttctgtagaactcttttccaagcagatggcctaaaaatattccacaagattgtaaactctgtagagtcagggatttttgtctgttttattcactactcagtacctctaacctcagtacctctaacaatggctagcacataatagataataaatattttttaataaaacatcatgattaaagggcctttttaaaggatttcattaaacaaccttcccaaagagagtgtgtgtgtgtatgcataaaatgggttcttaaaattaattcattctcttctaattagtatgtatcttttgttttaccttttccctatgaactttggctcacttctgatgactggccacccttttgattgatgcacctgtaacgtcttcatggatcgtcactcaatactccacctcttcccacctgggctcccaggtaaggcaatgagcttccaaaagtcttctcagtgcaatcaccaggcaaattttataaggcagtcaagaagtttacctagaaataaaaaaactcaagagacaataatagtgattaaagttaaatttgatcccgttcccatataaatcaattatttatacacttaacatcatttgagaatttctgttagtacagtgaaataaaaattatggctttggaaactgctgcatacttaactttggaattttctgatcctaggaatcaatatatggctttatgttttccttctaaaaatattttcttgtgtgtgtgtgtgtgtgtgtgtgtgtgttttgtcttttcacccaaagttgtgttgtttttgttcacaaggccaaattttgtggaagggatcatagcctctcttcactgtgtagggactctaaatcatggggtaggtcagtacattgtagattacttatttcttgcggctggagtagaagacgagcacattgggctctggatggtaagtccactaataggagtgtcttgtctaacagatttgatgttaggcctcaccaagtatatcgcttttgtttctcatgacatttgcttccccagcagtcttaacagctcagaaacagggaaagggggcttaaccgcaccagagactgataataaaagagccatgtattgcttctcaaatgatgattcaaaggctctgctgctagccatgctattaaaaaaggctctcttaactcacttctaaggcctgcaaagcgtatttgctgtaaagaaacatttctcccaagaaaatgcacaggctatatagcccacttcgggcataaaagaagtgttgctacattgtaaaattccttgttctggcataataaaaaacaaaaggctaactgagcccatttgaaccctcaaattagcaactgacctgtgtataacttcacagtctccgcctgctaataatatcagtaattcacacagtggaatgagtgttttgtgacccttaagacatacattataaaaacagctgagcatgttttttgaatggggagacattgcttactttgatggatgtcttgtgtttgggtggaagggactagagagatgatttatatatcaccttatgtgtgctttgaattttcatctttttaaagagcatcagtaaagtttaattgttctttattttccttttgttatttgtgtttcgtatattcctgataatatgaaaaatccctgccaattcctcctaggacctttcaatcagtcatttccatttcagtgatgccacagggttgggtttggtttgggttttgttttattggcttttgtttttttacctagattcccattgctctctgtgaaggggaatggaattagcatgagtgagtggtagatccatcattcccagaccacagcactccagggatctggctctcagtgcagccttgccccttttagccttctgattgggaatctccccattacttgagaggagccagtggggaacaaagtggagaagccatctatgagctgtttccctaaggtttgggaagctggagaaatatgctcttaaagcacaatggaaaacttttattattttatctcctctcctaccaagctcttgctagcgactggttttactgttcctttaacaggtggaggatttttcagattctagatgcagcaaggtaagtaacaatgtatttttagtttgactgaacccaagtaagctagaaaaaagagactctgcagttgcctgtccgtttaatttcagtacaacaaatagttaagtttttggcttggacaaattctttccagggctttttttttttttttttttttttttttttagtttaaaacagctgaaactacccaggcttggagtctcagttctgaaggctgacttagttcagaagggggatgaatgttcagggcgaccaccccagacaggtgtgcagtaggtcattagctctttttcctctttttgctgaaataggatgacacagtagagtgtgttgttgagaagaccccaaccgttggcaaagtgttctttacagtgcttcaggcacgtctgcctgtccctaggctggattgtgatttagagaacaagtaggtcagcatttccttgaagggaaatcaattatttgaaaatatcagggcttttaacgtatgtaaatacgtagacttgcatatttacaagtaatcccataggccagaggcctttttgacatgaagcctgcaggagagcaaatctaatcaaatacaagaaagttcctctctgtggggaagacggacgctgagaatgctcccagatgatgcccctgcaggcaacaactgttgctaagagctgtaccatcatattgccaccagaaccggagagtctagcaagaaccataagtcattttggaaatgtgtgctctagtcgcttggcacattgttttctaaggtcatgatgctcaccagtactgtctttggctttttgtaggcttattggctccagaaatatttactagtgcctctgttttttcttaatacccacctacaatccaccctgtgctccctggccaaataggttagcaagagcaaagactgtagctctggcatttctccacaaggacagactcccattaaaatagactacttgagccattttggggatgcccagtttagctttctgtagctgggcttccatactcccattagagcctcaatggatttacttgacagctgagaatagtaaatttagtgtttaattttgtagtcagattataatttattgagctaaatggcacagacacacatagacacctaatcacacagtattagtatgggagaacatttaaatatcatagattgggtgtgtcatggaggcaaagtaccaagttctgttactaatgaggtgacttttgtcaagcactagctccactctgagccttaatttcctcgcctgtaaaataaaatggagcggatgaccattaagacaatggtcaataacataggtaccactatccctataatagcttttatggggaagtcttgagaattttgttttctttttgctttaaaattgctagatgataggaccatctctttaaaacagttttgctgtataacaaagcaaatcctgacacactctttatttttactatggtgttgattagttggaccagattattgccagagcaactaatacctggtcttaatgagagaaaacaagaggagtacagatggtgagatgggaaagaaacggttttggtaaatatcaatggggccctttttgaattttggtgagctgaatgatgtatgaaaactatttgcaaggctagcatatttttcaaccactagtaaagcaataaaacaaataacatttttggtaatccccattgtatatgcagtttcataaatatacaagattatgattatcgctgcctcataattaacaatttgcataagtacttgctattttttagttgtctgaatagatttttgtaatccagagaaagaagggaacaatcagtggaagccatcccaaatgcctagtattattgctacacacttgcacaattaacagcgatactaattgcttcagaccagaacctcatttgtttttctaaggacagcaaaaacattaatagccagagtgcctgtcaatctctctctctttttcctatagccaactgtatcatagggtctgcagttgactgtaagcaaattattttgttggattttcagtgtatcatcttgtaatggagtttccaagtttcagttagcaatcaatgccttgaacagccagacttatttttataatattttaacaatagacctctataaagttaatgaataaaaggatgctgacatgccaatcagttctgctgctgcatttacattctactacatatttcatatctttaaaattattggcattagacctgcatataagaatcatagaaagtccaggctggaggggagctttaagatcatcccgtcacactccctcctttttcagatgagtatgattgtcagtaatttgaatcttgataacaaccaccaaatcaatgatgccacacttttttttttttgtacctttcaaacgttgggaactattatagtaagtttgaatgataactggttgtttgggaatcatatagtttcaacttattttcaaaacaactgaatcagaattttaaaaatatgccctcataaggcttacctaaacatagccataatgttgatggtatatgtgtgaaaggagatgttctatgcaaatcacctggcaatgagacactcaaccaatatcagctctctttccttcatgcatagattacctaattaacattactatagtggaaacattacatcagtgactgacagtctaggcgtttagagtcaaactgacctcgggtccaatcctggcgctgctactttccagctgtgtgacgttgggtaatttagttcatctctgttggcttcaggtagttttcttatatgtgaaatgtagccagtatataggcttgttttgaggattaaaatgagatcgtgcatatcaagtgcttagcactgttcctgtcacatagtaaacagtcgataatggtggttattaccatcgttttttggcatacccagcggcagcctcactcaatagtatatttaatcttacagtgatttggggtacttacacatacacctgtacacatgcatatttgggcacacaagttcataagatttgcatcagaaagactgctttcccaaaggttacctgtgaccaccatgtttcacaattcaatggcctcttccctggcctcagtcttcttgacctctttggagattctggcacttttgcacatattctcttgcttgaaagggttcataatctatcttgatgtcttctctacattccttaggtttcctttgttgggatctcttttccacacgtacacacacacacacacacacacacacacgcgtgcccacatcttctccctcccccactgcccctttaaatagagcaattcccaaggtcctgtcattgatctgcttctcttctgttgctatattttctccctgggtaacttcacctcctcacatagcttcacctttaacctctacactaatgattcccaaattgacctctccaacccttaattcattccggagccccaggctaactccaatttccaattgcctgctgagaatctccagggcaggatgtcctaggagactgaaagcgtagtctggcttttgtcatccttctcaggaatgcagatggaggaatctagcttcagaagtattaagggttgaaaacaaggcacaagtatggagcattagtctgagcagaagtaacagtggtctaagttagcaaagtgcttcaaactgagctttccaggggaggcataacagataaactgtgaatttctgttattatgcactggagatgtcaattggcagttggaactttaaaaggtttatattttctagggataagggaacagcttcctaagatgaaaattgagttcagtttttaggtgctggaagattggcatgtttggaagaagtgttaattaaaatcatctttcttttcttttctttttttttgagacgagtttttttcgctcttgttacccagactggagttcaatggcgcgatctcagttcactgcaacctccgcctcctgggttcaagcaattctcctgcctcagcctcccaagtagctgggatttcaggcatgtgccaccacacctggctaattttgtatttttagtagagacagagtttcactatgttggtcaggctggtcttggactcctgacctcaggtgatccacccaccttggcctcccaaagtactgggattaccggcgtgagccaccatgcctggccaaaatcgtctttctttggacacttattatcattaatcttgtttcagtgttttgtttaagaaacgcacgtgccaaggggaaagatgatgtactgaacttgaatgatgagcaggtgggaattttgtgagagcaaatgtgtgtgtagacacatacacatatgctgggtcaggtgtgcctgagattttgaatgtgtgcaaataattctatcagtgatagatttttttctttcattcattctgcagatatttacagaacatgccaagctctctgtggagcaacacagctgtgaatatagaacatatagggtctctgtccttaagtgtctaatacatttttttttgttatatgcaggtacattgacaatttaatttagtttagaaatatctgcaacatgtcacaaattgttcaatggccataatcttgctgacaatcttaatgaccaaagaggaacttaagggaaataagacagtgttaaagtgggaaaggaatgtacataaatctgaattagaaattgattacttcctttaaatttagtaaatattgaattgctttggggttttacatttcaagttggcttgccagtgttccaggccagggtaagaatgattatgtctaaccctaaaacttaattagagtaaaggaatagacaactcctggttaatgtgtgtactattgtcaggagaattagttgtaaatgagttatttctacagaaactgcaggctcagggctgatatctttagcacagaggacaatatccctttttgcagaagaatggtcccattctctaccttctcaaaatgcagtacagtcactcctgtttgagctactaccatatggcatatttgaagaccattttgtcctccaagtgggaatcatctacttgtgagttccttgacttcatggttgcatgccattctccccttcagaaatttggcatgggcctttgtctgtaagtctcaattccaagtgttcttggtcccagctgtcagtttcaaagtccccttcatggtccctctcaggtcccaaggatccctcattgcatcagtaaacctagagatctacttggatgcccagagctcctgtcagagctatgtagatggcagccaccctctgttccactatgctagcttctccttcagatctctcacggcacaaaacctctcattataatgatgtgcacattggccagtgcttctatttcctttgccttgcgtgagttagagacattctgttattctcactggaggtaagaatgattaaaaacatccttgaatttagagtctcaaatgcctttattctcatggttttcatcaatcataatataacttctctttcctttcttagatttattcattcaatatgtatctattgagcacttattatgatccaggcactgttctagacatgggggacaatacgacagacaaggtcccttctcttgtgtttcttaaagtgtgtgtgtgtgtgtgtgttggagggaaattgaaaacaaagtacacaagtaaatgaacaagattatcatagggagtggtaagtgccatgaagaaatcaaacacattggacagagaatggtcagacagttggagagtgatcagagaaggcctccctaaggaggtgaattttgctctttgcttttgttgattttgtacagacttcagttacactttgggtcctttggtttcctccatttcatgatatcctggactcggtatgcattctcattttgttgcttcttgccactgtactattaggacaacctcccttcagctagtcctgaagagtaaactaatgtagcctcctgtcaaatatgtgttccacacttttcttgtcgtagtcagtattagaattcagcatgttcacgctcttccctgttatagaatataaatggatgctaatcctttaaggatattttacttgattactcagtgcatttttgttactcaaggcaaactacctattgaaagaaaaacgcaagcattaagagttagtaagcatttggctttgcctatttctgtaaagggaaaagctattgttaaaattagtgttcaaagttaaatagatgatcctggaggttctctttagttcgaaagtagtacaattagttgttttcagagacggagccaaaatctcttttcaatatgctgtttaattttgtaaagtggatatgcaggaacattttccagtgtatcagaagtgcttagattaagcatacattttccgacaaaagctagctttacaattcttgtaaatgtcacaggaacttaaaacattgtgtcttgttttaacctctgccagctagagcagcaattcagcacagcagattcaattgtcagtttcttaaatgtgaatatctgaaagttcattgtcttttcagcttgaccacagggaatcttcaaaaaactaaaaagccaaacaccactaaaatgtttggtggtttcaaaatgctatggcataggtgttgcttgctagtgagttaggtgccaagaaaagcatgttaactcttagaaggccattcggattcttccagccatcattttgttgtcttcctcagcacctagttaaagccccaggtaggaactgaggtaggagttagaaagtttgccttccctaactcctctcacacctcccgtcctgtcccattgagctctgtgggagaagatggggaagcaggtggggtgggtttggagaaggtgcaccagaatgttgccaatatcccaagtacccttgcatctcccttctttaaaacttctgtgtcgtcacttactattccacttatcactcagatacttggctgtgttctaaatacaacaatcaactccatgactagattttgggaaagcagttttttaaaaatccagagaaaagctgagcatgattctgtggtaaaggaatcttcaggagaagaggaaccaagagagtttggaaactcctagaaatgcaactctgatttacagtcacagagattcttgacatagaaaaggagtggggtatagagaaagaagtgaggaaggcacacagcacagtgagtccttgtatgattttaattgaaaaggctgttattttctgcaggtgagaaaatagatgcacatcaaggcaatgacttatctaagtacgtgcagctaattagtggcagatgcaagagaagaacacaagtcaactgaatcctatccagtatcttgattggtaattaactaaactcgctgaatttttggcttgcttttgccgtttaattcttagcgctacgtttgttgccagcacttttaattcattatgctcaaaggactttatcaacaaaggtggacaaaatcccttagaaacaggtaaaaggaattttgttttggaggggttggggccagctgacagatagtacaggatcgcatagaggtgagagtggttggattggaaataaagcctaaaactcaagatttagcttaaaataaaatgaagaaagagaggattgcggctatagactggggatccatatttaaaggtacacatcatctctttaatgctcattcttaatgacagctgtagcccattctccatctgaagattgaaatgtcttttgtttagggttctcagtactttgagtctctttccaggcatatttgtggccttctccttgtctttctgtttttctattctgtatggtttttcatctctaatgttttccattagtttggtctcacggtcttgaccagggcactcatggcacaaccatatatatatatatatatatgatcttatgtgcacataaaatggagaacactatttaacaagttagaaactattagattatttctgttcctctttcggaactgaaagatttcctcttgacaaatggctcttctccaaaatcttaaaattgcacctcagaaaaaaatgacggtcactgtgctaccatgaagcttcctgtcccttcactttcattggcttactattcaatgagctccattgattttccagacctccattgattttctcaaccttgcctcatcagccagacactagaattacaagggagcttcatcaatatcttgtgtggtttcaaaacttttccacttttctaatttgggcaatgggtatggtacaaaccatccgtaaacggcatttggtggtgcattggtctttcttctcatggcttctacaattctaacttgatttctgctcaccacagggcacagtttgccttctcttccctgggagctcttgttcatttgtcaggagacctaaaagaaggctactatgtacagtggtggaatgtcagagtcatcctaaactggcataaataggtctttaatggcctttactgattgtttctatattgacatataaatccacatgaggctgtgtgaggagactgtgcatagtctttctcccgttttttcatatgaattgatttgacaatgtcatagatgatgcatgagacaaagtaaagtgtttcttaagctcactgctgcttgtttgcatgaaaaggaataaaagctacagggaagaaatggacattgtgtgatgctttaggcaggagccattttctgactcacaccttttagaccataatccactttctgaacctgtgcaggggaaagtggtcactgtgatattcttttgctggaaaacctcctaattaatagaggttttctgaaattcataagagatgaaatacagagtctcaaaaaacgaattagttgtaattataaatgcttgcatcttatatgagaaaatgaaatgggataagagctttttgaggaagagtctctgaaaataacacaatgttttattgttgaagagccatgtgatttaatactcagtgatcatgaaatcacatgtaaagcaatccaccaggagagtccagaaagcctcatttattcctctctatatgagcagattcagtgtctcctttacaatgctatcaaaatatgtataaataaaacaacactcttggggctgattttaaatttaacccacagtaactgtaatttaacatgagtacctgaatatttccctatttggagtcaaagtgggataactggggtaggggttggggagaggcccctagctttctgtcctacaacaatctcaagcacaggatctctgatttccccttctcatgcaggaggtattttatgtcttggcaatgggtacttttgttcactaattttcatggcctacaatcataggtcaattggctctgggtcattctggggctgagggaaaacaggtagtgtccttcaatagatttggagaaactggagggggcctcttaacttggtgattttccagtaatgtgattgaaaatgtactactacattaattaattcagtcattacagatacacttattgagcacctaccataattcagcacgattcttaatgctagagatatgacaattgaataagacaaatatagttccttctctcagggagcttatattctggtggcagatatagataatttggaggaagcaagtcaacaaaatgtgtccatattgtgatgaatgttatgaaagaattaagtggagtgctagataggggatatgtagcctttggaataacctcattgtggggcaaacttatcctttgtggatggatttgatttttggaaacatcaaaaatgatatggggccaggtcttataaatatataatggaagatcaaattgattgataaaagttttgcccccaaatgagggtatatatgtaattactgtaatatttttgagtgtcagtaaaaatatatactacactaactagtgataagcacgcccatgtttttaaaggcagtgaaagggctccagcaatgggtgttatcctttggcaagcatttaggcatctatagctaccaacagcactgtctccagttctctgcctctcctcaattctggtcaacccttgtcatcattggcaaatgtactttagctgttatattggtacataaaataaacattcagagacattccaaactatgtagtacagcagtaacatgtgaaatttgattctgtcacaattataatttagttctctcatttcattagtccaaataaagtggagtttcatttatgctattttgtatcaaataaatctgtagaatgctaatacaccacttcgatgagatacaatcaatttgagtctaggaaaggcaagaatgttataagctagaatgtcaagatgaagatgaacagacaaaggaagccatgataggagaattgaggaccccttgtgtgctccttcttgtactaacttaagtgatatctaccatgtccgtttagtgatcgttctagacatgtccccattaaaggatatctaatagagatggttttgtaaaatgagaagaagccaatgatagccatttaattacatctttagtgtgacgttagctccctgtcttgagaagcattgatattctccatgggtgtttacttgagcaactactctgccaggcactgggagtacagaggtgaattagagagagatcctgtctttatggagctcacattgaatttgggagatagaactaaccgttgtggtagaatatggttcatactaatatgtataaacgtagatacttggtacttcaaggagtctgctctaggttgagtcgttgggtcagaaactactaagggaactattctatggtttgctaaagctagtgatggggcaggtatgttcatttcttcacctcatataaatatctttggactcttggcatgattcacatgcatacactttcaatctatctgccagttttaaaggcaggtataatggtgaggtctagtttcaaaataagtagcttttataggtaatattctgtggtttcttcttgaatgtagaaccagaccgattcagaataactctcatgtgacctgttgtgaagagccggccttaatttttctttctctttttttctttttgcaacaccagctccatttctagtagcaaatctgagccaaaagcacagattcattgactgtttgcataagacactaaatagacactgaacagaggattaatgtagccctgtcttctgggagcttatagtctaaaacagacaacaaactggaaagaatatccaacacacctgatatgctcatttcccttctcatataaatccaaagaaaacagaaagtggcaagtcacattctacaggattgggaaaatcccctagagagtattttctttttgtgacttttcaagttaaaaggtattttgtatatgacatgtaatagattacagtgttatttgatgaaaatgcaagcaatgttcttcctttcttttttactatcaacaagttacattggaaggtgtggatcaaattaaaagtgaattcttgatttgccatggggaaatatgtgcagtattttaaatactctaaggtaagggtcaacttgtgggaagaagaggtatcataaaaattaatttaagaaactagccttgagatatttcctaataatcccacagggaaagcaacatctgtgtcataataaaggcgcttagtgtgacctttttgcaaaagggaatattaccgaaacatgaccaaagtttggagctgaggtactgcagtaaaataatgggagtctactaaatatttataaggatgtattcatttgtaagaaagtagtgaaacagtagaacatctgccaaaccaaggttaatttcccaaagctcatgtgtttgtgagagacacagagacaggcacaggaatagaaatgcagagataaagagacacagagagagaaagtagcaagaggctgagccagaggtggacagagaccaagaactgaaaatcagccaccctattgattaccttccaactctgtcatgaaatttactgagagaccttggtcaggtcactgctctctgggccttggtttcttcatgtgtaagatgaagggatggactagaatatgactctatagaacttaccaactccctggttctactcttagctgcaaggtaaatgaaaaggcaggcaggtgggtaggtaaagatatacacgggcaggcatggagacagacagactggccacatacatgcatacacaagtttcacaaaaatagaacaaagcccaaatcatggtagaccagtgaactgtgaatcacagagagcagcagccagatccacaaaatcgtctcatcgcttttgatactgccatggtgaaaacttggcagatttccttttacctagcacttgcccagcttcctggaggccagcattcagaccttttctgactggcttggccgaccctttcctccaccgactcagaggattagttatgtcaggatctgcaaatgacctctgatgcccaaatggaagaactcagcctactcttctaactcttaacacttgaggatgaaaaaactcacataacctaccatgcatattcttgtccaactttctgtctggatatctgtctggttgtaatgttctatggataattttaagcacgctgtgttcaccaggctttcaaaggtaaccacttttaaacttttgtgagtcttgtttgcaggggcatggaaatgaagagaataattagtacttgtcgagctcccagccagcgaatgactttagtaaggtgctaacaatgcactcaagtgagtgcagcaaaatgatgaggacttacagatggattttagtatctggtttatttcacttccattggtttttgcaagatgtaatatagtgtgatttttcttactttgactgcttataatttatcagccttccccaaaataatacccccatagtttaatctgagggcacatgagctgatagtaggtacccctttgggaaaatctgattaagcatttgtttctcaagaaactcctttggtatctgggacaccattttgaatacatctagagcttcacattttgatgctagtacattttataagaatctatgaaaagcaactccatcaaaattgtgtttccttagagaaagatagtgcattaggataacaatctgtattgcacccattaccatagtactttcttaagaggtttttgccatcactggaagccttactcttccaggacaagtgagccctgagaacacaggctagggtgggcatgatgtgtgaggatgaagaagccaggctggctgcagtcaagcttgctcttataccaagtggcggatgggtttggttgagtcattgtagctagcgagagaggatgctgaaagacacaagagaggcttggcttccacatatatctccagcgccacctcgtccctggggtccagactcctgcaactctcacaccactcctgtctctactgggaggtttagttgggatctcaaacttcacctgcccccagacaaactcctgacatttccccagaacgtggtcctctcccaatcttccccgcctcagtgagtggcatctctgtccttaccagttgctcaggggaaaatcttcaaggtatcttttgcatatctttttctcccccaggccatgtctaatccactagcaaattctgtctacttcacctgcataatatatctggaatttgaccgcctctcgccaccatcagctctgtcatcctagtccaagccgccatcatttcttacatgggcttctgtaaaagcctactagctggctcccctgcttcctttattggacccctacagtcttgtctaaccacagtgataacccttttaaaatgttaattgagatgttgtcattcctcttttcccagcccagcagtggctctccatctccttcaacaaccaaccctgcaaggttcctgcaagctccatctctgactttatattttattaccctgcctcaggcccatttttctctaatcacactggtctccttgctttaccttaaatataccaggcctcttgctgcctcagggcctttgtatttgctcctctttctacctggaatgctcttcccctagatatctgcagggctgggtccttatgttcattccagtctttcttgaaatgtcataggaataggattgccaaggagtccaattcttaaaaagaggtcactggtcttggccagcaggaagtcactgatgactttttagagggcagctgcagtcaagtggtagaagaggagccacattgtttttgaatcatctgtatcccttaccaggctgtgcaccgctcgagtctggtgctgttgtctcattcatttttgtctgtctagtaccctccacagtgcctggcaccagtaggcactcagtgtttgtgggatgagggcacgagtcttattttcaaacaattggttatgttaaaacacgttaaattgctgaatgtttgtgattgctttctcagtttttctcagggaatatgtttgaaaaacaaaatctgtgcatttattgtagacccattccctgagtattgacgggtgacatggtgctgtacatgtgatttagaggttttcagtgcacacaggttgtgggggaggctgagaccatcctcagtgtcttagggagataagaaagttcaatctctgcttgtgtatttactagctcacttcccttttaaaatcccctttctagactggaagggctatttaaattcaaaagctatccttgggttcaagcaaaatcttaatgactttagggacagatatttaacaggtggtttagatagttaacactcggctggtggtgaaaaaccacattgaaccacattgaacatggggttccctaataattttaactgagctcaaccttcatctcctttatcgcctctcctttatttaactatctactggagttcaaaacaccactgtaggaatggcttttcttcttgtatcttgccccccttccaggctctgccctctgagatctttccctagacaccagttagagaaggttggccttccctgaaactctttattcctagatccttttgacaccactagtaaatcctgctttctttgctgtctgagaattttatgaaggtcacttctgcagcatcggcctctacaccaatggctaggaagccgtggcaggactctgatcccatttctagtattgctcttaaaccagctctgcctgcaaatgtcagagttttagacctcaagccctctatctcctgaaagtaattgtgacttgtagcctatcacctgggtcagtccacagggtctgctctgcctgtcctgatatctaccatattcgtcatatgagacatttacctatgtgggagggaaaatggtatcacgagtgtggccaagaataggtagctatttctaccgggagtggaggaggtcatttcatacccctacaaaagaggatttttctgttaccccctctgctataaatcaaatacacacttaacagttatatgccatccaggctcattcaacaaacatttgccgagaaccacacagcctgggtgtaaaggagttgggggaaatagggacatgagacatggtccatatgccctcaaaaagcctgcaatccacagaaggtggaaatagtgagaaaggtacagacagagcctatgaatcagtgcaatataatcaggtctgagcaaagtggagccaagaggaagcaatttgttgttgcctgaggctgtagagaagactattcaacaggaaaggcagatgtgggttttcaaagagaagcaggattttgtggagaggagaagatggggaagtgctatcctgttagagaaagtggctttgtaaaggcccagaggcaaggaccagcatggaggatctgggaagggttgtggtgtggcatttagaaaatatgtaaggccaggttccatctcggagggtattgaaagccatgctgagacatagacctgattaagtaggcaataaggagctgcgtacggttgtcaagcaggggaaggagaaaacagctgtttcttccaaagataatagtagcttaactgtggagcaaagaagggagcgggttggcgctgtgatggataaataccatactctcaccatcactgcactgaccacactgagcaaacaactctcagtgtgaaagcggggaagtgatagtcctaagggctgtgtcacccgggcggaagaactgcagttgcatcacttgtcctgatcattgttaaactgagcgtgggctgggagctccttgttcctaggcaaaagtcctcagtaggagactgtaatcatgcctaaaattacttcattattggaaccagtgtttgatctgtgattaagagctggatgaagaaatcaagtaatcagccattgaaattgtaaccataaattgttctataaacaactaacttcccctgtctcccggactccaagcaacaaacttgaaaacagatacttttcctgttgtttcttcacccgatgggttttagccagtgcttttgagccttgcagaagtcagagggtaacacctgccagccacagtgcccctttgtccctcacatatggatcactcatgatgttgtaccttgtcagactaagacaagatacccaaggagtgtggagctgttaaaaatatgcaacttattaagatttgtctagtgagggtaaagagatttatttttaacagaactggggagaaactgcctggatttcaagataaagaatagagaaagccctcagcggttgttgccttttcaatgatgtgttagaagtagcttttgtcctgaagggttttattttgcccaaagcattcaaatactacagcccatagagacatttctgtaaaacaacattagggcttattgactttttcttgtttggggttgcgctgtgcttaaccttccagatatgtaataaatagtaacaaattttaagaaagatctaaactttgttttggggaagaccatggcagcaaccaggcaatcttgacacatgaagtaactgactgtggaaccacaacctgctttgctcctataatgcctagggacaaccagacaagagcggttaagggagttatttcatgtgatcatttttctgacgttaagaggtagcacctagtagttgctcagcaaggttcattttcctcctctgttgtcatttacagcccaaacccttagagatcataacatggaagagcccttaagggtctgcccaaacctttccattttgcaagataagtaggaaggctcacagaagttaatgacttaccctttgtcctcgactggtccttagcagaagcagagctagaatcgggtctacaatccagctgctttgccttcttcgatgggagcagtacttcatctgtctcttgggaataactccagtagcccagtgaaaacattgcctctttcacaaaaattcactttcacaagttagcatccttggcacttggcataataatgcgaccaacgataacatagataccactttatagtctgcatagtgcttttcaccataacatcttgtgttgaactcccattgttatccatggctctactggtggcattttaaaggacagtgtgttgtagactgggatcccttacccaaagaggagtttgaactccttttttaaaaagagggctgagaaaggtttcactttatgttcctgtaatttcttaaaggatttatagataaaaacattaaaatattctgggtgtaaaataaaattgtctcagaatgggaatagacttaaggtacagtgaggagatataggagacaaatcaatggaagatttaaagtcaggaataaatgctgataatggatttctagatacttctcttgaattccaaaaacacgaaaaataaactgttgttactggggtggagacaaaacagaagaagataaagagaacaggctaaggagaaaggaagaggttaagggagaaacctctgtatgaggaacaaaccaaagttgactcttttttcaaaattcctacattctctgggataaacagctaatgtttgaacataaaacagctgaatctcccagagcttcaactactttctgttttggaagttagtactttgggaaattgaagactctttccatttcctagggaagttgccaatttagggttttacatcagaggttggcaaattatgtccccaggccaaatccagtccattacatgtttgtttgtttgtttttggtatggccagtaagctaataatagtttttatattctcaaacaggtgaaaaaattaagaacaatgttttgtgacatttgaaaaatatatgcaattcgcatttcaatgtctgtaaataaagttttgttggaacacagccatgcattcatttacatgttgtgtatgactgcttttgtactgtaacagcagagtctgcaactctgaaaagatttactatctggccatttacataaagagtttgtcaaccgttgctttaagccaatcttttggtttccctgggtcacattggaagaaggataattgtcttgggctacacataaaacacacgaacacaaatgattgctgataagcttaaaaaaaaaagcgaaaaaaatctcataatgttttaagaaagcttacgaatttgtgttgggctgcattcaaagccattctgggctgcatgcagcctgcaggctgcggtttgtacaagcttgcttcaaactgaagtatcttcatgatctgaaagtgttaaataactttctctagagcccagctcttaaccagaggggagtttagacattgggataatctggttcaatataacttaattcaatgacttgtacttagaatcaagttacaaaagtggaatattatgcttcctgtctaactataaattgtattccatagaggtacgtcaaatatttcaattttctaaaatgtaatattaagcttcccagtaattcaaaatgagattaaggggaattttttttcatttgctctttgtaacaaccagcttcatataaccagcagcaaacaatggggtccccagactgtttgaggacacttttgtatcgattagctgtagttaaagcctgaatggttaagtcagcaatttgacttaaaaaaatgctgtagattctaatttataatacctctacagcaacagacttcctatcaggcagattgtggagacaagcagttgtttgtaccgatttctggctaattacttatctatttgatatggcatctcccaccaaaatgccataccaagctgtgctttccaagggcatttttgaataatgggattcaaacaggaatttaaatgttcacccgaaccttctctctcgatctgtgcactaggatgaaggagggttgattccagcttgggacagatgaccaggaggtatgggacagatgaccaggaggtaaatgaaggggttgaggatcagtattggaaggtcaggaaggacacattttacaagttgggacattcaacctatgaatcatttcttatgcagtttcaagatatattttgcattgattagctgtctttgaagcccatacagttaaggcagttttctgccttctgcctcttcactgagcacctgtattagctagagcttagatctaagaattctgtgacttgctgaaatttattctgctagctaagaggaccaagggcctttaagcttcagatttgcatcactgtctcttcaaactagattactttaatgagtacttgatatggtttggctgtgtccccacccaaatctcatcttgaattgtagtttccataatccccacttgttgtggaagggacctggtgggaggtaatttaatcatgggggtggttaaccccatgctgttctcatgatagggggtgagttctcaggaggtctgatggtttcataaggggcttttcccccttttgctcagcacttctccttgctgccaccatgcaaagaaggatgtgtttgcttccccttccaccatgcttgtaagtttcctgaggcctccccagtcatgctgaactgtgagtcaattgaacctctttcctttataaattacccagtcttgggtatgtctttattagcagcatgagaatggactaatgcagtactgtacttttgtaattttcataattgtttcttacattttgaatcaatagtttcataccattatgaccatatattttcaattacatgttattttggagaccatgtcatttttcatgggttttcatagctctcttacttttggctctgtggagcctaggagaaaggttcctgtcatccccatcccctggcttttctgctctgctaaaatcattataactagcttaaatttatatttcaggaaccttctgtaaaatcacaacagagttatcttctgatgagtctggttgctagactaaagatttgtatgaggattgtcagaaatgttggctgggcatggtggctcacgcctgtaatcccagtactttgggaggccgaggcgggtggatcacctgatgtcaggagttcgagagcagcctggcgaacatgatgaaaccccgtctctactaaaaatacaaaaattagctgggcgtggtggtgggcacctgtaatcccaactactggggaggctgaggcaggagaatcacttgcacctgggaggcagaggttgcagtgagccgagattgcgccattgcactcagcctgggggacaagagcaagactttgtctcaaaaaaaaaacaaatgttgactagtgtcttctgtttgggctggttatagacaacacagcttttgtcatgatttcttgtagggccactggtttaagttccaaatgttgcacctgaatactctagaaactatcgtttagctgataaccttgaataatttccagtcagcccttttttattccaaaggggtgtcacttaagatcaaattcattcagagaagtattgatccgccagctgccactctccattaactctcccctcccccagcggctgaaagagtgcccttcttggggccaataaatgtttatattgcccctaggtacgattgttcctccagcaagagccttcattaagcccagcaacatgataaggtaatgaggcttctgctttaacatagcagaacatatatatccaaatgagcatggttccctggctctccttttttattatcctgccttctcccaggagaaagtagtgcattgaggggaccatcaaaactcctcctcccttccccttctgctgagttccccaagacacctggtctcaactcctattccaaattgcccagagaaagagagatgataagtggacagaagacatacaggcggcatggcaaagaagctcaagactggcaaagaacgaaaagcgctgaatacaatggtcacaacagaggactcatattggtctagaagggatgcagaaagccagactggtgtggactaattatttctttatttcttctaaacattctatgactgagcttgaagggtcaaggaagatggctcattggagtgtcctagaattccatattacaattcagtagttttctttgaaagtatggaacacataatagatatatctttgtatcactagcattttgcccgtagcaggtggtaagtgggttgttattgcaacaacagtagatctgagctgtgaacttatacaataaggcctatactgccataatgagtatagcaccagaatcatcaccacattttaattataaaaaatattattgtactctgccatttcccacttataagcatcatgactctgtgaagtcaggtggcaagcttggattatttttatcctatttttcatttgtgtgaaccaaggcataccaatcacttggggggactggtgtgatggcttagaataagagctccaggttttcagctctgcatgtggcactcttctcaacaatctggatgaaatcaggagctagcatcacacactgttgctatttacaaaagcctaattaatacctctcattccctaatgagatactttttctgactccacagacaagcagagccaagcaagtgatgtcagaatgccagagtgaattattgggcttgtgtcaacccaagcagagatgaaaaatcacccctgtgaacttgctccaggagcaatcaaagggccaaagttttaattagtgagggttgtgatttacatttgcattcagcatcctaagaatctacattagtcttcaagctcctgcacttccctagttgttgtctgacactggttaggatagttaatatgcttttaaataacattatatttaatggacctttgaaagcactgacatatgaatccattttctcacctgtcagcagaactgttttcattaaagaagtcagtgaaagaccacatgctgagaggagctaaaagttggtggcagggaacatttcagcttggtatcttgtcctttcacctatatctactgtgaaaattaatgaacagttatctaggaatactaatattaggattgatttctaatcaaagggaaaatgatgtcaaagcactatagtgaataaaggaatgcaatggatttatttttaacaaacatagcagaactgacataatggaaaagggtgctgatttcttcaacatattcaacatttgcatgttgctgtattggttagtacatttgacagctgtagcatgttctcttgactctgcttggttgagagatatctttgtcctttgagagtggattgaattttgggaatcagtcaaatgtcctgagaaggtaatgatgatgtactaattggatgatcagactgggtcctatggttgggggccagaagtgaggtgtgactacacagtcatgagtgatatttctcatgtggctcataactgtctatgaagatagttcccagggaacagctctggaaatgtgaacgccagcagtatccttggaatctgtatacagcttctctgggtaacaactttgagaggaccagcatgcattgggtacaacacaggccctcgtgcgcttgctaaagatctgcttcaatactttgtcacaccgcctacactggctccacatttgccaagtaactatgagcatggttctccttccaacaatctggatggagctagcatccttcatgagtgtaaatttacaaaagtttaattaatatatcttgcttgctaatgagttattccttttgactccatagacatgcagggccaaatacatgatgtcagaattccctgagtgaattattgagcttgtgacaacctgggtcagaatgaaaaatcaccttagtatatttaatccagaagcaaataaagggccagagaattaattaatatgggttttaatttgttaaggtcttaagagggagcctctgtttgctctggtacctttttgtgtgtgtcctctttgattacaggtgaacatgcctttgggaaaagatatctacttctttactgtgctcctcggtaacctatagacaagaaagaaaaaagtgggttcttagtcttcagagagcatcaaatcattgaatttattgtttaggtgatgagccaatgccctgttcccaggaataggtttcatgaggaattgctaggaggcatagaaaaagaattgcacatagtggaagtagatgatgataaaagaaaacaagtgctagagctggacaacagagcaacaccccatgagtcctgaacaaagaactagaaagaaacccaaggaaaatcagagtgcttctttgcagcctttggctaagtctccctagctcccaaaaggatgtagacagcagataacactgctgatgagagggcaggatccagacaggtgagctgtgctagggaaggggctgccaaggaaagccccaaatgcaatggtacaaggtgatccagtgggagcaatccttcctattgtcccatgagcaggtgctttagggagccactggtccaaggcctgcattcaaattcatgcctcctggtttttcaccatctttccaggatcaggttagatcacagaaaggccgcccatttgccactttagcttagctgttactggcctaccttccaatgtggtatccccagctgctattaaaagaaatggacatgagtaaattttactgaatggaaagtatatcccaattaacttgactttttaaaatgtctctctatatacatacatatatatgtatatacatatatatacatatatgtgtgtgcgtgtatatatatatgtatatacatatatatacatatatatgtgtgtgtgtatatatatatatatatatgtatatatatgacactgtcctgtggagactgctcctacatatcctgtaaaaatcagtgcttcatagttttggcaccaggaataagtttgattctcctgacaaaatgataccttctctttaatcacaagttgagaatgctattatccagcgtgtttcttttaatgtttattgccttcgttgctgggaaactcagagctaaccccagcattcaatttcagtaatcttgctctttaagattttgagaattagtctcttatcccttctaaaatatttctactgatcttgttcttccccagggtcatattacaggtacgctttaggttaagctttctcaaaattggggtactggatgggttataaactataaaaaatagtgctctgaccctagtctgtgatggtccgaacacaccaacctgtgttcttcctggcccatgctacttgctctgacctggtgctccttgaaataaaatggatttctgttagttacagcccctatttttacactagagttgatgcttttttcctatgttagtcatgaattataatttctgtatgcccccaaatatcagaacaagtggggatggggaggcaaatagcggcatgcatttctctaatatttattcttatctctggagctggttgtataaagctgtcaagaagaaaatttccacttaaaccagaaccttccagcactaggagtgctgacctgtagcaattacgggtgctaggattgttttacttggtgtcttacttgactttcagtttgtgaccatcacttgacaggattaaaaattgcctctgttctatctgctaatttcttgaaggggacagcctattccagaagagacagtctgagcaggaaacaaaggctctgtactgtgctcagaaactaaaactagataggtcagggcccatgcctgaaagcagttggttctccacagcccattgttatccataggtcatggatacatcctggcaagcaggctgtaaaggacatgaccccttaattgaaataaaatgcccacctaggcatacaaaggatgagtagagaaagagtccttaagggaaatttttaattgtttacctcgattgattgattgattgattgattgagacagggtctcaccctgtcgcccaggctggagtgcagtggtgtggtcatagctcactgcagccttgacctacctggctcaagtgatcctctcatctcagcctctggagtagctgggcctacaggcaagtgccaccatgcccggatcattttaattattattattattatttagagacgagccctcactatgttgtccagacttgtcttgaacacctgagctcaagcgatcatcctgcatcagccacccaaagtgttgggattacaggtgtgagccaccgtgcctggcctgggaaatttttaaaaagaaacagcagaactttttgagagtaagaggggcatactccccttctggggttttatttcccccttgggcttctgaaactttaatgctgaactggcctctcacaagccacagacaaagctgagaatgtcaaaggtaactaataaactgctctgaaaaaaaaaaaaaaaagtaaacgtcattagagtggatggagtctaaaaatccataattctaagaatcccaggagaagcactgaacagctttttaaagccatttcttttgcccccaagccacaaaggattgtttatatccttttgaggcagctagctggatgcccctcttcccaattctgggattccctgagataaatactatcttgttcccttatatgccaactctactttctgctgttggaaacttctttgctacttgcagggccttctcctttcagatctgaaggtctggtctacttccccaaggcatgatgatagactgacgttcttgagccccagtgaaggttctagcctttcacagcttacattatcttcccatctcacatagaatcattctgtaaaatgtatatttctgaggtgtctggactcatacatcctccattgagagggggtctgaaaattgtttaatatagtttaacatttatggcatctcttccttgacagtgtcagtaacagagtgaagactgccattttctcaccaacgttaagggaagtcagggatagggcaggttcttcctacagtagcatctggtccaccagtactgagaacattctctgcaaggagtttgctctttatgtcatttagacattagacattttaaataataagcatgatttctacctttcatgtttttatcactggagttttctacctctccactcctccatctgctctaagccaagaagtgcctccagacagtgacatcttgcactgtgattaaagtgcttagtatagagaaatgagtggacaccaggtttgtataggtttaaagactttattaagtaagaagttgattgttttgtggctggagagaaccagaggaccattgtttgaaagctgacaacctatattacaaagaggtgacggagatgatatcatgactttcaggaagcacaggcttttggaagtgttcatcaagtgggtcgtggcataaggctgacttaaatttttttttaatgttttaatttgttgtagagacaggggtctccccatgttgctcaggctggtctcaaactcctggcctcaattgatcctcctgccttggcctcccgaattgctgggataataggcatgagccaccatgcccagcccttaaattctgattatatcagagccaagactttcttgacgttttgaagccaagttgagagcaaaacgacccatttctgattttctacataataaaggaaacaaaccaggaacaataatcaaaggtggattttttgtttctttgggaagttataaccatatttgcataaactttaaaacagttatgacatctagttgaggtactaaaacagtttctttttttaattaacttttgttgcaataaataaggccagactaacaaaaatatatccaaagccaataattctatatttgtttggcacatgttgcttccttcagcatacttcaggtcatctttgccaggaattgagaacaggttgcatgtaattacaaaggctccttggtgggatgaaggacaggatgactgacgaaataccacagctaatcagataagtgcaccagggaaaaagcaacatgtaatggctggaaacccaaaacacaagactttttttttttttttaagacagagttttgctcttgttgcccaggctggaatgcaatggcgcgatctgatcttggctcactgcaacctctgcctcccaggtttaagtgattatcctgcctcagccttcccaagtagctgggaatacaggcacccaccaccatgcccagctaatttttttatatttttagtagagacagggttttcaccatgttggccaggctggtcttgaactcctgacctcaggtgatccaccgactcagcctcccaaagtgctaggattacaggtgtgagccaccatgcccagccatcagcaaatgagtctattatgatgggaatactcatgcccccagactagatctagtttctcctttgatcccaagccttctggtgttgttctcctttgagcccactgtcccttctctggcctgtcctccttaatcttcttccaaggctattctcttctcatgctacacactctcctcatgtaatctcttctaaaggtttgaactaccatagactcccaaatctctaaagaccattcttcagctgagatctctatatccagctaagttctgcatccgtctatccaattgccaactaaacatcttacctagaggtaccaacaggcacacaaaactcaacatagctcaaaactgaacatgtcatcttcttccacatactctccccaacaaaaaaagaaggctgtgttgcgggaagtcagggaccccaaacagagggaccggctgaagccatggcagaagaacgtggattgtgaagatttcttggacatttattagttccccaaattaatacttttataatttcttatgcctgtctttactgcaatctctaaacataaattgtgaagatttcatggacacttatcacttccccaatcaatacacttgtgatttcctatgcctgtctttactttaatctcttaatcgtcatctcgtaagccgaggaggatgtatgtcacctcaggaccctgtgataattgcgttaactgcacaaattgtagagcatgtgtgtttgaacaatatgaaatctggccaccttgaaaaaagaacaggataacagcaatgtttaggaaacaagagagataaccttaaactctgaccgctggtgagccaggtggaacagagccatatttctcgtctttcaaaagcaaatgggagaaatatcgctgaattctttttctcagtaaggaacatccctgggaaagagaatacgcgcctgggggtgggtctctgaactggcccccccccaggcgtggttgtcttctatggtcgaggctgtaggggtgaaatagaccccagtctcccatagcgctcccaggcttaataggaagaggaaattcccacctaataaattttggtcagactggttgctctcaaaaccctgtctcctgataagatgttatcaatgacaatggtgcctgaaacttcattagcaattttaatttcgccccagtcctgtggtcctgtgatctcgccctgcctccatttgtcttgtgatattctattaccttgtgaagtatgtgatctttgtgaccaacaccctattcgtacactgcctccccttttgaaactccctaataaaaacttgctggttttgcggcttgtggggcatcacggaacctactgacatgtgatgtctcccccagatgcccagccttaaaatgtctctcttttgtactctgtccctttatttctcaaactggctgacgcttagggaaaatagaaaagaacctacgtgactataggggcaggttccctgataagactgccaacccttcttgtatggctgatattggcaaatggagccacaattaattcatgttacagcatctttgatcccacaccttctggccttgttctgtactccgtggtggctatggccctgtctgctatatgctagctaagttctgtcaagtcagtactgcatccttggatacttaccttgaatacatcccttctctctggaccttacttttctatttctaaggattcctctaactctatatttctaggcgtctttcccttgtctggggaggggtcaataaagagcctcactctttggctcagttaagcatcttgggtttaaccagactgtgattaaaaactcatgtgcatgaagcgaagtagattggtttaagttatacaaggtttagcgtttaacagtgattagtggatgatataaaaaagatgtgctttgtttccataaattgtcagaattttagtcttctgttttcatgcacactaaaataatgctcaattttccaaattgtaacacaatacaaagaggctgacaattgggtttcacttggaaaggaaaattaaaagtggtcaatacagatcacagaatagataatatttgcaaaggagaccctacttagaaataacacgcattcaaacaaaggtatgatgcctgaatgtgtgataactaagtagtttaaaaattgaaatagtttcatctgtccctgtaaataaacgtgaagagaaaagtacaaagtcctttggtttaaagggtcagtgtttttaacagacacatgaacgcatagtttaggggaactttcctttctaccccagaaggcattttcaatatcttgttggcatggcccttctacttgatttctaaggagccagatgcactgtttgcttttaagacaaggtctcgctctgttgcccagcctggagtgcagtggtgcaatcacagctcactgcagccttgacttcccaggctccagccattttcccaactcagcctctcaagtagctaggatgacaggcatgtgccaccacactcagctaattttgtttttgtttttgtagagacagggtattgctatgttgcccaagctggtcttggactcctgagcgcaaacaatcctcctgcctcagccacccaaagtgctgggattacaaacatgagccaccacacctagcccagatgcacttttaggtatagatgcatttggccccctagaaagtactcaagatgccaagttcagcaacaaggaaatatttgaatactcttggctttgggcacaacatggagctagagaatgggtaccccatgccccaatgtcaaaatcagcagtcttggttaagtaggaccaaccctgcctcaatgacccaacttgttcaagttctagctataaagacagaatatgacctcagctcttcctaatttcagtgcccaagctttttccacaacaccagggctgcttccagttagtatggcaacaccattctccagagttgctaattttcactggttttactctacttgagtttcctatctgtgggcactagagctaagaaatacttctgcaataggctgtcactttttagtcataaagtgtgagttaacatataatttgaacaaaaagccaaagccacatgactcctttagtaaacctctaacctagtttgcgtcagtcagtcaattcaattcagtaaacatgttagaagcccaatttaccaggtatggttttcagtcagcaggtgctgaaaaccttgtatatggcaagtgtgatcagagatattgtgaacagatgtgaatacaatttgcccttgtccttaaagaagttaatatgtaatgtgcaggcagagtggacattcttgaaaatcccataagaacatattaagtagaaagtgaaacaaagtggtaattcaccagggaggaggaaatgagcctctccaccaacacttagttcgtatcattctgtagtgtaaaatcagaatctcacctccaaatgaataggctgactgacttctctttgttctccgtgtgctaattcttgccattgcagttggctcctttggcttttcctaaaaagttcactgagaattttctggcctactctggggactccctaatgtgtaatgttcaccaactaggctccagttgtgaatttttaattatgccggatcattttcagtaaatagaacttcgggctcaactaatgctgtcagatctaatctttgtctcacctgctatggagctccactctgtggtgtttgcagtaattgccacttccccaggaaagaggagcttttgcagagatggatgtcagcagccctttgcattctcatctgccctcctcagaagccctacagcggggcactttatccagcagatttgaattttgatgtttggaaagtagagacaatggatacagctgattgttctctttcaattttcaccaagtgtgattgtctcatgcttcctgtgaggcagtagttctcaaagtgtgggccatagacaggaaacattaccgtcatctgggaacctgatagaattgtaaattctcaggtcccatcttagacctgctgaatcagaaactctgggggtccctgccacctgcatttaaaaaatactctaggttatctgatgtatgattaagtctatgagcccactattgagagagaactgtttcaaactaaggataagcataatttcgttctattttgtgaaaattctcataactcatttttctgatttacaattcttcaaaaacaaaaatcctaattttcataatggaaactcacatttacctttgctttccctaactttcccaagcataggcagttgtttcctgttttatttccctagcattttttcacacttgtttattccacttggtacattacattgttatgtagctgttaacatgcttgccttctccactagccttggggccacctgccggcgggaaccttgtcacactcatcatagtatccccaaggctacatagtaaacacacattaaagggcacagagtaaacacattcaatattttctgagtggataaattggttaacattgtataattttcaaaactaggtaatggccttaagaagtacgactggcagaataggaaactgagacccagagacattaaaggattcagttggtaagaagttgcagaggcagggctaacaacaaaagcttacctcagtatgggaaaggtgatggccacaggtccctcaaaactggcctaatacactaaactccactcaggaagcttgggatactttggctcttcaagggcaaagcccttgatttactcccagacaggttgctttctgccccaaaaccaaggatgctaagagagggtagctgaggttgccagttagtgagacacgtgcagagactgagaatcaagagggaagggaatcatgtaaaaaaaaaaaaggagattttagtactattggaggtataaattctagtactcggttaggccgtggtaaagagaaaagatgtgaactgcaagtgaagccaaggtagaaagctcaattttgctcatttgccagagtgtccttcttacaccaaggtgaaaacagcataggatgtactctgtgaggtatttgttataggaatgggctgccaatgattgccaccaatctcttggtacccagcttgccttgtcatctgtaagcaatctgggtgggctgggagaatggggagaagcagactatgggcatgggatgaagaaagccactggcctgcaccaggaacgaggccttcactttccctcattaaccttagcattaatctctacataactaagttacctgatttagatgcttttacttggacctctggcatacaagtctttgtaacgcagttgtaaatcctcatagagtggggtgggagtaaacagattctggcataggatgcttcttgaaacactccttaatcatagtggatcactgtctcatcaggcctcactgtttatctcatggctttgagtcccactttggagcaatgaccgcacatctgccttgtctttcttcttgagctccagttccatttctctaattgcctactgggacactgtccatcaataccccaactcgataggccccaaactgaatccgtcatcttctcctctagtccagatctccctcccaactactctctctttcactggcagagtaaatttgttctcagtcatccaacttgcaaaccttctcagtgactttcatttagggtttattctcattccccaaacatagtcaatccccaagttctgtcatattttcttttgccatgccaggcatagttattttccacccctataactgccattccagcccagcctctcattatatttcagatctcaattaccccaaaccatccaattccataactatggtttctgctcctcaatccctgatgtgatggagaagcccagagttagatgcgaacgcaacagttttataataccacttacaattgttagataccgttctattggcctctgatagtttgtaactacggtccatactgttggtaaagacacatgggattagtcagcttaaatgagaaaataatataatttagaaactgactcatgttctttcttgatcccaatgaggcattcagggacgtgactgtcactctctgggcaaaaacaacatgtaccaagaggtgaagagagcaaaatagcaacaaaaataaatgagcccattgctgcagtccctgatgccctgtggtgagctgctagagtgaaaagttaatggaatgggagagggcaagataatgtgagcgccctggttgccttttccaagagcttttcaattccagagtaactgtgagcttcattgtgaatggtttacctgatcagtataattccctctcctttgtagataagaagactaagacagcaagaagttaaatgccttgctggcagccaggattagaacctgggattcctgaataaatgctttgaacttatgaggctgcttctgagagatcatagttacactgggcttcatagcaataaaaatgagcttttcccttccctcagaaatcctgttattatccatagttaggcaaagggaaactagaagaggatgctaaataaaagcacatctcaatgaactgaactatctttgccaggtgattatcagaaatatagataatgagcgtaagatacttaaaggggcaaggactctaatttagacacctcgggcaaaagaagtgaaaaagtttggaacaaagaaaaccactcaggacataacctaacaagatagaaaaaaatgaaatgcgaaagtattatcagctttaattaaaggaaatcaatatttgaagaggtgtcttgctcaacaatagaacaagggcaaacatacttcagaaatgtgagtctcttagaaaagagaaaagcaagttttcatggggaaacaaccacgattgaaaaacctttcaaaagatgacgacttggtgtatctgttggagaggggcctgaagcacctgttggggaggccgactagatgagcttttatccctgggagagtctgttttaagtgcattttttcagtcagggagtgttcaggagcctagaggcatctctagggagtaaagaatagccagtatttccctcagagagacttgaaacaaaccctcaacaataaagtgggtttcatctcagttatcacttacaagaacacacattggaaaacattaaggactatacaaatgcaacagatgtgttatttcagaggcactctgcaaccatccaagcaagcttgcttgagaatcctttctaagctcacgttttttgtgatgcacatgatgaccaaccttcagtgactggagtccaattctcccagaccattcctcttcagggatggaagatatgtgacatgtgtcaccacttccttctctcaaactggtgcaagacattaatactcaatcatgacacttctttccattgagcccaaatgcagctttttcatttatttgttcaatgaatacctcttgactgcccatttaaaagtgagttggagagacagataaataataaaatataagcaacactacgagcaccacatgctaagtgcctagtaaaagatatgtagacaataaatatcatagccaaacctgttctcttgaaatacaatttcaatttcctgggaccctgaaaattaattcttaaaatttcagtactattgtagttgtatcagcacaactatttttcagggatctgagatgaattaattccgaaaagagcttacaaaggagatgcagaagtttctatatgccacccatcaaaaaagtgagtcaggtgtgttttaagccacagggttcttctcccacaattagctttgaccaaacagcaaaactcagattggagtgggtctgattgccattttggtttaagtacactggataccatttcagcatcaaatcattcaatcagaaacactgaaaatgctgaagagttgggttagttgcaattttcccacctgaatagaatgtgcataatactgcaaattgttttttcacttttgtagtgctggagacatttatggaacctgtgggaaagggttttcttgacagatggagatggacagccaaccagacagaaggagagctagcactcattaacttttcccaacagaaactcacctgtaattgttttcacaggcctttaatgaggcttggttgtgaggcactagagagaggaaagcagcttatccatagaaaaggatagctactcaggtgaggtagaggaagcctggatccatagccttggaaattgtaggacataaggtttgagattacaattcaaagacaagatgaaagtgatgagggctgacaagtagtctagagatgggcaaatcaaaagaataactactggggtagatctgtttcggttatgtaagttaggaactctaaatcaaggagcacccacccccccccaccaatctcatatatccaaaattatatctatgtgtctttgaaacaggttggatttattcttgtaaatccctgggattgcgggatgtttcagtgaccagagttcttggcaggatcttaatctttaggtctttgccccaaagatctttgaagttcccagacagtctgcagctgcagtattttctctttatttttcatgggacccttctagaaactgcagtgtccttgatatcactgctttagatctccttctctctcaaagtttcagaattatggcatcttgcccaggcttatctaactgacctggattttggtggaggaatgaagactttttctgtcaatgttaggtaaacttttctataccacagtcattagtacatctacaaaattaagctccgaggatccaagccagccacaagttcttcttgatccccctttcagatacatttcatcactgttaatggatctgttatttgcacagaacaaacatttccagttacttgattaattttacccctattcttggtgcaatgccttccctgtgtgatttattcctgagaatgtttttgttttcatttccccaatatctgtacttgggggatttggcagtaggttagaggggcccttattcctatcttttaaaggattactgctccaggaccacctcccgctagagcaccagttgacaataatgaggctgccgctgccagctgatagctttccctgatgtcctactgtgtcctgcattgagcttaaacagggtcaattataatgtaaactatagaggaccctagtgcccaaggcgcagacatgggaatttagcagtgggggattttgctttatcaaaaaaaaaaaaaaaaaaagtgaatgaatgaacttagtgactcagcacttagtgatttagtgatgacttaaatgaccacctactctgagcccagtagtgtgcatgagacacatcaaaaacatcccttgtatctgaatgcttccagccaagtttcccactgcctactgcttaagtgaggggctaggaggaggaaggctcagtggccagtgaccagggtgcaagagtgacacagagcatattagcatattgcattctttgcatcaggctatgccaaacttctggaagagacaattttgaatttgtgaggaggatagccaggatggtccctggtctcaggtccctaaggaatcctttgccaggaagtcatcgaggacggatagaggcagcaccaaatgaattcttcagtccccactcagaatgtggccacattctggtgagtctgtgagtggtacggggtaatggtccctgcactgtgcaggaatcccagcacttcattccagtggatttctgccccctcctctgggatagaatgtgtgtccactctctccagagccatccactccagcagcagagccagagctcacatgggtatctcccacttctaagagctgcttttcataccccctagacgttttttgttttgttttattcttgagacggagtctcgcactgttgcccgggctggagtgcaatcgcacaattttggctcactgcaacctccacctcccgggttcaagctattctcctgcctcagcctcccaagtagctgggattacagacgcccgccaccatgccctgggtaattttttattttttatttttgtatttttagtagagatggggttttgctatgttggccaggctggtctcgaactcctgacctcgtgatccgcctgacttggcctcccaaagtgctgggattacaggcatgagccaccgcgcccagcctagacactgactcttaagtgcttggacagttgctatctctctgacttttcctgatcagcctttttccatgcccacacacatctttattacctttgcaatcaccaggaacccatcattatctcttgttccaatcatatccatgaagtcatttgaagctgatgggtgcatggcagaatatcttttgtgacccccagcccaccccacatataaatacagctacttgcagacatctattttggagatacttaaaaggttcataaatatctgaaaagatgtttgacattttctgagacaatattctttgccactggaaggttctattatacacattaaaagcaaagatacatatttttctttcttaccttcactttttataaaaggttatgctgacgtagaacttactaacaaaaaaaaaaaaatcttcctgatgaaatcaggataaataattccacacatcttcaagtggagagaaaggctttgaattggtttccatggaaatctgaagatgaagtaaaggaataatttcaaggcagagcagctgaactgaagataatggtaaaatagtttgataaaggaaatagaataaagtaatcaagaagactccaatcaattattcctttttgtttacctttaggtgattaattcgtctgcgtttattaacctgatgagattaagcaggccttccttgtgatttatttcgtaattgtttccaaggtttgacataagctgtggagttattgaaggtggagatttaaattcaattactatgaagcaggtggtgattctcctgaaagaatatctgaattcacggacttcccatgtaacattatgagtgaaaattattaattcatctgatagtatctcccaaagacttttagaagtcatttggcatccacatacttcaccaaaagtcagcagcttcagaactgaacatgtaatgaagagaattcagtgcctggaaagaaaggattttattttaaagactagttatttttatacttttttttttaaaactagaggcccccttggggcctgggctgtggtgctatcattgatggaatccatgagctcaagctttgaatgccaaaaggatagctttctttgaacttgaccagtggttcccactctctacctttaaagggcacaactggataagatcatactttgacaggagagagagagagagagagagattggccagggggtggtggggggatatgcaggctggccttgagagtctttaaatgaagtgactaattgctttttgtctctgtggtccttgttgtgtatatgttttctattctttctgtgggtatagtaaggataaacggggttctccaaacactaacgcaggcgccaactctccgtcatccacaaagacccggaacacatctaagagtgggaagtaagtgaaaaagtgctcctgtacatctgacatagctgtcaaaaagtcaagtgctgtcctccttttgtcatttattcatattcattcaacaaagatttgtggaatgtcttctgtgtgcctcccactgggctcgtcactggggaattgaaacgagcaaggcatgtgtcagtaatattgggtgcatgaagaactagggaagagggaggagagggatggaaaagtcaggagatgactctggaaagatagcttagggctgactgtgaagggcaaggacataagtccataagggcaatgtaagagttggattacaagttttaagaattaaagcagcagcagcagcagcactgatttatgacttacaaagtccatgaaaacctgtcctgatccatacactgagtttaggcttgagttagaagaatctggtaagcttttccataaatttcctggtttaagtacatttatgttttaaccatatcactgatttatatgatatgtatattcttttcctagtaactaatatgcaccaagtcctacatgaagctgtttttttggtattaccaaaacttgtatgggctgaatatttgcgatattagattgaccttttctgggcttattccagaagacaacaccagccgatctctccctttggcttcagcaaagtgtggcaaactcaggcagtgtgatcccacgcagatgacatacctctaattagacacttccccttggaagttgcttcaaccctgtggtgaatggctcgagttctccgtaagctctctctccagggtgtggggcattgtgacacgcagaaactcagtccagaaagagcacccagcctgcatctaggagaaaatgaaagataccttcatcatgctaaaagctctaatctagcaataagatatgtcactacaagagcacagctttgcaatgaaaggtgaatttgtaatggtcatatattttatgtattcagcattggaccgtaaatgctgcactttgaatatgatcttatattcaattcccaaagtgaaagatctactggctgcctttttttccttcttttcctctgaataccatttcaggtttgcatataaagttgaatgcgggttatcttgcaaaatataaaaaacggtgttaaagacataaaactaaatctccaagcagttagaactcatttcagttatttattgctgagcaccataatcaaaatgctgtataaattatgaaggaagggaattgatgcacacattcccaggcagctgaatgttttcaaattagtcccaattcattgttaacacgcactcttagttaacagggatggcattgcagaacttcttttaactccatgcttacaacaatggcagaccctacctgggcaccctgtacctacctgtcacaccaaaaaccacagggcacaatctccatttattagtccctgatgtataattatggatgtttgtgatttgctgttgcctttccaaaggggccttcccttgtttcttttggctttgcaggagttcactgtcttactttttgagtgaagaatctccatttgagctacaaaaggagcaattggtagaatctgagttaagatgacatagagaatgcatacctaataccatacccaggttttcaacagtgggagggctgaataaatacattcttaaggagataaaaaatgatctatatctcacttgccatacttggtcacatcccaagcttctgccatggtgaagggtctctctctttgcacattttgagataggtaacttttacttgacatgtatagtgactcatagactgagctagttctgaattcttcattgtttttattggttgttagtgaaaaattacaagttctccgacatcctcttcctagatatgtgtgccagggtttcttgcactgttctcctcctcttagtcctctcccatcagttttcaggagatttttctttttttccattagtgtacattttctccttcttgggatatcattttcaacaggagcagtactgaccttctgtgcatatggtgagactatgaagggcatttttcacactttatagaacagtgcctatggatgtttaggcactgtgttctagttcagagagagttgtgattgccagttcctgctgcactgtctatgcatttccttagctttggtgtgtgtggtggtgaggaggggataggtagatgtctccaccccaaggcttttccccatggtgtattttctttcacaacaaccagcccagaggatgccatgttctgatgttatttgacctaatgacaataggatatagagcagtttttaagaatttccctatgttattttgaggccagacacaggctgggagatagaaggagggttctttccttctctgaaaagaaattcagtcttctctgtttttgaagaaaacaaaaaagcaaaagtcaagctgccccaaatatgcatcatggctaaaaataaggaatatgtgttgactgagtgttacgggccaacctgtgtcccaagcacttggtacattttgtctcattaatccttgcctaccaaaagctcatgaaacaggcactattatttctattgcacacatgaggaaattgaggctccaagaggataatgatatgcccacctgaggtatccaaatgaacaattttggtaaaaaaccttctttggcaccaatgataataatagtagtagtaattaaaatatattaagcatttactttgtgccattgcactagactctggggccatataaatataaaatactataggtgcccccaagcagttcacagtcttagtagggaggacagaggatgacaacgtggtatttaagtgctacaatccctagctgatgccagggttggggtgggaaataggtcatatggggatatcaataaaggctcctgagaagcaatccctgagctctttaattttatccatttacccttcatgtagcaaggttaggtcagagaaagaaaatgcaagtcggtcactccagaggggcagaatcctctgtgtcttggtcagaacacgttggagttgtggattaggtcaaagctaaaatgaaatgtctaattccacctttttccaactttcaatccatttggagcctactgagattcagtgtagcatgctgagtcgcttaggaaacctacagcttgaatgttgcgtcagttctggttgctctatttcattgcctggatgtgaagctgggtagccagccctctgtttcagggaggaacagatggaatgggatatgtctgagcagcagagccagactaccctggaaatgactttcagggaggtgcaagcagtttcttctatgccaacagtgagccaaattgacaagacagaaaaaaaaaaaacttcagtgcagaactgtgtcactgagatcaggaagcataggttttgcagaggttgacccatgaccaatcaggccagaccactgcatttagcctcacatatggttccctttggtaatgtgaacctgttattctggccaacacagcagaacacagtcaatccatttgctgacccattggattatccccagaaagcaagtaactgtcaaagctgggcatgtgtagtagccaccaagagcctttataatgttcatttggtattggaacattttcatactttacatgagaccaattattttgctgaacacaaggacactgagactcaagaaaggtaagtcactttccatgaggcacacacctagctactagcagagggcagcctagacacctggtcttctcatacttgtcccatgatctttccactgcaatgtatgctacagttcttctcccagagagcaagatacttcagctaattgcaccaagggaggccaggagccagatctcaggatgtccagccaggtgctcttccctctttttgtgtgggctctgccagctactgtgaaaatggagactttttggaaaaattagaatcatcctacttttaaaaaaatgtagcagtagcggtgatgaaaggaaaaagcatgtacttctcaactgcttcattttttcttctaaaataatggtatctctggttctatttggacagctacctttcctcaacagtattgttgagccatctcaagcctctaatctactccatcaatgaagcaatagagaactcatatatcactatagctattctctctcgaatcagccaaccaaagctaaggagatgtagattagataggtagatagacaaacagacacacatatatctacatctacgtatgacattcagaggcatccacttaaaaattaaattgcccaaagttgagatgatgatggaactcgatcactcctctcagtctgagatgtttttcacataggctcaggctagggaataacaaggaccaagtccagttttcaagtactagtgaaggccacaaatatggggccagggcagagcaaccaagcacagtgcctggcaaacaatactataaatgttgaattaagcactataagtgatgggttaaatgaattaagctaggggaaggagggatattaaaatggagaaaaagaaggtgtacagaaggggaatatgagatgatcaagtcaaaccctgcttactccacaaatctacttggagctgactctggtaagaccggctctaacctgcctttgccggaagtaccttatagtgaacaaacctgtttatctattcagtagtatccagataagagtagtcaagagcacatagcttcataaataaacataccagcacccctttgcttttggctggcaggagtcaaatgaaaaacttttcagctttagaaaaataaagtgaaggctgggcgtggtggctcacacctgtaatcccagcactttgggaggccgaggtgggcggaccatgaggtcaggagatcaagaccaccctgtctaacacagtgaaaccccatctctacaaaaatacaaaaaattagctgggcatggtggcacacgcctgtagtcccagctactcgggaggctgaggcaggtgaatcatttgaacccaggaggcagaggttgcagtgagctgagattgcaccactgcattctagcctgggtgacagagtgagactccgtctcaaaaaaaagaaaagaaaaaaatgaaagataaaatgaagtcttgcttgctctgtttggactcagcatggtgcattttcatgtttgacttcagctgtttctatgtccattgctggcaccagagtcctgcatattatatcgtgattatgttttttcctctaattgagacccatgtattttttctaagacattgggttgtgactgttgctaacccccactaattttgccactgtgtgtgtatgaaagtatgtgtgtgtatgaaagtatgtgtgtgtgagtgttctcttcaaaatggttgtatgttgcatgaagatagcaatccactggccaagtatttgactttgccagtaattgctgtagttttatgtgatgataatgtcaatagttccttagtttagctactagactaagtctaatatcacaaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggttgtctgcttttgccagttactgaaatgtggaagcaaaagccccagcaccataataacaatataacataataacataacataaacagtgcccatagattagatgctacaagaaatgagtaacagatccaggaagaaagagtccagccatggaaatgtttcttagcaagttcacctgcatctctgtgatggttaggatatacagtacacttcgtgacataataaatccacccccccaacccaacatatatgactttccatgctggtcatgcttctatagcttagtcaagaagagtgttctgttaatcaagccttgaaaagcaggaaccatttttctctcccttcaactgccatacaaaaatcagggaggcaatgtgctgctgctctctagaacaggggtcctcagtgactctttttctacctctgtgtcatacatggttgagaattctcacttatattgctctagcagagctcagggttctgtccagttcccaggcactgtctggaattccactcttctctctccctattgggaaagactaggaatgcaaggaagagtgatgttaaacagtatgctatttttttccacgtaataaaaagcaaatctctctctctctctctccttctctttcacttttccctccttccttccctcatctgtttgttcattgatctattaattcttccaccccatttttctggctctcaactgagctttctttgaactaccttggcaactttcttgaagatcatttgtccatatgtatttgggtctatatctggactcagtgttattccattgattgatatgtttatcgttatgccagcaccacactgtcttgattactatagctttatactagtattgcaattagatgttgtgagctctccaacttcattcttttttctttcttttttttgagataagactgtcaacccaggctggagtacagtggtgcaatcatggcccacttcaacctcccaagtaactgatacgactggcacatgccaccatgcctggctaatttttttgtagagatggggtctcactatgttgcccaggctggtctcaaacaatcctcctgccttggcctcctaaagtggtgggattacaggtgtgagccaatgcacccaaccattcttcctttataacttgttttggatgttgtacgtcctttccatttccatatgaattttagaatcggtctataaatttttgcaaaaagaaaaaagaagcctgctgggattttggcaaggattgccttgaatctgtatatcaaatttggagaaaactgacatcttaacaatattgagttaccatgaactcagggtatctatccatttatttgggttttttaaatttcactcatcagtgttttatagttttcaggatacacgcttttcctattttttttgtcagatatatccctaaatatttcacacttttggtgctatggtaaatagtattgttttatttcaatttctgattatttctaatagataacagaagtataattgatttttgtagattaatcttgtattctgcaaaacttactaagttttaggagcttttttttttttggtagattccactggatattcattggatattcaacatagatgattgttatctgtgactaaagacagatttattcttccttttcaatatggatgtctttttcttcttgccttattgcactggttaaagcctttagtacagtgttgaatagtgatatggttaggctatgtgtccccacccaaatctcatcttgaattataatccccataatccccatgtgtcaagggagagaaaaggtggaagtaattgaatcatgggggcggtttcctcgtgctgttcttgtgatagtgagttctcacaacaactgatggttttataaggggctcttacctcttcgatcagcacttcttcctccagccacgttgtgaataaggtgccttgcttccccttcaccttagaccatgattgtaagtttcctgagtcctctccagccatacagaactgtgagtagtcaattaaacctctttcctttctaaattactcagtctttggaagttctttatggcagtgtgagaacggactaatacaaatagctatgagttttttggtgtgtaaataatttctacccacttaagtctggaaaaagacacatacaataatggagagatagttgaacaatggaagcgtcctccgaagatgctattttgggaacaaatggttgatccctgcctttattgcatgtccaaagctagattcccatagcactgcacagatatatttcatcagagaaaagtagatcctattcatggggaggagggggaggtggaggagaaaaagtgaaaaacaagaagaaaaataaaccctaaagttcatagaatcatatatacttttctcattattctcattctttcattcatgttctctctctctctctcttctttgaaagaggtagtatagtataatggttaagacagcaaatgctggagcctaattactgccttaaaagcctagcattgccctcggaaggttaccggctctccctctgcatcagtttcttcacttataagaagaaactattagtagtgcatgcttcatagggttttcttgaggattaaattctttattcattcaaaaattttactgagtgcatagtaggtacaagatgctactctaggctctggggatacagcagagaacaaaacaggcaaaattccctgtccttatgcccattataatagagggatacagtcattaaacaagtaaaagacgtattattttaaaagggaataagtcataatttggaaaaagcaggggagaggtataaggaatcgtggaggcaagaaacttgtaaatttaaagtagttgagggaaacatcactaaaggtgacatttgaggaagggtttgatttatattaagtcagttaatgcatgtaaagaaatgggaatagttctttacatacagcaaaaatatagtacttttatgaattataatttattgagtactttctgtgtgtccaacactgtgcgagatgctttacatattatcttgtttaattattataataggcctataaagtaagggttattagccctttctactgaggaggaatctcaagacattggcttgtccaaagtcacatagtaggtgatagggccaatactcagatcacatctgagcttgtctcacgaggctaagttcatctaccccttctgaagacatcctgcatgcttagggactatattagactagactttgattcacaaatattagaagactggtcctgctgctggaggcctcagatgggataggattatgtagctaaaagcttctacaagggctgtggggagtggtgaaatatcaccttatctttagtatttcaacttgagaataagggcaatattgcctggcactccaataccagcacctggctctgacactttcactactatgtatgttgtgggcaagcaacctaagaatgggaagtggggaggacagaaataaaacaacgttactgggcaatagctattactccattacaaaagatgatttgggttttcaggatggtcgcttgctgaagtttaaacgaaaaaagaaaaatgaggctggactcagctcactgatgactgaactataaattttgcttggaaaatgctggcaatgctataaaattcaggccaccatctgttagtgcttgcttaaagtagcatttgcactggataattaagatgtcacatgcatttgaagcacaaatcatcagtgcatgggtgcctagcatccctggaaagattgtggatggtgaagatgttctgagaggaatatcatgttgcttgaaggatacatttatatgaaatcacaggagctagtgttttggatcacctgagtggggttgagtagaggaggagatgaggacactgagaaaactgctttcttgagttgactggatcatttaatcaaaatgatcaactggctaggcccatgcagtatggcaggcgtaataatatgtttggccatcactgtctgcaaagctcatagtgaattcagggatataaggaagaagggaggcaagtctggctaagcctaaaattcctaattaaaaaagaatttgcttgtaaagcactttataatttgcaaacagccttctcttttgttatttcatttaattaattttacccaccatcctaggaagcaggaattatatctacatcttacagactggaaaactaaggctgagggaaatagcatatttttgcccaaagccacatagatagtaagtggtagaaccatgattcaaaacagggcccttttaactctaaatcctaaagtattttttggccaaagcacaacgtgctctgatattagagtcaaataattttacatacctgaccaaaaaaaaagaaaaagaaaaaaaccatattttacaactttacaggcaggtagagaaacttacagacttcaattccaacaaagatgccagagactgccaaatatagcaagggcctggaatttttaaataataagaaataacatttattgagtgcttcctatgcaccaggccctgttcggagtgctttaaatgcatgcattatttcatttaatcctgagaactactccatgacgttgattcagggagagttcatcagtagcttagatggtgttgcccatacccaaatattgaaggttctctttggggtgatgtctgggtactttcagcagacacagcatggctggattgtggagctgagccaaggtaatgattctcccagctttggagtctaaagagtttcgctgttttggcatcaaagaccataattaatggaattaagaaggctgggcttgcttccaagtggctcttcaagagtgtccttctttctcatcatggttggggaggagatttgtgctccacgggctttaatgagatgttctgtacccaacgtctgcatgtttatcttcacttccccaatacgtgcctatggacccttcaaggatgatcaagctattttgtgccttcaccctaggcaccagggtatgttgttcagttgtgatatttgtcagaaaaatcttaggttggtgcaaaagtaattgcagtttttgccattacttttaatggcaaacaccacaattacttttgcaccaacctaatagtatgctgccactgcccactctcctagtactgctcccccttcttctgtgaaatgcaggtaatcattctcatcactcctcctggcatcaccaggaggatatgaaaacaagcaatataatgtctccaaagaccttacaaaaaataaataattacaaaaacatacttcatggtggttttcagtaactttggggggaaaaaatgcatctccatataagtaaagttgacagactcttacccctttccctgagaatgtcttcttgccatctatgtgccaggtttgcagaggttgccccttttctcccacagatcgttatgtcctttcccaaccacatgcctagtgtctcaccgactattcatttctcacttgccctccattggcagccatattttcaggggctaactacacatacccagctttgtcctaaaaacacacaccaagtctggaggccacgagtttccttacctgattatctgggtttctattcccccacttggtggtgaggaaacacatgcataatgttgttatttttttctgcttgcttgtaatttgggaggcagtgcgaccattcattactgaatgcctacaatggacaaggcatttgtgttagtcaacaggaataccaaggaaaaggcatattgtccctctcccctgcaaatgcctcctggtggggaatctctgcctgctgtagccattcttcattccaattctggcttctagcagatgaaaaaggacgaaaagaggtataaagaagccacccaggccattgagcctgagttcatagagccattgtgatgcacttaccatgtccttcctctgtgtagaccagtggttttcagtctatgttctgtacagcccttgggttctgagggaggacctcaaagcctgccatgagtgaaagtgatggggtagtctggagtggtaaatagatggggctccaggccctcactctacctcttcctgagtgactccattttaatctgttttacatattgggatctgcctagatttcattttttaaagccctgctgctgctagaatggaaaaccaaaaaccatatgttcacacttatacatgggagctaaactatgagtttgcaaaggcatacagagcaatataatggaccttgagactcaagaggccagggataaaaatctacacattagatacaatgtacactgcttgggtgatgggtgcactaaaatctcagaattcaccactgtgtaattcatccatataacacaaaactacttgtactccaaaagctattgaaataaaaataaataaataaaaataaaaaatacaaaagccccgttgctaagaaggaactgataactaccagtgtagacccagccagagaatactcagggagcaaggtttttattggaaaaccgcctttatccaccatgcctcagctccccagtgacaggcaaagcagttctggctattggacaatctcacagtcccctttctcaattctgcaagcttttttaaaaaaagaagaaaaaaagaaatgcttcctttcatatggccaaattgctctgaacagatgaaagggaccagactgacaggtgattgttccctaagattacagcctacacccaggctgaatctgaaacacttggaggaaaaaaaaatgctacaggttttgagtaatgctccccgactggcatctgctctcaagactaaatgaacacacactatttccactccatttccttaaactggcctctgtgctaggctgtaatgaaacctgtaggggaagaaagaccatttgcttggggaaaggattattttagttgcttaagccatcctctcccaaaaaataggcggatggttaggctggagtctttgtttttaatttaaatgtcattaggaggtccatgagttttcctcatatttattgtatgctatacatacacattgtagctattttatataaccctataaacaatttttaaaataaattttaaattgtctctttatattatattcactaacaaattcaaccttatcaccaacaatataatgttatcatcaggcccaaccttcatccccttcgttatactggtcttcttcttgtctataaaatgtctgcttttccataccattgcacctatcttgaataacctgtgtccttcaactacccatgtccaaacactagttcattgaaaagagctcattctttcaaaatagataagatatgtatttctatcccagctctagtaccttggacaagttaatctctttgagcctcagttttctcatttgtaaaatggggagaataactggaccttcctctctgctagaaattccttgaatgttcactgagatgacttaggcagatcttctggtacatactggtactcattaaatggaatcgttgttattacttatatttcaagacaattactgtgccccttactccatcatgtctcccttgatgcaacctgagggcatctctccctcctctgaacagcatctatttagcattgaaccagacactaagatgtgccattcatttgtttattaattcaatgagcaactatttattgtgcatttagaatgtgataggcacattaccagatgctggggcagggtgggcatagagaggtggatgtgaaagaaggaggagagaaggtggagacagcagggctgaaacagatactgctcttaagcacctaattttctagtaaagaagatattcatatacaaaaataactagaatacaaggaacaaagctatgtgctttgtaagaaaggtgcagctggagactcggctggaggactgtctccactggaagaaaaagttctggaaatgtcaactgtcttctttcttgttaactttccctttgtttgcttatctctccagcaaagttctggctgtggctccttgaggaagagtgggagtacttctttatcttccacagagcctaccaaagtacaaaatgagctctcagtgtatgcgctgatgtgagtaaagtatctgcagtatctgtagtaaagtacctgcaaagtatctgcagtaaacagaataggtatacaacacatgccagaaaagaccacctattctcttattccatcttatagcatctcataaaaagtgcatgcactgcaactcgatatgtgaaaaagttctaaaaaaaatggatacataaagaagtattcttcctccttgaactttaaagattcttgagcttattttaaacaaagagcattttgttgaggattttggtattgagccaactatagtacacattgcatttccctgaacctcatgatgttacagagaggggctaggagcacttctggggtacacttaccctacaggcacttctatttgaacctactgcttgtccctgcctttctgaatctgagaaattatacctgagagtactttttaaaaaccagttgattgaagtatgattgacatataaaaagctgcatacatttaatatttatttatatttaatgtatatatctcattgagttttggaggtaaatatacatctatgaaatcatcaccatcattaaggacataaatatatctatcatgccctaaaggtttcctcctgccccatgattattattgttttgttttttgataagaacacttacaacataagatctaccctgttagcaaattttacatataaaatcaagtattgttagccataggcactatgctgtgtagtagattcccagaacttatttatcttgtgtaattgaaagtttgtaccctttaaccatcaccacccccttgcccagcccctggtagctaccattctcctttctgcttctatgagtttgacctgattgtgcttttgatggatgttagaactatcttccttgacctggcttcagccatataagactgctgcagtgtctgttgaaagttgcatcccctaccccatctcagcacaacattctcctcctcctgttcatcttcatccctctttcaacccacagtagtcctttcattaacagagttgcttattcagtagtgcacagttcttttaaggcagattccaatgacttagggtttgtcctaattgactaagctggatgcaaaaaaccctgagagtcaaatgactgtggacatctgtccccatacctaaccctaagcaactctgacaccttgagaaagtcacctagcctctctgaatctgttttctctgctgttaaatgatggggctggctttgctgactaaagtacaaacaaatcgtgagacaagcccccgtcaccactatcaacacaaataatggagctagaaacacgagatcctttccaggtaatttaatactgctgcattttaaaagtcgtgggccgagaagatgagttttaaaaggagggaaaaagtaattcacatctcccaagatagtgtttataatggtctattaagaacacattgaaaagaaatggactaattctgtagtgttttacccaggacagcaggccagttcagtcaaagtgttttttgaatagggctataagcaaatctctttcggtgaaacctagagctgctttgcagaaagcagaaaagtggagttttcccctaatactttaaaaaatggtcacttcaccattgccaaacttcattaccactcccaggagctaaagcttcgagattaatgatcctcatcttaaagagaaggcagtgaccgctaaaagaaaaaaagaaattacaagcacatggtatttactgttctgcattctttgagaattaatgtcagtaatactgttgcaacatttttcaaaataaaggatggcgttttctaattgtctagttaaaaaaaaaatctaagtctgaatccccagagaagaaacctgagtttaaatcattaacaccacaaatctctgataattgtggcatgtttgcaagtgccttaatcaggatggtatgtcttagtggcctgttttaatttgatcacactgattaagcttctgtaagctaatatacgttgcatttccaattcaattaaatgagaatctcctggccttactagatattaccaaaatgccctgatgggtgaacactagacttggtattttcaattgctaccgactttctgattatataatctttgtattaaatgaaatcgatgaaagctcaaattaaattcagcaaactttaaggagtaaatatgttttccctgtatttttggcatactttcacctcaaggtgtggagcatgttagtcggaactcattgattacctttagtgataaattttatagggctctctcccccgtataccaattcctagaacagtctatcctgttagaaggcactgtaaatgtgggtgatgaataggcactctctctattatatatgtattatagttgtgcctttttcagctgtagataagagctatcttatgtaaatgtgattgctttgtaaatgtaaatgcctattgggtcatcgatcatcttggagatagaagaaacagaacaatagggggaggtgtgagagaaactgtctagggacagaaatgaagaaaattgctaagtgggtaacagattgaatcattagagctggagaactttgtggaggtggctaggatggaaacagcagccgcgaaactactggaagcctggcttgtgcctgcagagccctccaaaaggcttgcttccttgaggttctgaggactgactgctaaatgagaaatgggcctcttcagtgtaggtttgaagcaggaaggaactgaaaagaaaagcccaacttcattgttaggtgagcactgtgggtgcctgtcgtttgcctgcgcataacaggtttggaatctctcaaatccttcccactctcaacaacccacacaagttgtgagagtactacctaaaaacagccccttggtgtgccagtcatatgccaccccctggaggaggagggtactgaataatacctactgctgctgattcccatgccctagcagttctctcaattttttgggtggtatcaggaggcaggcaggcccagcagtgaactcaggaaccatcagggtgaaagtgcctctggaattttctcacaatctgttaggccctttttatggagtctggttttcaaaacctgctataagccaaatgtgtgactcacagagtaataaaggcctctaaatcaatttgtaagacatcttgaagttaaacaagaaggaaaggctgtttttgccccacatatttttttagatcctgcctacttccacaaaggatttgagatgacttccaaagcctttcttactcatgcctaagagtatttaagaactatttctgaaagttgaatccatgtgtaccatataaatagaggagaatgattatatggaaacacaaacagattggggctctctcactttatacaatagatcaactctggggaagtggttaaatgagggaagtatttggggcacttgctccagtcttcccttggttgtccttttacttccttctcccagcatctgcactctccaagtattgcctgcccttccaagcaaaacttccctgtcttgtattccatacctgcaaggaactttatttactttctaataaactctgctaataaatatgaaatagtgagtactagaggcttaatacatatgttagttgttctaatgttcaaaggaattcctacaatggtaggagagaaatttgaggccagaaataatgccattaagcatttatcccagctgggcatggtggctcacgcctgaactccaacactttgggaggccaaggtgggaggataatttgagaccaggagttcaagacaagcctgggcaacatagtgagacccctatctctaaaaaaaattgttttaaattagtcaggtgtggtgacatgtgcctgtagtcatagccacttgggaagctaagatgcaagaatcaggagtttgagtctgcagtgagctatggtcacaccactgcactccagcctgggcgatagagtgagacctcatctcttaaaacaaaacaaaaaagaagagagagagagagagagagagagagagagatccctcctatggatttaataatcatatcctgcattggggcaggggtgggttgaggtggaaaagggggtgtgaaagccatattatagagatgggcaccaagaccgagttttaaggaaagaaaaagaggccaagaaggatcactgaggaccccaaaggcaaacttggctgccttagaattttgctggggctgaggactctctggtttaaaaataaatatgaaagcaaagatattaaaggcaaagcacaaggatttacagagaaaatgagcagactgatttttagttgaaagatgtccacaatttatcactaagttattggtccaagctcatattccatcctatcactgttctcctgcacagtgacctccatactctaagcaaaccaaacttcctgagccgcacattgccaccccataccttggctcatactgttctctccagacacatttcctgctctacctctttgtccaaataggactgacttctcaagacttcattcctcctgatgttcaacagctgaagcagccataccttcctctgaacctccggaatgggttttctggacttctcttaggggacgctgttcatctggctttatcatgtatattcatgtccaagtcttctcttcccttcaaggctgcagacatcttggaaggagggcaagtcctctttatatctttactcctctcttcccatggactgagctggcccagaatcttgaaaaatagccaaccactgataaatgctttctagttaagagttcagactctggagtcaggaagttctggcagcaagcctcagcttgtgtttattacttcacctctctaagtcttggtttcctcatctgtaatcacctacttcggagttgtgttttttttttttttttagatagagtctcgctctgtcacccaggctggagtgcagtggcatgatctaggcttactgcaacctccgcctcctgggttcaagagattctcctgcctcagcctcccaagtagctgggattacaggtggccgccactgcgcccagctaatttttgtatttttagtagacacaaggtttcaccatattggccaggctggtctcgaactcctgacctcaggtgatccacctgcttcagcctctcaaaatactgggattacaggcgtgagccaccatgcccagcctggagttgtgatttttcaatgagataacccatgtagaatgcttagcatggtgcaagacacatggtatacattccacaattatttgttattgataccatttttcccttaaggaaaggtgcagtcttctctggctccctgtggcaataatccaactgagccattattccagaaggaaatcacattagggggcttttgggcaagggtttgctaaatgccctgactcacactatgtctacagtgacatttaccccatcaaaatgcagggaaagacaggaactggtttcaacttgaattcgatatttctgtggcccacatgctgaatgccaccaaagcctccactcccagagcagcagtttgtagagatggaatagtggcagtttttcattttccagagtccactcatccttccaagaatctcaatgcctcattgattcataatacagtgcataaagatttcatttttcctgcccacagtgatacattatggaggcaatctgttttgccactgaaaagtttgcttagtagaaaaatttggagttttgacattcaggaaattacagtcatctgtaaaacacgattgatatgccgaggctaacattttcattgcacttgcagagccagaataactatgataaaatatgtgttaccccacacacatttcaggatcttttagaaacattagctctgagaacctcctcccagggctccaggactagaatagctatccccattagttgtttgtttgccactcacaaggataatatctccattgacccaaccaagaatcagactgtaagacaaagtgatggctttcccgtaccaccaggttaaaggcatgaaagaaagtaaaaagatagagagataaagaattccaccccgttttggaattgttaaccagccacaaaaagcgcaggtataggttaggtagaactagaagctgaaggcttacaaaagagaaattagactgttctacatctgcctacaatttaaacttgttctctgtatttttacacccaaccttttttttttttttttttgtctctttccacatgcaattttcagtgttaaatgacatcaaaagcctagggctccggaactatccacttgttcaaaatttgatttcagaatgataaatacagttgttttagctgagagatgtagttgatttccactggcatactgagaaagtggtccattcagggtcagatttggccaggttgtgagcacttttcacttggtcctcatgcactgggacccacgggaagtgcacaaagtctgtggttccaaggcaaatgacaggtaccactgcttttgactttggaagtggcttagagtgaaccccattcagctctgggacagcttcttcaggcactgagaacacattctgcccaaagtgtgtaagtctgactcatgaatcaagcagtttttagaggtgtcattgaagtcctgcatgcaaccctatgcaaacaattattgccagtgcttactgaccttatattatgtgtcaaacacaattctaagtattaattcatttagttattacagccactctatgaggcaagtgatagaattatcatcttcactttatgaagaaactgaagcacagagtctgagcatctctcccaaagtcacactgctatctcataagaggtagagctggattcaaatcctcaacagaatggctgcagagctcatgctcatgatctatattatattgccttgcataaagaaattttataaaagccctctgttgtcagacatgctgcctggattatctcacaagtgccccatgcccatggtaggaaggctttcttgtcctcctaaaacacttggccaaacttcactctcctcctgtcccatggttaagcctcttgcatccaacaacttggcttcattcatttcctaccagtgtttgcacagatgctagaggagcaagaataaagccaatgggtatagggaggagaggagatggatgccaaagacacacttgggcaaagaccatgcctgcctaggagttttgggactctccagcaggggaataaggggaaaagtgatttcccagaggcatgttgaggattcacttgcttgtccccaggctgaagctttgggggtacccatattcagctttctctcctgctgctcacctctgggccttatttcagctgatctggccactgacaagggaaactaagagacagtggagcaaagaggactcatcagaatacaatgaggggacatagaggctggaggggtggagaagatagagggggagaaaggggagttatggcgtcaggacaggaaaaaaagatgaagagagaatggcaaaacaaccaggaggaggaggaagtcactgaaaaagaagaggggatgcacacagcatgaggtgggatgtggagaagactgagagaggaaggaaactgaggggaaaggctgatggagatgttctctctcctcacttctgtgatctcagtcctgtccatatgggcagtctgatatggtttggctgtgtccccactcaaatctcatcttgaattgtagctcccaaaatccccatacgtcgtgggagggacccagcagcaggtaattgaatcacaggggtgggttttccatgctgttcttgtgatagtgaataaatctcacaagatctgatggttttataaagggcagtccccctgcacacactgtcttgcctgctgccatggaaaacatgcctttgctcctcctttgccttccgccatgactgtgaggcctcctcagacatgtggaactgtgagtccattaaacctcttttctttataaattacccagtctcgggtatgtctttatcagcagcatgggaatggactaatacactctcctcaccaccagtagtcttccttgactgcctgctgggcaccactgaaaggctcttacgttgcacggtgttccaactagatggccttgctcttttccttctgtgagctccaggtacacttagagatgaggcctgtcttcttgtcctgaatttggacacatgacttttttttttttttttttttttaagagacagggtcttgctctgttattcagactagagtgcagagctgctatcatggctcactgcagcctcaacctcctgggctcaagtggtcctcccacttcagcgtcccaagtatcagggactacaggcacatgccaccacacctagcaggagggatatcttagaggtcatttagtccctcccccatgcaaatgaccaataagtcttcattgcttttgaccccgtactccttatctcctatcatcccctacgcacaggaggcagattcttaaaccaaaggaataaactttacattgtggattgctggccaactgtgttggggaggggctgtgcttcccagcactcctgaacttatgccaccccacaaggctggccctggttgcctgtcccattatggtgttgtagaaagctctccgctgtcatgcaaattaccttttaaaataaaatgaacaaagtggcatggggtagaaaaatgagtctggatatctagacttgggtttaaaacatatgtaacttgatgacttactggctgtgtgacctttcacctctctgtgcactaatatcagtgtctatgaaatggactggaactgtctatttctcagtcatggtgtaaggctctatgaagaagaagatgtgttttgttaaaaataaatatatatttgctataaagaactttttagaagtagaagagaaagagggtgctattcctttcaaaagatttggaataatagctctttaatccttgaaaatgaactgagaaatataaatacttatgattatttaaaaacctcaaaggtgacctgctcatcacctgaactgtgcttggtatgctgaaatgcagcaatgccagtctcccaaaaatgtacctgcccatatttcaactgtcagcacattctttccaccacgtagaaggtgaaggtcgacatgttctccctgcgtgcatttctagtaacaccttaactcatgaatgttaaatggaaggaggtgggataggggaacaacaggacttcaaaaatagccttggggaaatcaaatcttgctttaacttagtgtgttcatgaccgattcatggctctgaaaaggaaaaagtgtttgatcaaaactgtcaccaaaagacctcattttaaattcctctactttctttgagcagaaaggaataggtatcctgattatgactattgaagcaggctttacctgtgcataatagctggtctcctatattctgtgatttttggatggcctcctgccccatagaacttgccctactgctgcctgaaattctaccataagagggcatagcattgccccttaggggctgcccctttaaaatggaaatgcttctggtggtgctaagtacatgacactttgacaaaatgagtttttctaatgactttccttctaggtctcagattttgaacagactaagcccagagagagagtccagtgggggaaaggctggaagaagggggaggtgtaggaggaggaatggagaagcttggagggccgaggtctcccagctacaacaaaggaccaaagaaatagtaactaaggatgggatttcaggcctcagtggggtacatttggaggagaaggggcctcctttacccttacaagttgtattgtgggtgcagcagtctctcctgactggggaaatgccaacctggggacctgaggcactgcaccagccagaggtggagtcactttgggactcgtttcagggcctgtgtagtttaggggacaatgccctttgtttctgattggtgggaggaggaactgatgtgcagtgggatgggagaggataaaatggagcatcctgggtgatttcaaggcttcatgctagaaggctcatcaattaacccaccagtctgagttcccataaggtgctgggccctgtgttgagagacaggagagatatcaaatagtttggctcttaaggaatgtctagcctggtttgcaagacaaaataagagaaatggagtatgcagccatttatttgaggcttaatgtgcaacagagaaaacatgggggaaacactgaattgggagttaggaaacctgggttctggtcctagacccactgctgaccaactatatatccttgggaaagttgcctcctttgtttgaggttcagtttccttagctgcaaaatgggaattttatatcttgtcctgtatacttcataggattgagtgagaaactaactttataaaaacagtggaaaccttttcaaatttctcattgtgattaatcagccctccctccctcactcctatcttcccactttccctttttctgtccttccctccttccctccctcccccctttcttcctcccttccttccctctttctgtcctttctctctccctcgctccttcccatcttccttctttccttccttccttctctcaggcactgatatcaatgaattttcttcagatgacttttctgaaaaactattttgagaagggcaatgtcgtttagagtaattatctctggccttaaatccactttgcagtgagtcactatttctgagaattaagctcaattccagacaaaaaagcccaagccaggagggaaagctctgtaggtggctcacgcagcacgcaagcagatctctcttctcattgacatgtcctcacagtaaatgatgacttgaagaatctaagggaggttctgccctctagcatttgccttagttggaaagtcagggtcaggcatctgtcttaatgtgagcattgactttgagtccttttttatgggtttaaagtcttgcagtaaagaataagtgaacgtcaaccaaatagaggggttgcctttgcctaaagccgattcctgttcattggtcatcttaagggtgatattcaggaaagtgaacaaggagtcagagacttggttttgggtcccttctgtgccataaactggccaaatgaccctggatgagtccctatccttcacctctgggctttagcattctcattgctaaagtgattggagcaggtaacctctgagaggtctgccaaaccatctactctatgaaaaatatgagtttgtcactttcatctttcatttgtgagtggctctcattggttccattcacaggaaccttgcccttcatcggttggccagtttccacacatgggacatggctcttactcaacgagagagtaatccagagctcactgtatgcatggagggaggtgtggaacactctcaggctcccccttggttgaactgcccccaaccatgatgagtaaaatggcctcacccactttcagtgaagtaagatcccgttttgcacaagatgaggtttgtaaagtgcccctttaaaaaaaaaaagattctattctgtcaaaaattatggaatgttcatgctttcatcaaagtagagccatggcttatattttacaacacgcatagctgtctaatttcacatactgtttttctattctgtcacattttggacaaaaatgtcttttctctaggattcaggacattgcagtgtgatgtaaaattgcaatctggaggaatatactgtgcgtggagaagggatgatgagggcaactgccccgtgactccccaatactaggccactgatttcagggaaggtctcctttttgccttaaaggggaaacacagttgtccaaagtctctatgccatcaaaaagaaacctctgatgcacgaaacttatagaacgcttgtcagtttcagcattaacataaccttcaaaataattccttctgctcaatcaggatcttcatgtcttcagtcctccttcctgtacttgccccagtgtgacatcacattccttagctagagaggtgggatgggggatggatgagtttttttcaccacccagtattatcattgcaaagaaacaaggctgtgcctgttactgtatagaatgcttatttccccacacatgtagcccagccatgttattcagtaattatgccttttgcagcttgaatatctgaaggaaaaactttcccaggtgaaaggaggcatgaccctgccagcccttgaaattctgaatggcttcaattctttacagttcaaatggttaaaaagttctgttcccccacacccccccagaaaaagccagggtttgcacttcatatctctcagcaccttgaagcaatattagagctcattaaaatcaacccagggctcaagaagggaagccttcatttagggggaaaacttttcccctgtgctgctctggaaaatagcacaatgctgagagcaggcatttttcctgactaggtttcctctaacgatttctccaaagcacagttagggtacctgcctcccagacagcacatgtccagcaggcccaggtgaatgcgtgggactggctatcactagctcaaaattgccttaatatttattgacggcctaccatgtgaaaaaggcctcttacttgatttcttgtctctgtggaggtccctaaagaaatgattctgtgtgtctctggatttctcacaatctagagacatggaaagggagctggctatctggttcgggatccgtagaatacgaagtatggtctaaaatggtgtccagctatacccctgcccccaggcccctcagctctaaaatgctcagatcccagccctgcggttctgtaaggggcccacaaaaaccacagaattggatccctcatttcacatcccagcatatccaactgcctcctactcaaatgtcctgctgcattcaggccagttgtgctcctggcctgtgactcctgaggctgtgctcaggcacaaatgagaatgaacagcccagtgggtgagagcacacacattggaggctcagacacatctgtcagtgaggacacaaagaccaaatataaagaccagattttatcttcataaagactctatggttttcatgcattgtaaatgagaaaagtagaagcacagagaggttatttgcccaagatgacacagctagtaactgccagaactggaatttgaacacaggcagtctggctgtagatcagcattgtcaaatagaaatacaatgcaatggatgcacctggaggcgataaacgtaagcgaattaatgcaggaacagaaaaccaaatattgctgggtgtggtggctcatgcctgtaatcccaacactttgggaggtcgaggcgggcagatcacttgagatggtcaggagtttgagaccagcctggccaacatggtgaaacctcatctccactaaaaatacaaaaatcagctgggcattgtggtgcatgcctgtaatcccagctactcgggaggctaaggcaggagaatcacttaaacctgggaggtggaagttgcagtgagctgagatcgcaccacttcactccagcctaggagacagagcgagactgcatctccaaaaacaaacaaacaaaaacaaaaatccaagtatttcatgttctcgcttataagtgggagctaaacattgagcacacatgaacacaaacagggaaacaatagacaccatggactacttggttgggtgaggaaggggttgtgggttgaaaaactaccaattgggaactgtgctcaccacctgagtgatgggatccataccctaaacctcagcatcgtgcaatatatccatataacaagcctgcacatgtacccctgtatttgaaataaaagttgaaattcaaaaaaagaaatgtgatgcaagtcacctatgtaattttaaattttatagtatccacattaaaaatggggatacagatgaaattaattttaataatacattttatttaacccaatatatccacattattatttcaacatataatcagtataaataataattaattcatgagatattttctctacctctaagtcttggaaatcttagtatgcttgaaaacttaaatcacttcttagttcagactagccacatttcaagagctcagtagtcacatgttgctgatggctaccatattggacagtgcagctctagaacaagcccttttcatgatatacactgtgactaaaatgaaggcattaacacctatttgataggttttctgaaaaagcttctagcctagtgtctgacatactgtaggcacctgttaaatcaaaacatctattagtttcctgtgtgttttgctctttgctgatgtcagaatgccgtccacccaccccaccaccatacacgcacctagtcaaatcctttttgtccttcagaatccatcatattcctcctcttctatgaagccttccttgatgaccataatacagtcaactctcttctccccactcatttctcacttaatctctgtatgacacaattagcactgaaatatactgtgcctctatctgcccccgccccctccaattctaagcccgttgaaagctggcacccgtatacatgcaacttcctcaccatgcctacagctctaattatggcgacttctaggtcagagttgatacgttgttcatggattgattaaacttctgtcttgcaacccaaggccaagcccctcacctccagggctaaaagggcactatgtaccctctttgcacatgcctgtttctggattgagtttcatgaaagtaccagttttattactttttagttaagacctgaaacatgcagggttttatgtggatgtactaatcaatcaaaaggcaggaccaaagcaatggattcctgggacaagaggcactagggatgtttatctgaagagcaaaccatgatagtcccagtggggacacttagaaatttccccaacctcctcccatccactgtggcatggagcttatgattcttcccctctgtgcactcttgtttcagggttgggagaaggaagagaaccaacccctagctctggcagttccagatgccaatcctcaagggatggcaatttgacagaagatgtcacatagaaacactcagtaagctgagaagttccatatgtggagggaggagttcctagaaggaaagtcaggcaggaagcttgagtgtgttaatcagtggcagatctggtctccatgtgacttgggcagatcatatcccttcatgggaccccagtcccctaatctgcatgctgtagggtattttcataaaagtttcttccacctcaagaatacactgactattaatgaaccaagactcacaaaataattttagaatgcaaaaaattgggagaaaggcagtgtaatctacaaaatttttcatgatgtcaagcaattggatggattctgggtaaaggcctgcaactatgggtcataaagtttggaatttcacatcttgttaaagaactcagctttttcactatttgcaaaagcccttagagttatgtactttgaaacctactgggctttgggaaaaaggagagtgatttcttttaaaaagaagtaaatatcaccaggactcattgtgtgaagaattccaccttgagtttgaattcaaaggcattagaaatcttctttattttcaacaaaggaaaaaaatttctgctttgttaaagaaaaagaatcgcatagaaaaacatccttctgtttaatgaaagcccatttgtgctcctttgagcactccccacaatacacacagatgggtttacttttagttaatcagaggaaaagaatcaatgaatgaaggtgttactttatatacacagaactggtcctttgggtgaggtatgaagaagagcagaaaactccttcaaggagaactaatagcatgtttggtgggtgcaagaccttcagcctcttcagatttggttttgtgtctggtagatcttttgtctaataagtcttgcttgtctcatggatcactgtgctcccaagagttcaccttgctccccacctcctgtgggtagcccagaaagtctggctaagtcagcagcccacagcatgaacttcaaggggaaaggaagaggttcagcatccagatcatttaggtctttctagtgttgtgaagacaattaaatgaagtcatgtgtcacactgctctatgtaacccactgtctgcaaatgcaacagctcactcttctcactaggtaaagcatgactactaagccataaaacttgtgacaaatgtgccaaaaacaacacatctacaggcacgtctgtctgcttcaaagtagtccccttgtgaagtcccacacttcttttatgagactgctgccactgctgataacagcatttattaaactcctgtttggggactactaatatgagctacacaagaaaagcacttaaaacagcacctccagggcttaaggggtccagctccatcagaagcatgtttgcctttgattcaatttaccatacttttatttagtttgtgctcacatattaatattgtttgatttgaacgccttcctccttgctttgacccagtcatttacatgcaatgggaggatccatgtggttgctttagacttcattagccaaggaaggagaccagaccttcaacattaatgactcagtgtcatatacaaccaccccaactattggcagagttacttaggaccaccaaccacagttctttttctaccactcattgtttctccaagaacaagatgtgcaaaggctgaacttttatatatatatataaaatattttatatatattatatataaaatattatatataatatatatataaaatattatatataatattatatataaaatattatatatatattatatataatatattatatatatattatatataaaatattatatataatattatatatataaaataatatataatattatatatataaaatattatatatataaatatataatattttatatatatattttttatatatatatagcacatatatatgctacaggtataatagaatgttcactcctattgatttgggataagaatttgtttcctttcttaaattaactttttattgatcactcctatgaccttaactgctacgggttttctggccttcttctattaaaaaatgtctttgatatttatttcccctttgagtagtgcagggaaaaccttatcatggcctttcgtgaaccagtagcctcaaaggaaagtaaatgtttacagcatgatcctcagaactttgctcaagtaacattccctggactttcccttgatggaaatgggtgcccccagggtttctccaaggggtagagagaagatagggcttgcatccgggggcacagttggcttgtctacactctagataccacctgggatttctgagagacttctgatctctgaagccacatgcctaggacagtgattctcaaactcaactgtgtgtatatcagaatttctggatgggcttcccaaaatgcagattggcaagccccagcctctgagtttcagattcagtgagtggacctgagagtgtgcatttctaacaagttcctaaatgatgctgatgctgatggttctgggctcacactttaggaaccacttttttagttaactcatagaattagaagtcctgggcttgtgccctagcaccaggatggaaagaataccatttctagagtgagagagacctggattgaagcctgaacacacctacttaacttgaggcgtgacccagagtcacatcatctctgagtctcagtttcttcattctggaaaagggaataataatatatgattcacaggattgttgggagttaacgtataagtgtcaggcacagagcacccccagttcctggctatgtagttggtgtaagaaagtgtcctctttgagcagccaaatgtttacccttcatgggggttagtgagttctttcaggcctggttgagtgtgccatcctaggtaactagcagacacaaagagggtctgctaaaataacaggacttcggcccagaaatagttctctcaggtagattgattctcaagggctactggcaaggtgtgatttggggacaagtccttgcctgtctctctctgggcctcagtatccccacctttaaagtgaagggtttgacctaaatgatttactgtctcaaaggtttcctcctgttctgacgagtgtaggactctgtgacttagaacttgggcacttatttcagaatggtctattaaaaggagaataaaaaataagattcttgtttttaaccatttagttatttttaacgtccttaaactttccagccttcttttaaactgggatactgcacaaaaagtcagggacaacagctaaatataacaatgtccttcacagctacatctccttaaaatgctccattacaggtataaaatggtatatctgttatttcatagtgacatctagtggcttttccttatcaaagaataagatacgcattttcctatttgctcatcataagctctgctgcttctcctgcagaaattcattcaacaatcttttattaattgcttactttatgtcaaacattgtgctaggccctgaggatagatacatggttcttaccctcccagagctcatagtccagcggaagaggcagaaaaatcgcttgacaatcccagcacattgtgatacatgttacaatgggagaacaccagggcgtctggagcagagaagggggtgcttaactccatccagggaggtcaaggaaggtttcgcggaggagacagtctttgagttgagttttgaaagactttgccaggtaacctacaaaggataaatagaagccattcaaaagagtgggcactccatatacagaggcaaagcacctgtggagtcactgcctgggactttgatttggaaaattcagcatatagggtatagagcaaggttcctcaaccttggcattattggcatctgaggcagggtatttctttgttgtagggggactgtgcatgataggatatttagcaacatccctggacttgacttactagatgccagtaccaaccccctccccaagtcattacaaccaaaatatccccagatattgccaagtggcccagagttgggggtttggggagtggagatggaagatcactcacaattgagaaagacttgtatagagggagctcacttgagaaggctggacagaaagaaaggtggttgctggattccacaaggctgtctgtagcatgtggaggagcttggcttcatgtcatagttgatagggagccattgggagggcttaattagggaatgacaggtcaggtatgtgccatctgggggtgtggaagtggcatgggactggagacctgaagagtaggacgggatgctactgcaatgttttagtagagaagtgatgaaggcctgaccccaggcagtggtgcaaaggatggatttcagagctattagaaactggaaaggacttaagcgaatgtttagctcttagtagtgaggggagattagaggagtcaaggatggccctttggtttcttgcttggacaactctttcatttgttgctattatttcgacaattgcttatcagtgacaggaaaaagttggcctaaacttgtagacacaaagcaggttcactgtgcattgtttataaacttctatgggtttggtgagacagaacacactcataagcaacaagttacatgaagtgggtttattacttacagataggcagcaagggacaaaagaagcctaggatccactgtgagatggtttcccaagactcaagaaagctgcctgggtgaatgagtctcgattaagcatgcctcacttgcaccatagctgagagaccccaaaaggcagcctttcctgagttatatacctcaggggccatgtgactcatttagcaaagctttgaaggacatcctgcttctgagagaaaggaacaaaggctgggctgtcccaggcagttcctccctatctcaagatgttagattctccaggaaggactggaacaaggcttttgctgtttcaggcagttcctccctatctcaggatactgcactcccagcacattctacagttattcttaagaatgacaagcaagaatgaggggagtattgtgttggtccaaggccacccagagaactgtcattcagtagaaggtggtaaacctttaactgtgtagtgcctgtaaagtcaccatgggcatacagaagcaccaatcagccattcaattaacccatgtaacccaatggggagtcatggctccaatttaaaaatgtgacaccttgtcattttaattaggtgatacatttggtcacaagaaagtcctgtccaattactactaagtgaaacaggtggcgtatgattttcctggggctgaactggcctcattcagttaaaattcagtcagtccattcagcggcacccttcagtttcatgtcaacctgaagaaagatttccagcaactatcagagacttgctctcacctgcatcttgctctgttttgatcaatgcctgaatccaggcattgccaacaggaacaggaaagtatggtgaagatattgggggatataatcagaatgtagatgtcttttgacaggcttagatttcctccatcaagaagagattaaacagggccacaaatacactgcatcagttcctgacaatatagattgcgttccagcgtggcatatatgtgaaagtatgaaacaattgagcttactgtgtatcagtggtgtggtgtggccgccaaaatggtccatgtgatctgaggccacattaagagaaatggtgtcaagaatgaggaaggtgataggctgtcccttcttgttgcttgtcagatcgtgcttagcaggccatgttccaataaagtggaatgcacttgcaggcagacaacaggatagcggggccttgaagctatatagagaatagttgaaaaccatttttagcataaagaagagaagccctggggtaaatgctgtcttcgaatatctgaagccacacaagtggaattttaaaaaggtccctaaatagaccatgatggtctggaaattaccactttgtgctgaccactccgtaccttatcttcagcccaggttgctctctgagtgccagatctgttcattcaactctactcagatgtcccgcaggcacctcagtccttcctccagagctctaggaggcatccttaagtcctcctcctctttctcccccgaatcccttttgtcacttttacccgctaaatatttctctagtctgctcctccttctcttttgccttgtcttctgcagtggcctcttaactaacttcacgaatttcatcttcatatacataatgatctttctaaaacacagacctcatcatgtcattcccctgcttaaagcccttcaaagcctctctgttgcctgcagaattaactttgaatgctttaatatggcatctgtggcctttcacaaccaggtcctgggctccctctccatcttcaattcctgccactactccttcactccccgggaggttttttgatgcacgtttctcttgcacaataggctggtttatgcctctgtgcctctgctcatgctgatccttctgtctcatactcctttcctctctccttgactcatttttttttttttttttttgagatggagtctcacactctgtcacccaggctggagtgcagtggtgataccatggtgcactgcagcttctacctcctaggctcaagtgatcctctcgcctcagcctccctagtagctgagactacaggtgtgcaccaccacgcccactaatttttctattttttgcagagacagggtttcaccatgttgttcaggctggtcttgaactattgggttcaagtgatctgcccaccttggcctcccaaagtgctggaattacaggtgtgagccaccgtgcccagttgcctcatctaattcttgtttttcaaaataaagctgcagaaacccttgtcttatctttaggctaggttagaaatcagtgtgaggtgtttttttttaatcataccctgcacttgctccaagcattcatggcacacacaattgaaacactttccccgggtttccatgtcttatccctgtctgtatccccagtgcctgccatagtgccaggcacacattaggtgccaagactaagcaagtcttgacctgacctgaccactgagggaaaactggccatgtctctgtttgcccccgaccccagctgcattccccagcgtgcttctctgatattgccctaaaagctcttccttggatataatgagcatcctggattctttttctgacataacctccaaggtgttatctttacctgccttcctacttccaacacaccatgaaattcaggagacccctggaccctggacacctacccttcagcagatctttctttctttctacacatggaatatttctaagcagcatcaagtgctttcagttgaggcattctgggtccccaaggctatttgccctggaagaagggggctgttgacactcactgaatctctgcaggttttgtcatatgagtctaggtggctgttatcaccaaggcagcagtgtgtgtatgtgtgtgcccctctaacttctctgctgcagtgaaaatccctacagtgtagacactgaggctgcctacgttgggctgtccgtatttcttaagggcactaggtgaccttcaagttgaatgcatactggatccacacacccacaacatgagagaccctctctgaaagtctgtctctgtgttgccttctctctatccatgttggggtaggggtggtgcttatgaaacattgattgtgtcattaaccctggtggttgggatgtatttgctctgaaaggctaggaacaatgtttaggaaggagagctgcagacttccactgtggtgcactcttaatatttaccagaagatgtcactgtaggcttaaaccaatacaagaagttagggcaagaagacttccagctaagcatgaaggtgactccattttggggggttagaacaccgagcagcccccattacaatgcatgcctggaaaagctggttgaaaggttaatccaaatgtgtcacagaccttaataaatttctttttttttttttccaaataatcagactaattgccactaaactgttgcctcagggctagcataaaggctcaataagtatgcactgaatggatgagtactaaagctaggagtggaaggagggaacccagggctttagtagtcatctttgttggtaaaggctactggagaacaaaagctgctactctttagcagtggcttctcatagagatgaattttagtggcaccaacaagatcaggtcctagggaaagtagtgagacaagtgaaagtgctcttggccccttttccatcctcactcccagatgcttctcctgtgcccaatgcttgtttcttcctgaaaaaatatataaagtgatttattttaagaaaaaccttcctgtgattttttgcaaggcacttagaagattatccagagtttttatgtcatgaggcatgtccctagctctctccttcctcttccccaggatagttcatcaagtaagcagttaaagaagttactgagattctgctttatgccagggatgaaggccaatgtacaaagctggaatggatgggatgagggctatatagaagaataggacagagcccctgtccttgaaaacatagtttaagtggaaatataaacaattaattgtaattcagtatcacacatttttgggggaggcagtggggtggaggggtagggtctcactctattgctcaggctgaaatgcagtggcacaaccacagctcactgcaacctccgtctcctgggttcaagtgattctcgtgcctcagcctcctgagtagctaggattacgggagcgcacaaccacacctggctaatttttgtatttttaacagatggggtttcaccgtgttgtccaggctggtctcaaactccttacctcaagcaacccacccacctcagcctcccaaactgctgggattacaggcatgagccaccgtgcccagccccagtatcacaaatattttaacaaaggctaagtatagaagtgctatggcaacacagaggaagaaatgataactggcaacacagagtggggtacattttttcacaaaagagatggtacttgaactggtattgaaggatgagtagaattttccagccaaagagggaagatcatggcaggcagagcaagcaccatgtacaggatagaggcataggagatagatttcaggatgcctgaggtgatggaagccccagttgggagaaacgtttcctcaatgaacatcagccaatattcagttaagcaggtggctgagcaggttccctgtggctcctcatgtatgtgtagagaacaaccactccctcagatgggaatgaatatttcagaaaagttgcaagccattctccgggtttcctttaagaagctaaatgctaatattcaatgtttattgttgctttctttccacaatatgcccttctgtggcctcgtccttcatcttctgtacctgagtggtaacccatttctcatgaaaagcacaatgacacggttctctccttaagtatgcctgattgtatcatggacttgatgtttctggggcgtgtgcctaccatgtatggtgtgagtgtgttaacatgtggtttaaatgtttgctagtctgctatttgagcaaagaactttgtttgaagccctaaagagaagacagccatacagcaaagcctccacacttgctgacatccacgtgcccttttagtagataaggaaaagggacattttgaagctgctgatagagttaagtttcctatcctgggaatattatcataggagcaaaggtggaaaccaaggtagtagcttgcatacatgccattggcagctaccatgtctatttcagtcagtgactaaccacagcgtttattgctggaggccctgggctactctgcctatctctacattccacttccataatgtatgagccataatatgacaacagccagaatcaagagtatcatatcatacactcttttaatgagttttttaaaaacaaaaagatatgcagattagactggatattagaaaaaatgctattgcatatttaataagattcgaatttgaacccacttgtcaactccatttcactccaataaagtatgtgcttccaatgagtctccatttcatgatcactaaatggtttagagtggggggcatgaaataaagtggttgcctagttagccaatggtgtcattgggaagattttgtctttggttagagagggagaaaaagaggggaagggggaacgaacgggagtgaagcatgacaaggtcaatgtctggaatctaaccttttcatacctgttttagctgaagtatcagcaaattggttgaaaaaattagctatctctaggctagtgagactcagagaggggactgcagtacagtttacaggacaaatgccatcagatccctgtcatttttgctttgccttcctttttagccagtgaacaccacatatgccatgtacctccatgactccacttatttcgcccatatctctgactgttggtttttgtgcttcatccataggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaatta

SEQ ID NO: 5043 - DNA, 328428 bp, human
atgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcgggacccgggcctaggcgggcggagggctgggaggcgcggctggcccaagccggggacctagcgcgcaccctgacgcccgggcgtttgcaccccggctgggcaggtgctgggcgcccagtagcgcacgttcgccgcgctgtggcggccacagaaaggctttccgctccggccccggactgaccgtctgtctgtccgcagggtggcctgcgtgatggttggcagagcgtgcgggggaggcggccgagcggccggaacggggccgctgggacggggcatcgtactcagtctccgcactggagagccctaaagagccgcgctctccgtgcagcgtctctggatccctgctttcttctactctgcacccgggttccgaagtctcctttcagcgctctcttcctcctttcggcgcccgcattcttccctccccccgctttcccccctatttcgtctatttgccttgttctccctctttctctcttgtgtcctagatgttgtctgctcctgtttgctcgctgtttccttctttccattcccctctctcgcttttattctttttctctcttaccctttctgtttttctcttcttgccggacttttatcacctcgctccttccccgctctggctctggtcttcccgggcgactgggtgtccctctgtcgctattttccgacatccaaggagagctcatggttcccaggcttgcttatcactactggctgcatgagaggcatccgtggctctttgggagtggcggggggcaccccgcggaccgaagggcgggctgggatggtgccctggaccccatgtggggttcagtcaccaggagcctctcctgatttacaaaaaatatttaaaaagcttgagccccagcatggggcgctgccagcccatgttctgtgagcctgggctgatgcggtaaaagctgatttattaatagtctgtagccagaagcaagggtattttcctccctccagacgcgatgtccagttgctagaggtcatgcagtactgtaaagtgggtggtggtggggtgggggaagtgagtgctatggggtgcagttagtccagccagggctactgtttcgcaagtctccttaaaacaaatctgggctgaagcagggagtccagggggtgcacaaggtgagtttcatggcctggaggcctctggatggggtctctgggccggcaaggacatgtctgtgtcccatccccatcccccgggtgcacttggtaccctggacaaggggatgctttgcaggtgactgttagaacgcaacaaccagtgtggatttttctgtccaactgcagcaaatagagccctagagccctctgactttcagattaccattgagatttaaggggaacatcaccccctggctctcctcttcactctctcttctctcagtttacactgtcctttctcaaatgctggaattgtgtcagaatctgccaaacttgtatttcctttccaatactaacaaattttttcttccaccccaagaaaaccttagccccaggacctcaatccattggtacaattgtgtaagtcattgtcacaacaatattctggtgtttaataagttcccaaacaatttggcaatattgaaaagaatttctcatactgacagaccttgtaggtgtattgagaggtggtaatatttaaaaagctcttctgggcaaaagtagaattccacagccatgactatagcagagaagtgaaaacaaggtcttggtcaccatgaaagccatggccttgtctggagttccatggggcacatgtgcctttactgatccttttgaacatgtaggtcagagtatgatgtctataaacacacattattaatgtggtctagattatctgtttggtggctactgtcctctggcagattccttcccgcattctccagaagataaccagaacccctcaaagcctcttggattgtcccaaattgaagcaaaattatttgaaatgacataggattttcttggttattaaaagggtgatactacagtagcatctagtctaatcaaagagcaaccatgttctaaaaagtcacagttactggattttacggtgtttgcaaaaatgaaataaaacttgctagagaaatgcattgctacctcaagggcacctttttatttcattcattcctgcccacctccagaaatattcactttgaagaatagggatagcctaggggttccagaatttctctggatgttgacagatcccctaggaggttgcaggaccagttctgtgagttctgataatctgtaagagctaaggtgtgcatgtgtgtgtgagaatgagagagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctttaaaaaaaatcagaaattggatttcatccatctgtctgccagtatgttgtttgcagtcactcagggtcctgctcattttagaatttctgagaccatttttgaaagtgtatccaaacattgttgctcacaagctgttaaaagtcccaaattctgcaggcttttcttaggccaaatttcctctgtttgtagccaactctagtgtgccatttgttctgtagagggaattcagaactgggcccaaagaaatagcactagcccccttcttcatcactaagtatcatgctggccagcatgcacagaatggggttgagaggtcagggtccatggctatacaagtcaaagaatctgatcatattcatgttgtaccctagacttttagcatctctaaaattttcagtttggatgagtgattgggccgggggtaccacacccattgggagaagaacagatttctacatccctgaggtgttttattcaccaggggtaggtcttgtggctagattgcagaggggcctttcattgccatattgggaatccctgcaaagctgagcaggatgggagcaggctgaggcatctggaagagtaattaattatcatctcaaatccagtagcatatcattgatgggaaaggactaaaaagtgtttgtttagatggagaaaagctttttttggtcattctatttttttttaattgtgggaaaagctttcttttattcccatttgtttttaaaaggtggctctattttgaaagagctgtaactatagagtgtgtgtacctgatcatgcctcacaagcccacgctttccctctttcttctccttgattttgcagtgaggcaaaatgacacaacaggcttgtgatataggctgaggcattaagcagaatggactgttacagccagtggtcagtactggtcgtgtggttcatcaggctctaagctgttgggctcagttttacttagctgaggatacatttcttcagctgtctttgagagctgtggtaccatcttagctatttcatagaagagggggagaaatctaccattacaatatctgtagaattccagtagtattaattagcatctttgcatggatgtcgaacatggtgttggagtccttacaaagctgtaagttctcaggtagtacaaaaggctattcagaattaacatcacttaataataattttagatcagtgctatggggcaattaaaatgctagagcttgtctttcatggatatcagtcatcaactgaggtagtatgtaatgacattaaaagaatagccatccgtttttttctgtcattcattaagcaagattttgtgaaactgttcattatattccagggaagagacatcattctctgtctcacagagcttatggtagaacagaacaatttagtactttagatatttaattaaaaaatggattttgtttgaaaacaatttgaaaatcaataatgtctttaaaatgtcatacatttaccagaatatacaaaaaatagacaaaagtccatctgttatgttgtagtttgggtctaatcggcaaagcagatggagtaactattatgtctctggcatggtgctagcagttgtggggagattagagccaagaagaaaccaaaaaagccaagataaccatcttcagcctcaagtccataaagattagcatgtgaagtgcaggactatgtcatgtagacaggtgctgggagaggaaatttagattttggacaggcccttttccttcccttggtctcagtgtcttatctataaaattggagatttaaatgacatgctttccagggccctttcctttctaaagtatgaggaacaggccagaaaaaggagacatccttttgagaaggcctctgggagtaggagagttgtattaagaagaaaggaggcattgtgggtgggcacggagtcctcatgaccttttgaggtccagcaacctcacctaggcaggtctggccagacccgaaaggttcatgcttggagtaataatggttagggaagtagatggggttaggctccactgtggaggacttgaatggcaatgaggaaccccagtaagtatgagaagctcttggatggaaagagtgcaaaaacaccatgaaagtaaataaaggtcggagtctaggtaaagctatctccctgatatctagtctggaatgtaggtggtaccagccaccaaaacagagaggttgagaaggggatctggttcgggctggagagtactaagaagtcatgactggttcctgttgcctagatttctagtggacaggacttataaggaggtgacaactggggctctggggcaggttagggctccatcgtacattatatgtgggaatctgtggacccagttaatctgaattcacaattggcgttgttatttaagtgatagctgcaattcacatatgggactcttagccaaggaaaaggatgtttgaataaaggaaaaaagatcaatagttatgattacataagaataagatatgcttatctgtcaaaaaaaagccaaaacgaaaaggtttcaaactggtaataatatgcacaattacaacagacacaaagttgaaatctttactgtacaaagaactctcacgagctgattagagaatcaaaggacatgaccagacaatttacaacataggacccccaactagtttgcagacatggaaaaactgttttatttcactggtactaaagaaatgcacatttaaacatagaatactttttttgcctctctaaccctgattaaaacaaacaaacaaacaaagcaaaacccaacatatatcaccaccaaacaaaaaaagtagacagtgctgacaagggcatggtaaatatcaaaattctcatacattgtcagtgggaatgtaacttgaatgatctttttggaaataaatagtgtaaacacagaatataaaaatatttatttctatgacccataatttcttttctgggattttgcagaaaaacatacttttatacatgctttcattcattcactcatttatttattgattcagcaaatatttattgagtatctggtatccctgtgctatgtgctggggttaccgggaagaaccaggtagatgtggtccctgccttcgtaggagtgggaaagatagacagaaaacaaattatcaattacttaaaattatatgaagtgccatgggggaaaagtacaggatgctatgagaacacatactaggagactaactggagttatcataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagagaaaaagagatagaaaattatggacccagtacgactacaattatattaaagaaaaaaagatagcgagcgagcgagcgagagaaatcatctcctacccctcccaaatctaagcataaaagacagagactggaagaaaaaaataatagaatataaatagatctattagtgatttattttcttattctgcttttctgaaggttttgagttttctttgagtctacattacttatataataacaataagcattaacaatttttaaaataatgttttactaagctgtgattaattgcacacaggtctacttttttggttcctggctggttatttcattagcctcttgatatcctgggagcctttaatgaggagagtagcctcagccctaataaaccctcaccctgaaaggcagaggtgatgagtcagacattggctgctgattttcgataactgacttttatcatattcccacacaatgcatggaactctttttataccagtatggtatagagctacttgagtgaattgctattgtttctttctcatttataaattataaattttaatttataaattatatggaacaggaagttaatagtggtacacagttggaaatataaagcttattctgctcagccagagccatccgagatagtctggactttggatctccatgagcttctttcttagtgagttgacaccagggctgatggtctggctggaagagttaaaatcttggggttggtaaagggctatagttctaaacatccataactgggagcttagatcagttagtgtatgtgttgctctcgtccagcagaaaaggagagttcactttgctaagcagcgccccctagagaagtttcactgcataagagtattacccccagttaaccataaataaagttgattagaaatgtcattgtccaactattccaatatctgagggaccactctatgcacatatagtgaggtgcataatcttattgttgaaactccactgaaactacaccgtaggtacaagttgttttgacagtgtaaagaatgtccctcacagttgaaaagctaatattaacattctgtgacacatgaaatgaggtatttagtcactgagtttaaaaagagatgtatggatgggaatttccccctttccattaaaggataatgaataatccacttaatggcgtatgtcctctaaaacagtgtccttgtaagcttagataaatatttgtctaaactttagtaaaatatttattggcaaaagagcttttctcatttactaggtattgaactttgcagattattcagttggtcttattgcatcccatttgttatttctgccattttgcctctaaaaactgtgctgaagactttgacacatttcagagcattacactaaataaatctgtcttgcacattccactgtgctttttctggaatattataaatattcaaatataggcacacacgccgattcaaaatacaatttaatacatgcaaattgtgcataaattccatatttataacttggcaatagtttcgaacttgttatcctatgatataaatgtatcaaataggagctcatgggaattatcaataaatgtatttttctgattaaactgtgggctctttttcagtcacaatttaagcttcaattctgagttatattataagagaataatttgcacttcatttactctgaattgtcaagaatcttgttcttccccaatgtaagtgtctgcaaagaggacttcttattcagtttgattgctttttaaattttactagtggagatgccctagtgagtctgagagaattggtctgtttcttatgaagagtttagttctaatgagttgcttccatgcactgttctgtgcgaatacagagcaattgaaatgtgcggtgtattgatttacctcaaatggattaggcctgtgtgcaccattccttgcattaattgactttctcccataactgtactaataactgcaaatcttcagtatagtattagcttcaatttactcataaagatccttgggtttttgctaacttactacaggagagtcaatgcaagcaagagtatttagaaattgactagggggaccaagttacatcatacaacccagaaatacttttaaagggctctttgatcatggcagccaactcttcagttattacaataaataggagttgactaaactcaccagttaagacctagattatcacaatggatgaaaataaaaaatccagctatatgctgtgtataagagacaaaggtaaaacataagaacataaagcacacaaaaaggattggaataggtacactatgcaaacactagccagaagtaaactgatgtggctatgttgatatcagacaaaacagactttaaggtagaaccattattgggcataaacagatcactgtgtaatgattaacagttcagtttttttttcagataacaattctaaacttgcatatgcttaataccataagtttgaaacgtataaagcaaaagttggcagagctaaaagcagaaattataaaatctgattttttttcagaaattgataggtaaaatgaacaaaaaatgaataaggatacagaggatttgaacaacatgattaacaaactcaatataatgggtatatatatatacacacacacatatacatatacatctaaaatacacacatacacacacatacacgcacacacacacacatatatatatataaaatctgcacccaattggaagaatacacacacaagtgcatatgaaacacttttgaaaatagaccatatactgagccctaaaattactcttgaaaaacttcagtgaatgaattatcttgtagaccatactatctgatcatatgcagtgcttagacattgggtgttgtgttaaacctgagtgcgtgtgaaggaacgttagtagtttgctatatttgtaagtattaccaatccttcaccgaccacataacatttcttaattgacatacaaaagtgaagaactccaagacttaggtagtttgacccaggtaacttggccttattttccaagaagatctattactattttggggtacctattgagacaggtcctgtgcaaggagcatattatatattttctcatttaattctcacgacaaccctctgaggtagattttttaatatatactttaagttctagggtacatgtgcacaacgtgcaggtttattacatatgtatacatgtgccatgttggtgtgctgcacccattaactcatcatttacattaggtacatctcctaatgctatccctcccgcctcccctcaccccatgacaggccccagtgtgtgatgttccccaccctgtgtccaagtgttgtcattgttcaattcccacctatgaatgagaacatgcggtgtttggttttctgtccttgggatagtttgctgagaatgatggtttccagcttcatccatgttcctacaaaggacatgaactcatcctttttatggctgcatagtattccatggcatatatgtgccaaattttcttagtccagtctatcaatgatggacatttgggttggttccaagactttgctattgtgaatagtgtcacaataaatgtgtgcatgtgtctttatagcagcatgatttataatcctttgggtatatacccagtaatgggatggctgggtcaaacggtatttctagttctagatccttgaggaatcaccacactgtcttccacaatggttgaactagtttacagacccaccaacagtgtaaaagtgttcctatttctccacatcctctccaacacctgttgtttcctgaaattttaatgatcgccattctaactggtgtgagatggtatctcattgtggttttgatttgcatttctctgaaggccagtgacgatgagcattttttcatttcttttttaattattacactttaagtgctagggtacatgtgcacaacgtgcaggtttgttacatatgtatacatgtgccatgttggtgtgctgcacccattaactcatcatttacattaggtatatctcctaatgctatccctcccccctccccccaccccacaacaatccccagtgtgtgatgccccccttcctgtgtccaagtgttcttgttgttcaattaccacctatgagtgatgtgatgtttggttttttgtccttgggatactttgctgagaatgatggtttccagcttcatccatgtccctgcaaaggacatgaactcatcattttttatggctgcatagtattccatggtgtatatgtgccacattttcttaatccagtctgtcatcattggacatttgggttggttccaggtctttgctattgtgactaatgccgcaataaatatatgtgtgcatgtgtctttatggcagcatgatttataatcctttgggtatatacccagtaatgggatggctgcgtcaaatggtatttctagttctagatccctgaggaatcgccacactgacttccacaatggttgaaccagtttacagtcccagcaacagtgtaaaagtgttcctgtttctccacatcctctccagcacctgttgtttcttgactttttaatgatcgccattctaactggtgtgagatggtatctcattgtggttttgatttgcatttctctgatggccagtgatgatgagcattttttcatgtgtcttttggctgcataaatgtcttcttttaagaagtgcctgttcatatcctttgcccacttgttgatgggtttgtttgtttttttcttgtaaatctgtttgagttctttgtagattctggatattagccctttgtcagatggctagattgcaaaaattttcccccattctgtaggttgcctgttcactctgatggtagtttcttttgctgtgcagacgctcttgagtttaattagatatcatttgtgaattttggcttttgttgtcattgcttttggtgttttagacatgaagtccttgcccatgcctatgtcctgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggcagcagtaccatgctgttttggttactgtagccttgtagtatagtttgaagtcaggtagcgtgatgcctccagctttgttcttttggcttaggattgacttggcaatgtgagctcttttttggttccatatgaactttaaagtagttttttccaattctgtgaagaaagtcattggtagcttgatggggatggcattgaatctataaattaccttgggcagtacggccgttttcacaatattgattcttcctatccatgagcatggaatgttcttccatttgtttgtgtcctcttgtttcatcgagcagtggtttgtagttctccttgaagaggtccttcacttcccttgtaagttggattcctaggtattttattctctttgaggcagttgtgaatgggagttcactcatgatttggctctctgtatgttattggtgtataagaatgcttgtgatttttgcacattgattttgtatcctgagactttgctgaagttgcttatcagcttaaggaggttttgggctgagacgatggggttttctagatatatagtcatgtcatctgcaaacagggacaatttgacttcctcttttcccaattgaataccctttatttccttctcctgcctgattgccctggccagaacttccaacactatgttgaataggagtggtgagagagggcatccctgtcttgtgccagttttcaaagggaatgcttccagtttttgcccattcagtatgattttggctgtgggtttgtcataaatagctgttattattttgagatacgtcccatcaatacctaatttattgagagtttttagcatgaagggctattgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgaggatttttgcatcaatgttcatcatggatattggtctaaatttcgctttttttgtgtgtctctgccaggctttggtatcaggatgatgctggcctcataaaatgagttagggaggattccctctttttctattgattggaatagtttcagaaggaatggtaccagctcctctttgtacgtctgaggtagatgttttaaaaccccatttaaagatgagaaaacagaactggacaagatacataacctcctaaatcttcacagctacacagtattggagctggcatttaaaatcaactgggatatttggcctgtctggtatattttaatgtctactaaattctcagacaaatctccaaaaacctttttcttttctgtggctaagtctatacaagctaagtggaatggagacctgaagtaactatctggagataccaagatccaacatattagcttgtttttaaaaaaacaccttttaaaaatttaataaaagtcactctttcaaggtgaactctgcagctcttttttcccgtcttaaagatttagatgccgaagttatttcaaatactttttacattgaagatttacacataagtatgatgttttaatggaaatgaaaaaaggcgctagagaaaagattcaggttttcttttttcaaataagaaaaatgaggaccttaactgtattttaatttctacccccttgtagactgcatttttggtacatacactatgcaaaatttgtaagaggccaaagaatcttgctccttttagaatgttggcatttgtctcattagcagttagttgcattgctttgaccaattgtgacctgtttctataaatgaccattgctttttgctgcatttggtaagtgtagacacagcctttggagggtaatataaatgagttcaggcagggcatctcttgtaatctgggaacagaggagccagtgaaataaagatgctttctttcaaaaaccaagggaggagtcctagatgaaatgaatcctgaaggctattcttattttgggggctcatcatgaagataataagaatccattttgttgctgaaataaccaaataagagtggcacattcccataggagtgaccattctcttccttttggaaggggcagctttagaaaagtgccattatgcaaagctgaaggccataaaaaagtgccattaaagagaatgcaaattagcatgggcctaccagcctggcaggcattattaatgttggaggtaaagaaattaggttgaaggtatggaagaaccataaaaaaacaaccagaggccagtgtgacattgggctgatggccacttaagctgatgcctcatggctgagactttgctaagtggaagattaactgacaaaacagcttgaaggttgacgaactatttgagctcattgccagatactctagaggcaaaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcgaccacaaaattcagctcttctgatttgctaggatctgactccaggatgcagtactttctggttaacagagggggctcttgtatgcagtaaacctcccaagatggagagatgtggtatcagctattttcattatagccatcttaggagtgtgaagttgtatctcattgtggtattgatttgcatttttctgatggctaatgatgttaaacattttttcatgtgcctattgcccatttgagtatcttctctggagaaatatctatacaggttgtttgacattcttaattgtgttatttctttttctttttaatattaattggttttttttaaacatattctaggttcaagtctcttataagatatacgctttgcaaacattttacccccattcagtggttgttgcttcactttcttgaaggtacccattgaagcaggaaagttttaaattttggtgaagtccaatttaatttttttctttgtcacttctgaaggctttgcctagtgttcacaaaaatttactcctatatctgcttttaagagttttatagtttaaccttttacagtaaggtcaatgatctatttcaggttaatttttgtgcatattgtgaaaaaggagacacacccataagattggtataactttatccttttttatttaggtaatatttgtcccagaatcctttgttgaagactgtttttctttattcattttccttggtaccattatacaaaaccggttgatcataaatgtttggatttatttctggattctattttacttgtctataaagctatctttaatcaagtgacacacagtcttgactactgttgctttgtagctagttttgaaagcaggaagtgcgaatcttttatttattttttctttctctagattgttttggctattcttggcaccttgaatttcattgtgaattttagcatcagcttatcaatatccacaaagaagccggctgggatttttttagggattgtattaaatctgtagatcaattttggggagtattgccatatggacaatattgtttttcaattcaaaaacatgggctatttttccatttgtttaggtcttctttaaattctttcagtgctaattttgaagcctttagattgtaagttttgaatttattttgttaaatttatttaaaagtattttactcttttgatattattgtaaattgaatttttttcatttttggattgttcattgctactatataaaaagatagttttttttgtttgtttgttttgcaacggagtctctgtcggccaggctggagtgcggtggtgcaatctcggctcactgcaacctctgccccccatgttcaagcaattctcctgcctcagcctcctgagtagctgggattacaggtgcacgccaccatgcccggctaatttttgtatttttagtagagatggggtttcaccatgttggccagtctggtctcaaactcctgacctcaagtcatctgcccgccttggcctcccagagtgctgggattacaggcatgagccactgtgcccggccagttaatttttaaatattgatcttgtatgctgcagccttgctgaattcatttttaagttctaatagtttttcagagtatccctcaagattttctgtatacaaatgatagagtttggatgtgtgttccccacaatctcatgttgaaatgtaatccctaatgttggaggtggggcctggtgggaggtgtttggattatgggagcagatctctcatgaaaggctcagtgccctccctgtgataatgaggtcacatgacatctgtttgcttaaaagagtctagcacttccacctctctctcttgctccctctcttgccatgtgacacactggcttcccttcaccttccaccatgattctaagcttcctgaggcccttgccagaagcagaagccaacactatgctagctgtacagcctgcagaactgtaagccagataaacttcttttttatgttacccagtctcagacattcctttatagcaacacaaatggactaatacaacatgcttatgctatctgtaaatagacactttaatttcttactattcagtgttgatgaattttatttccttttcctgccttacttccttggctaaaatctccagtaaaatgtgaactggaagtggctataatgaacttctttatcttgtttttgatctcaggggaaagcattcagtctttcattattattattattattattatttgagacaaggtctcactgtcattcaggttgggatgcagtggcatgatcacagctcactgcaccctcaacctcctggggcttgaggaaacctcccacctcagccttccaagtaggaagaactataggcaaggatcactatgcctgactaatttttaaattctgtgtagagatggggtcttgctatgttgcccaggctggtcttggactcctgggctcaagtggtgtactgcctcagtctcccaaagtgttgggataacaggtgtgagccactgttctctgcccagtctatcactattaaatatgtgagctctaggtgtcttttatcagattgaggaagttctcttattcctagtttgatgagtgtttctttaaaaaaaaaacaatgaatggatattggattttgtcatgattattctgcatctcttgagataattgtgtttttttctctttattttttatttatttgtttttttttttttgagacagggtttccctttgttgcccagggtggagtgcagtggcatgatcatggctcactgaagcttcaacttcctgggctcaagcaatccccccacctcagcctcttgaatagctgggactacaggtgtgcatcactattcccagataattttattttttattgtagagatggggtctcactatgttgtccaggctggtctcaaactcctgcgctcaggaggtcctcctgccttggcctcctacatgctgggattacaggtgtgagtcaccacaccctacctctttattctattgatatagtgttttacattaatttactcacaggtagtaagccaacctcgcattctcttgacaaatcctacttagtcatggtgcataatctttttttatatattgctggattgcttagattttcttctagtattttcatagtttcaggtcttaggtttaagtctttaatcttgagttgatttttgcacatgatgagggctaagggtccagttttattcttctgcatgtggctatcaaattttcccagcacaagttattgaagagggtgcccttttcccaatatatattcttagtgcctttgttgaaaatcagttagatgtaaatacacagattttttttctgggttctctactctgttccattggtctatgtatctgtttttacagcaatgtcatgttgttgtggttactataactttctagtataatttgaagtcatgtagtgtcttgcctccagcgttgtcctttttgctcagtattgcttcggctgttcagggtcttctgtagtttcatacaaatttcagaatttgttttttctatttctatgaagaatgttattggtattttgacagggattgcattgaatctgtagattgctttgggtagtgtggacattttaacaatattaattctttcaatctatgagcatgtgatgtctttccttttttgtgtcttcttcaatttcttcagagttttattgtttttattttacttccttgattaaatttattccttgttattttatttttttgtagctgctataaatggaattactttcttgatttccttttcagctagtttgttaatggtgtatcaaaacactgttgacttttgtatgttgatttttgtgtcctgcaactttactaaattcattaaatagttctaagatatttttgatggagtttttagggttttctatatataagacaatgtcatctgcaaacagagacaatttgactttctctttttcaatttggatgcattttctttcttttttttttttctttctcaacttttattttaggttcaagtgtacatgcgcaggtttgttagatgggtaaattgcatgtcactggggtttggtgtacaaatgatttcatgacccaggtagtgggcatagtatctgacaagtagtttttcaaccctcatcctcctcccagtctccaccctcaagtaggccctggtttctattgttcctctctttgtatctaagtgtactcagtgtttagctctcacttataagtaaggacatgcaatatttggttttctgttcctgtgttaatttgcttagaataaatggcctccagctgtatctatattcataggagacattggtctatagttttcctgtgatgtctttgtctgaatttggtattagagtaacactagtctcacagaatgtgttgagagatattttctccttttctatttttttaaagagtttgtgaaagcttggtgttaattctttttaaatttttggtgtaattcactagagaaacatatgggcctgggcttttctctgtggtaagttaaaattatttatttgatcactttactttttatagttcaattgagttttttatttctttgtgagttaatttcagtagtttattgtctttctggtaacttgtgtgttctttccaagttatccagtttattggcatgcagctgttcatagcattaccttataattcaatttattgttaaaggatagtattaatgtcccctctttcattcctgattttaataattgagtcttttctctttttgttcagtataagttctgtttatcaattttgttgatctcttcaaagaatccatttttgttttcatggaatttattattctttttcaactctcaattccctagaatctataatatttcttttcttctgcttgctttatgtttagtgtgttcttcccttttcagtatcttatgatataaagttatattagtgatttgaaaattttcaaattatagttgtaaatgcctatattttcaaaaagaaaatatttcaaatcgcttcatcccataagctttgatatgttttgtttcatcccataggttttggtatgtttggtttcattttcatttgtatcaaacaattttctgatttcctttgtgattttttccttgacttattggttattttgcagtgtgatgtttaatttttcacgtttgtcaatttcccaaatttccttctgtaaatgatttataatttcattccactgtgattggagaacatacattgtatgattcaactattttaaatatattgagacttcatgaccagtctgggcaacatggcgaaactctatttctaccaaaaatacaaaaaattagctgactgtggtggtgcacacctgcagtcccagctactctggaggctgaggtgggaggatcacttgagtcctgggaggtggaggttgcagtgagctgagattgtgccactgcactgaagcctaggtgacagagtaagaccctagctggaaaaaaaaatatgttgagacacatcttgtggcctaacatatgctctatcctggagaatgtctgtgtgcatctgagaagactattttgctgttggtggtggagtgttctatagatgttgctaaaacttggtagtttattgtgctgtttagacttctatttctccattgatctttttctagttgttccaccattatttaaattgggataatgaagtctccaattattattattgaattatctgtttttccctttggtcctgtcagtttttacttcatgtgttttagggatctgttgttagctgcatatatatttataattgttttgttttcttgatgcattgtttctttatcattataaaacttctttctttagtaattttgtaatatttattttctctgatattagtatagccattccatatttcttgtggttcttgtttccatgatatcttttctcttctttttcctctccaatgatttctatctttttctatctataatgtgtgtttcttgtagacagcaaatagctggatcttgtttggtttttatttcattctggcagtctgtgccttttgattggattgtttcatccatctacatttaacaatattaatgatatagcttgatccatcttattttgattttccatatatctcatgtcttttttgttcccctattgctcctgtactgctttgtcttatattaagttaatgctttccagtgtaacattttaattcccttaatgattttctactgtattttgttgttattttctcaatgtattctctagggcttaatctatgtatattaaattatcagaatctacttcatatttatagtaacttaattacaataagctctttaagtgttttcctagatagctctgtttcttcttctctctttttgtgctgttattgttataaattttacatctatacatgttacaaactcagcagcacattgttataattattacttaatgaaattttatgtcttctaaagaaggtaagagaagtgagagaacaagtatatttattgagtttcttataaaccaccttatgtaccattactggttctgtttgtttgtttctgtgcatttaagttaccattttgtatttcctcactccagtacagccttgctccaacacatttcttttggtttgttattgtcatatgttaaatgtatatattttatggtcccaacaatacaattatatacctatttttttattgcttttcaaagtttgttatgagaaaaggggagtaaatatgcatttatactgtattttgttattattacattattattttattattacattattatcttcaaatgagctgattttttctttcatgtggacttgaattaccacctggtcccacttgctttcagccggagaatttttctttattatttcttgtaatgcaggactgttagcatgagattgtctcatgctaacatgagatactttgttttctgtgaatgtctttatattgctttcggttttgaaaatacttttgctggatatacaattcttaattattggtttcttttcctaagcatgttgaatgccatcccactgcctttgtcctctattgtgtctgatgagaagttagctgtcagtgttattgaggttcctctgtgtgatgggtcacttttctcttactgcttttaagaatttctctttctctttttaacatttttagtatggtatgtctgtgttaggatctctttttggttatcctacttgcagttcattgagctacttgcacgtgtagattaatttttcttccagcttagagaaagtattagccattaagatttttttttcttttctgtttctttctctttctggtactcttccattaggtgtattctggtgtgctttttggtgtcccatatttctctgaggttctgtccatttttataccttctttctctctctgttttcagattgcgtaatgtctactgaaatatcttcaaggttgctgattatttatcctgccagctcaaattgtctgcggaagccttgtagtaatttttttttaaattgagacagaatctcgctctgtcacccaggctggagtgcactggtgcgatctcggctcactgcaacctccgtctcctgggttcaagcagttctcccacctcagcctcccgaatagctgggattacagacgcatgccaccatgcctggccaatttttgtatttttagtagagagggggtttcaccatgttggccaggctggtctccatactcctggcctcaagtgatctgcctacctaggccccccaaagtactgggattacaggtgtgagccactgcacccagcccttgcagtaaatttgtaatttcaattattcttttcaatttcagagtgttcattagtttcatttttataatgtctatattatataacatagacattatattatagaaaatatatatagaaaaatatattatatataaatatatattatagaatatagaatatatatagaatagaatatatattctattctaaatacagaaatatatagaaaaatattatatattatataatatagacataatatccttttatggatattatatatttaatgagacattgtcattataccttcctttacttctttaagtatggttttcattagtttcaacactatttctaaaggctactttgaattctttgttaagtctgacatctgggctctgtcacagatagatcccattgcttgcctttttctcttgtgtatgggtcacgcctttctacgtcttttcgtgtctcataatattttgttggaaactggaccttttgaaactctggataatgattctcctccaccttcactgggttgtgtatttgttgctgtttgcttatttattctgggacttgtctgaactattttactaaaacctatttctcccctgtgtgaatcctttgatgtcagagggctgtcttgggcatgtgcagagtcacagtgggataacagttttagcagggatttctttgggtctttccctgatatttctgttaaacagtctgtctctgttgttatcatgtctatctgttggactccactaattgttgggtgattgctgtattgtttttgacagtgtcctggggcatcaattgctccacagtctgatcagatttggacacttttgctggggtattttttttttttttttgaggtggagtcttgctctgtcacccaggctgaagtgcagtggcgcaatctcggttcactgcaagctccgcctcccgggttcacgccattctcctgcctcagcctcctgagtagctgggactacaggcgcccaccaccacgcccggctaattttttgtatttttagtagagacggggtttcactgtgttagccaggatggtctcgatctcctgaccttgtgatccgcccaccttcggctcccaaagtgctgggattacaggcgtgagccacctcgcctggccttgctggggtattttttgaggccagtctttgagatttgttctaaccccaaaagggctcttctttgctggttctttttctggttatctaatgttagctttcctatgatttagcttgtcactgttacacatcctcttaaatgcttaccaccaagatttccatttttttctcagaggacctttagggttttactttcccttatgctataataaaaagtcagttcctttggggagagctttggaactctctgttttatggcttgcctttctgttggtgtacagtgtctgagccattgctttggagttggaggcaaggacaggggtcttgtttctctcaaaatgacactgcttcttttctagctgggtattcatggagtcagtatcctctggtcttctcagtttgcctctcctgatatggagcttctttgctgatagcgagctacaccagtggtgactggggggtccagtgttgttgctctgctatgcctgaagtacagtctccatcctataactggagacattgttgaggaagggagcccctgtcttcttggccatgcttgcctggagtttagcctttgcaacaaagagctgatgttgatgagaattctggaggccttggtctcctggggagatacatagctcttgactgggagctaggaattgtgggtatctcctctttttgtccacacccacctgtactggtcctgctgtgtgaaggggagggagtagatcatggctcaagtgctacagactctccctctttctaccaaaggttagtagacttccttgaataaatctttccttatttgctatatgcattaagaacatttccagagacagtaaatggctgctttagaattttcaccggtatggttgttttactggggagaggcctgcagagctaagtcacaattttcttggttttaggtatgatggatgatttttttttattggctccaagacatattatacattatgttcagggatgctgggtcctatttaaatcttttattttagcaagcagtctccctgtttaggtttagcatataggtcttggcctactttttttgtctgtggttccactgtgagtttaattttcacagcatttgtgttgttatttaggtctcctctgtttatttagtattattggacttttcactggtctctcttagtgctgcctaaggaagccaaggactttccccaagccaagcccttgggtgtcttttggtgggggagggttgtattgagatcctcctaatagtattatccagcctggtgtctcaggtttggggaggaaattcttgggtccatggggactaacaggcctcttagacccatatacttgctgcagttgtctcttttggtagctcttccagcctgcctcaatgtctctggtcaggggaggagagtgtcaggccaatagggacaaagagcctttccagtggctgggcgcagtagctcatgcctgtaatcccaacactttgggaggccgaggtgggtggatcaccagaagtcaggagtttgagaccagcctggccagcatgacgaaaccctttctctacaaaattaaaatacaaaattagccaggcttggtggcacatgtctgtaatcccagctactgaggaggctgaagcatgagaatcacttgaacctggaaggtggaggttgcagtgagccgagatcatgccaatgcactctagcctggacgacagagcaaggctccatctaaaacaaaacaaaacaaaacaaaacaacaacaacaacaacgaaaaaagcaaagcgaaaaaaaaaagcttcccagaatgggctacttgccacaattgggtctcttttattggttctgcccacccaccttgatgcctctgggaaagggaagagagtcttaggctcatggggacaaaggagcatcctatatctagctgttaggtataactgagtccctttttcaatctccgtctgcttatcctgatgtctctgggggaagaggggtcttgagtcctcgggggacttcctgaaataagtctcctagctgtggttaggtcctgtttgcttaatttggttttgtggaccttttgcatatccttgttgtttttctctctagtttttctatcagttttccagagaggaggtcgaagtttctaactataactgtggatttgtctatttctccttttagttccatcagttttcactttatatattttgcatttctgttgtttgttacacacacatttagaatggctgtgtgttcttggttgattgacccttttatcattatgtaatgtccccctacattcttggtaattttgtgttccaaagtctactttatctaatattagtatagctacttattgctttattttaattgatgcctacatgatatatctttctatttttcagtgccttcttttgcttgttttatgtattatgtcaggctggagtacagtggctattcataggtctgatcacagctcactgcagcctcaaattactggcctcaagtgatccttccacctcagcctcccaagtaggtaggacggtaggctcacaccatggcacctggcttgtcatgtgtgttttctgtaaaatctagaattagttggaggaatagagagaaatgtgtatactctgtcttgtccagaaccagaaatctagttcacctatttctgttttcttgaatgatctgggttggctttttaagtctttgaggctccgtgttgcactcacctaattttagctcaataagatcatgttactgagtctactactctgtacatcaagggctgtagtggctcaattttttttttcaaagatcaaattttcaaagtccatatatttttatcaaatatgcccttagccttttgttgctttggttgcatctgtccctccactgcctttgtaggcatttggttttggagagttgcaatgatgtatgatctgcaaatctccatctgctgcctgccactgactcagcatgaatagaaacaaaaattgactataaactggttgacaccaagatagacctaataacatggcttatttgtatgaagttggactctgctattaattcattcagtatgaagtgcttactgtgtgccaggatctgtgttaggtcctggggttacagagctagcagtgccataggtactgattttggagagttcatagactactgagaggagacaatcaaatagggtattcggtgctatgataaaggtgagcacaggttgctgtgacaatagagaacaagggtactcaaattagggtaggctctgttgatggaagtgacacctgagttgagtccctgatatagtttggatatttgtctctgcccaaatctcatgttgaaatgtaatccacaataattggaggtggggcccggtgggaggtatttggatcatggaggcagatccctcatgaatgccttgggccatccacttggtgataagggagctctcactctgaattcacatgagatctggtcatttgaaagtgtgtggcagctgggcgaagtggcacatgcctgtaatcccagcattttgggaggctgaggtgggagtttgaggccagaagtttgagaccagcctgaccaacatggtgaaactccatctctactaaaactacaaaaattagccaagcatggtggtgtgtgcctgtaatcccagctacttgagaggctgaggcaggagaatcgcttgaacccaggaggtgcagtgagccaagattgccccactgcactccagcctgggcaacagagtgagactccgtctcaaaaaaaaaaaaaaaaagtgtgtggcaactactcttgaccactgtctctctcctcctcctgcttttgccatgtgacatgcctgctaccctttcaccttccaccatgattggaatcttcctgaggcctccccaaaagccaagcagatgctaacactctgtttcttgtgcagcctacagaaccatgagctaattaaacctcttttctttataaattacccagtctctggcatttctttctctttttcttttttcttttcttttcttttttttttttttttctgagacagggtttcactctatagcccaggctggagtgtaatgttgtgttctcttatcactgcaacccctgtctcccaggcacaagcgatcctcccctctcagcctccagagtagctggaactacaggcacatgcctggctaattttttgtatttttggtagacacggggttttgccatgttgctcgggctggtctcaaactcaagcatttctttatagcaatgcaagtatggtccaatgcagtccccaaggatccataaccagtcaaggattgggggaaaccttaggaagcagcatgagtaaagggagtttcaagaggaagtgttgcttgtacttatgggctagaatgagatctgtgacctcagaatttgatagaaaccaggacacctagagcccagtaggatatgcgacatattttggactttagtctgagagcagtgagaaggcattgggactttttaagtagaggagtcatttaatttgatttgtgtttttactgaattcctctggcttctgtgtgaaggggctggagagtggcaagaacatggcagtgagttagaaggctgcagggagcagcccagggagacagggttgtggcttggcttggggaagtgattgtggggatgcagagaggtgaatggattcaggaggtttaggaggaagaacagaaagaatgctgcgagtaaaagatatagatggtagggatgagagtgaggaagcaaggaagtttctgccaaggattctgccttgagaagactggagaagctgtgataagcagggcagtgggagagagtctttgtttacatgtggaatttggggagactgtggagtcgccatgttgagatgcccacgggcagtggatctgtggatgggggggctcagtactgcagacatagactgggagggttttttgtttgttcgttttgttttgtttttgagacggagtccccctccgtcacccaagctggagtgcattggtgcgatctcagtttactgcaacctccacctcctgggttcaagtgattctcctgcctcggcctcccgagtagctgggattacaggcacacaccaccatgcccagctaatttttctatttttagtagacataggttttctccatgttggccagactggtctagaactcctggcctcaagtgatccacccgccttggcctcccaaagtgctaggattataggtgtgagctactgcgctcagccagactgggagttttgaggtgctttgtctcatttatctcacttaaaataatttcaaaatatgttaaaaggaaatgttatttgcaatgcatagacaggttttcctcgctagttgctgaggataaaatccaaacaactggacctaaacagacaggattggaagaggctgttctggaccaaatgggatgctaaaccttagaatggattgacaagagaaggccatgcagaatggtgagaaggccctacttacctcagcccagcttcaaggccctaagtgagggatacctggaatgcctctgaagactggcatttggatgcccattccttcccattgcagttgccaagcccaagagcagtggagaacaactgtaccttcttgtcatgaagtgtgtacaccggaaaaaagtaaatgcttgtattttctttttcctctctttcttttctatatacagctctccaaaaacgcagatttctctagatcacagttgttcgtggagaagtgagagtgacaattttagagtaaaaaatttaatattgtgggaattatctctaaccagtcaaattactaatgaagatatttattcttgggaatctagaatcagctatttaagctttctaggatctggagtcacacagacttgagttcacatgatggctctttcacttaccaatcatgagactttgggttaatcactgcatctacttctgaccttcagtttcctcatttgtaaaaggagaatgctacctcatgggactgttttgaggcccaaatactgtatgtaagtgagagggctttataacgtataagttgctctttaaatgttatttaatcattatttagcttctggtttcattctattaataacattttaaagtgttattagaaaaattgtaagattcttgctaatattaaaatatgttgctttatttaaaagtaactcctaattcatgcccacctaataataaagaatatcattaggtggctgtaaacaaaaaaatcaaacagttctttctttcctctatacactcacacacttctggtcatcaaaatgtgtgaatttttccgacagagaccaatactccgacactagctgggtgtcttacaattcaattcagttctgaaactaaccagcattagtgcaggccccatagattaagagctcagtcccacaagtctgccccctccccttcagacatctatctcaagtcccaggttgtcacctgtacttctggctgtaaatcaaggtttccacgaccccctccttgggtttgacaatttgctaggacagctcacagaactcaaggaacacttgcttacatttactggtttattatttaagaaaggatacaataaaggatacagatgaacagccagatgccaaggtacataaggaaaggtatgtggggagggatgcagagcctcttgtcacctccatgtgttcaccaatatggaagcattctaaaccctgtctttttggggttttgtggaggcttcattaggcaggactgattaaatcatttgtcattggtaataattcagtctctctttttatcttttgttttgagacagggtctcaccctatcacctaggctggagtgcagtggcgcgatcacagctcactgcaacgtctgcctcctgggttcaagtaatcgtcccacttccacctcctgagtagctgggaccacaggcgcacggtctcactttcttttccaggctggtctcgaactcccaggctcaagcaatcctcccacctcagcctcctgagtcactgggactgctggcacacaccacgacacacggctaatttttgtttttcctagaggcggcatttcgccatgttgcccaggctggtctggagctcctgagctcaagcgatctgcctacctcagcctcccacaaagtcctgggattatggacgtaagccaccatgccccgtcaacaactcaatcttaaacccctctccctttcctagaggtggtggggctggtctggctgaaagtttcaaccctctaatcacatggttggttcccttggcaaccagccttcatcctgaggctatccaggagcccccagccatcagtcattcattagcacacaaaacatctatcacttcagagattccaacagtttttggaggaatgaaaatcaaaatatatatttcttattataaatcacaataccacagtgattattggtatgtatgcttttaattttaggctaagcgaggattgattctattcaatttttccctcaggcttataggaacacatttaagggcatctgttgatgactcattaactgtttcaaacctaaaatgtgtcaaatgctgtgactttgcaactattgttgctcttccctttagcacgaaatactttaatgatctcaagacatttatattatcagatttttgcatatattcactaaaatttggttttattaatggtctcgatgtgtcccataaatattcctggtttccaacttgagctggatttattaggaagaggcaaaatttagcttatgtgccatacctgaaggaagttacgtatcgtagcttgtgatgctgtgggacagctaaagaacaagcctttacctggtgacagattttaactggggaatagttattgtaaaaaatattttcattttttttagactacaagatatgcgggctagcattggatgcttgaaaggaaaattacatttttgctgaaatccaggcaatgcaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaaaataaaatgctgagacctaccccccaaccatctaaatggacttcctcctcgaccaaggcactcttaaaatttaacttgaaagactggttcaagtcatgacaggttgtggcagtgggacatgcctcatgattacctctctggcattaacatcaacacagaccttaagtctgataagaagcatttacaatctgttctcttggaatcttcctacctggagacttcctctgcacaataagaactttggtcttcataatcctttatcttaacccaaacatttcctttctattgatcctaggcctttatttagataaactcaaccagttgtcaaccagaatttttttttttttttttttttttgagacagagtccagctccgtcacccagactggagtgccctactgcaatcttggctcactgcaacctatgcctcccaggctcaagcgattctcatgtctcagcgtcccaactagctgggattaaaggtgtgtgctaccacgcccggctaatttttgtatttttagtagagacagggttttgccatgttgggtagactggtctcaaattcctggcctcaagtgatccacccgccaaggcctcccaaagtgttgggattacaggcgtgagccacagaaaaattttaaacctacctataaagccggaagctctccccttcaagttgttccgcctttctgaaccgaaccaatatatttcttaaatgtatttcattgaaatcccatgcctccctaaaatgtatacaaccaagctgcaccgcgaccaccttgggcacatggtctcaagacctcctgagggttgtgtcatgggccgtggtcactcctatttggctcaaaataaatcacttcaaatatcttacagagtttaactcttttcattgacactctgccaaaaggagccctgaaatgttggtcagatttggataaggaccatggccatgtggcttaaatggcatttgctcgcttgttggtaatgagttgcatttgaagaggtggaataaatggagacaaccggcatcattgggcacctgtggacaaagaaaagcctttttggttgagccaaggtgatactatccacatctgcctaggaagttgtttttttgtttggagtagctgggactacaggtgcccgccaccacacctggctaatttgtttggttttgtatttttagtagagacggggtttcaccatgttagccaggatggtctcgatctcctgacctcgtgatccgcctgcctcggcctcccaaaatgctgggattacaggcgtgagccaccatgcccggccctgcttaggaagttttttgaaagagtgtttatttgtgaaaatgaaggtgcttctttatgtctatagctttctggctttactcctttcagagatttgacttgtaaggcaatagatagaaatgatagctcatcagcatctaatgagccaaattacttactccataaaatattatcctactttctaactccaaccatacaatttgaaggaaagaagcccaggggtcccgattaagccattgacatgtctggctgaaggatgatatgggcttctcattgactgagccaacaacatgacctgcccaggcgggatccgggctgactcctaactccaggatgaaagcaggaaggtaaacagtctttgggtaatttactcaaattgtagccagtgaatacctcaagcatggcactcaccatgctgtagtgtaattgcctggcttttgtttttgttttattttgttttacctgatgggagctctctaatacttcaaacatggcacttaccatgctgtagtgtaattgcctggtttttgtttctgttttcttttgttttaccagatgggagactatgtctttcatgtctgtcttcccagtgtctttgtccgcagtaatcaattattgtatgttgaataagcaaaattataatttttaagcaccataaattcaacctgccaaaagccaaatccaattttttgtctttcaggggatggcacaatagccagcttttcaggaacctgagtgttttccaaaccagcacttttcaaacttaactatgcacatgaatcactaagttttgtgaaaatgaagattctgattcagtaggtcaggggtggggcatgagattctgcatttttaacaatctcccaggtgaggctgatgctgttggtctgcagactacaccttaagtagtaaaggtctagaccctggtctctaccttatctccaaaatttaatccatcaccaagtcatgttgtctccatctcctttgtcccaactcatgtctgtttctgttgccaccactttagctgaagccttcatcatttcactgcagagattattgcaatagctttcatgtagtctacctgctctttattctccactccactgtctatactgcagccaagatgatatctctcaaatacacctttgggcatgtcaatccattgttaaggggctttcaatgtaggataaagtaacagaccttctgtggttagattgcctttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctgtcctgggaatgggatgcagtgccttgggtggtttcaggagattgacacacttccaggaccaggcattttcatttccaccttaaagaaggagcctgctgtgctttctgagacctactgtatctgggatggccagacttcaggagacaagaagaggaaggcatcctatccttttggtgggtggatggacgggccgaatctatctcagaaatttttaatttttacttccatgtcactttccagtcttcagccagccccccaccgtctacctcccactgctggagtgtggcttcattcaggggagaatgctgagctctgttgacatttggtagaatttgttttcttccctctttaatttagcaactaatcacgggggttgttctttgttcatctttccagggttttccgtacgctgactaatgcttacagctggctctctctggagagaagtgctgggaagatcaatcaaatgaaatcttaaagggtaaatcaggttttcaaatgtgttcaggcagctttaaatcgtttcagtgagaagaagtgcttacaagggcagaaatttgcccagcgaaatgcctcccaatggcaacagaacaatcacaccttggatggctgctttgtagcctgagtgtccagttcttctgagatttccaatggccatttacaactcaagagtgagggacaaaatgaagtgcatttgacttgaaggaattcactaatgcaagatcaaagttgtaaaaactgtaccttaatatgctctatcaaagggctgtatgcagatgttaagaaagggaagctgcacaaaatatcccttttcaataatttcacattttctttagtttttcagctcctataaatctcaagaaataattaacatgaaacctatattatgtttcaggaaaaactccagagagtctttcttaggcttttggaagtcagtgatgctgttttctgtcttcttagagaagtcctaaaatggaaaaattttatcatggaaattgacccattcagagcagagagtttatgtgactttatggtacaggaaatttgaaaatcgcatctcatcttttattttctattgtcatgttaaactatggttgtgcctatgggattaagtgaatattctagccacttgcattaaatgattagccagtcttttcatagtgacagttggttgtatgtgctgctagtcctgcagcggtctagtctgctagtggttaactatggagaattggtcagaggagtccctccccctattatacacatctcattaaagactctctgccactgccaaaccagaaaaggcaacttatttcacgattcattaaagaaaacataattgggaaggtaattttgtaaagtcatcatcaaacatagtccaccacccagtaggaattatcctctcattatctctttttctagatagtcattgacattgttcccctctgttagcatgaataattaaggactgagcataaagaagtggtgtggacctatggtcaatctgaaggtgtcatcagaagagttagcagggctttcttgccttcagcaggccatttattctgagctaacctgccaattgtatttagaacagggaccattaacagggtgactgtttggctggctgtcagtaggctgtggggctttttccagagcaaatagagaagccagctgggcttcactaagaccacccaggaagagagatcatgtcccacctgatcacattccaagcaggtagcaaatgggctccagttgaattgtacttctgaaggctttctgaaggggtaggggaaaatacctcccatcttagaaattatggctgctagtgtccagtttaaaaaatttctggccctcagcaccaagtgtcttagctttttgtccatctatagctgtcagaaagacacgctttgtcttcctggcaaaactgcctctcaaggtctatgccatcattatggcttggtttaatcaagctaccagggttgcccctgtgtctctcatctggctcttccagaagggacagtttgggaaactttcagagattctgaagatttcatagggggagaccacacttaaggaataagaccctccacacattgcagtgagagtgacatgttcattgccaccaaaagaagcccctctgttaaaacaaacctgattccaaacagagctaaggttgcttgggggctccgtattgtaaggcctatgggcatgcaatgaaataggagttgatgtggactctgaaccctgaagaagcagtttaaatcactagcactgctgtttattagctgggaaattttgggcaatctatttcagttgtcaggtcttcagtttcatcatctctaaaatggggaggacagtgcctgtctttttacactcctggacttgtgttgaggagatcatggataaagtgtgttgcacacagtaagggtagttatcatggttattaaccacactgcagctaattgggctctagctaccccatttgtccctggtcaggcaggcccaggactttcttaagcttttctcaccttaaagcggaaacacattccctctcctgtggggtcacgtggctctgtttaaatgtggctctaaatgagatgtgtgccttttgacaggtcaccttgtaaagatacacagcatttccaaccatgtaaaggtggctctaacttcttgaaatcctctctttgagaactgcctttagagctggtcattttagtcacaaaagaaacatctttcaacagggtcttttttttttttttgagagggagtctccacccaggctggagtgcagtggtgcagtctttgctcactgcaacttccggttcccgggttcaagcgattctcctgcctcagcctcccaagtagctgggactacaggcacacaccaccatgccccgctaattttttgtgtttttagtagagacatgatttcatcatgttggccaaactggtctcaaactcctggcctcaagtgatccgcccgcctcagccttccaaagtggtgggaatacaggtgtaagccaccatgcccagcctcaacatggtcatgttttgaatatgcttggacagaaccttgccaccatttctcatagtcatgtgtatggtatttaaaccatagaatgtcagatttgtaatgccccctagaaatcttctagtccagtagttttcaaactatgttccccagatctcaactgtttggagaagggacatcaaggtcagggaaaatccaaagcaccatatgttcttgatgctaagatgccattagttgtagtttgcaccatcaattaatactggcatttcaggaatattaaaagaatgtatgcagtcattctaagacccatccttattttagatatgaacttcaattaaatacagtattagggttctctggaggaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtcccagactccaaaagctgaagaatccggagtctgatgttcaggggcaggaagcatccagcacaggagaaagatgaaagctggaagactaggaagtcagctaattccaccttcttcttcctgctttgttctagccacgctggcagccagttggatagtgctcacccagattgagggtgggtctacccataacactctgctgactcaaatgttaatctcctatggcaacaccctcacaaacatatccaggaacaatactttgcatccgtaatccaatcaagttgacacttaatattaaccatcacactgtccatcatcaaattaaagaaatataatgttttctgttaaacagtataattttacacaattgggtaagcactgtttcattgctattttatagattgggctaatgcctatggtttcatgtcacagatttctgctcctacagagtttgaaaattgacctaatctaacccatttcttctgtagaggtccagacaggagaaggtcatacagatagttagcagcagggctggggctagaactcaggcttcttgactgccactccagttctcttcacaatgttacagtaccttttgtctacagccatattgcataccagcccagctttcctttgccatgacttggtttgcatgcaggaattgtaaacccatcttattaaaagttaccaatgataggctgggcccagtggctcacgtctgtaatcccagcactttgggaggccgaggcaggtggatcacgaggtcaggagttcgagaccagcctgaccaatgtggtgaaaccctgtctctactaaaaatacaaaaaaaaaaaatagccgggcgtggtggcacacacctgtaatcccagctactcggggggctgaggcaggagaatagcttgaacctgggaggtggaggttgcagtgagctgagattgcaccattgcactctggcctgggcaacagagagagactctctctcaaaaaaaaaaaaaagttaccaatgataagaacattttatgttactatagcccttaacattttacagaacaattttatattctccttttccttacatctttaccacagcttgttaggtggagcaaggaggatatcatcatcatcattattatcatcattattaagacaatcacctccattttatggatgagaaaactgatacccagggaggataagcaattggctcaagatcatgcagacagttaacagaactgagaagaccatccgtgggtcctgatttactcattcaatgttgttacacattaaagcaaaacataaatctaaagatacgtcttgaggaaagagttattcactagaagcttgcaagaacatcattttattgctgaaagcagctcaccttcaccagggacgttgagtcattgatatcccagaaaccccgtgtcattgggtgatttcaactacaagttggtgccatagcctgagccctgagccctgagccctgaggatggccttatactgagcattgggtgttttatcataacagagacagttaaggtttaacaatgggctaatggccgatggcagtgcttcctgcactgctagtgagagtgccaaaccaaggaggagctgaggaacagtccagtggctaatgtggggattagctgctgctttgggtaatctgtgtccagttcaggctggttacaggagagcctcaaggactcatttcacttggctgcttcttgacctgcaattttgcatgctgcatgctgcaattttccctttgaaaatacatctttccttttaaaaatgtggtgacatgtgacttctctgaagtttaaatgtttgatcatttttaagctggcacaaaaatggttataaatcttaatacttaaaaatgtaaaaggaaagcataaaccctaccaacttgtttggtcccttttgtgtgtttgagagagcaagcccagctcagcaggccctttggatgtccgctgaggttcagaaagcaatgatctagtcgcatcaagatattgaatcttctgaattctggccttgtgccccccaggtcagggctgttgtgttggttagatggctgcccaaaaaatggtcctgccatgcccctgagtttccctcttgtgaatgaatagaaagtttccatctacagagttggcaagctctgtgctgttaatttcacttagttaaaaggaaaaaaataactaaacacacaattattagtaaaccaccctgcagacaagtttaggattctaaagaacatttggtggttaggcttaaatgctgtaggctatgattacccttaattctgcacacagacaggcttcagagccagaagttacatgatttggtcttgtcagatgaggtcccctttttgccttattcacagggagattatggaggtggtaattgtcagtggattccaaaactccctggtcaatttaagcatttatatgtgggtttaataaaatgatgatataatacagaaagcacactgtcagggaaggaagtaactattagcaacatcatgacaccttaatctttttctccctctgggagagcagaatgggttaaacagaaggtttgcttttattattgaagcacaaaaaatcacatttttgtctaagttgtttagtcagtgagttttgtgtaattcaatggaaataattccatagtaacttagtaagtcagtattgaaaaggctgggtgaaaggacagcattttagagcaggcagtgggaagcctgagggagcaggagagggggagaggggctggttaatcagccgtcatatgccaggacaatatataatcctgtttgatttggtggaacaggccctttatgggtaacatattccccaatcccaaatcaggaactgtgaactcattttacttgctataacctcaatcctcataggactggggcttataaattgtggttgactaagtggggagggctgagttgtggaagatgccacctaagggtagtggggacaagcacttcaccaggaaaatcagtgacagaggatttttcagtgtaactttgccagctggagacctctgcagccagcgatggccatgcctggatctcactcaggccctgggcttgccacaggaggcaccctgctcacttggcccagggggctgtgcttggcttgcactcctgcccagatcccacacttgccacaggatccacactcagcctgcagctgggccgggcatgctgcaaccagcttcccccttgtgtgctgacatctggatgaggggaacacagtggcatctgaacagggatgccaacaacctcaaagccccagagggggtgttacagtgtgctaacagttgttttagtcccaccatccacagcctgagcaaacaggggtgtgttaacagctctttcagtcctgttgccctgctccagcccgcagccccagggctaggctggccctgctgctgcttcctggagcatgaagtggctgcctggcactggcggagggcagagggctacagttttacagccttctttgtacccacgtttggcaggttctgagttcttgtcccacatccaagaagaatgagggtacgttgacaactgaagtgtgaggagagttttattgcatggcagctctcagtagagaggggactcgagaggccagccctcgagtggtggtcccaaagtgtggctgagtccggggtttttatggactcggaaggggatgcacgctgattggtttgtgagtattcaaaaaaggctaaaacaagggcaccactcaaaggtgggcacgacagtataaaaagccaattagggaagggtaggtatatgtaaaataggtgaagggtggggatcaattaaaggaaagcatgccagatgggaagagaggttctcaattttgtccatggatttatctaggacttgtagcttggctttcaagctttaaactgtctatggtttgaaggtggggttttatcagggacttgcccctgtctgcctaagacttgtctgccttctgctgctatgagcagtacacagaggcaggagcaaaagcagaatagagccccatctgagccatgagttgggagattttacaatgggtcagtaaaagggacaaaatttatcaaatggaagagcacaaagatgagcatttggatttgtcaggaaagttccaagagaaatgttagcacaatcacagagggttaaattctgtaccatgaactacagatgaccctgactcctttgttggttataaaatacctttctagctccatataaagcaggatgccacagcctacatgtattaaatcatgcattgtattgagttgaattgaatggtatttgggagagggaggggatagcccaagtggtcccaggttaggaccaacactggggcagctgtgatcttgggacagaaatgtgaaaacacagactgtccagatgcagaacaggtgactttcatcaaatccagtccctccaatgaacataagaggaaactgatgccccatgaggggaagcaacttgtttcaggtcacctaccaggttagttgcagaacagacctaaagggtaggctacctaattttcaatttagtgtttgcttctctttaggctttattgttactttgcaatggagatcatacagatatgggtcaggagactcaagaggacaagtgatttgccccaggctacactagtgagcggcagtagccagtgtttgtctgattccagagtctgtggacgtaactacagggatatatgatagagtgttttgtggttggaggaggagagaattccttaagagtgtgtgctcatgaggccaggtgtggtggctgacgcctgtaatcccagcactttgggaggccgagacaggcagatcacgaggtcaggagatcgcaaccatcctggctaacacagtgaaaccctgtctctactaaaaatacaaaaaattagccaggcgtggtggcgggcacctgtagtcccagctactcaggaggctgaggcaggagaatggcgtgaacctgggaggtggagcttgcagtgagccgagatgggccactgcactccagcctggacaacagagcgagactccgtctcaaaaaaaaaaaaaaaaaagagtgtgtgctcacgaaaggcagctctaaagaggtcacatttaaactgaaatctaagggatcatgggaaagaattagccatagcaaagccaggggaagtccaggctgaagtaatcacaattgcaaagaccctgaggttgatttgtccctgggataaatgtccttgcctgatgatgtgcttgcctaagtcctttttttagaggtaattctttgacagacccattgctgtctggaactcccaatggacaattactgctttgttggtgtatctaattcaagagttagcagcagaggctcatgtcatgaaacttcccttcaagcttgtttgtctgctgagtttttggtaggagcaggatgggatcaggatggttagggggccaggagcggtgggaaggaaatgagttaggaatggtcttttatgtgcccatgagaccaggctactggtaaaatactgataaatatttcccctctaagttttttttttttttttgagatagcgtctcgctctgtcacccaggctggagtgcagtgctgcaatctcagctcaatgcaacctctgcctcccgagttcaagtgattctcctgcctcagcctccctggtagctgggattacaggcatgtgccaccacacccggctaatttttgtatttttagtagagacggggtttcaccatgttggccaggctggtctcaaactcctgacctcaagtgaaccacccgcctcggcctcccaaagtgttgggattacaagcgtgagctaccacacccagccccttctaagatttttaacatatgtcatgctgcaggattcctattccattagaggcttgtatttaccgaggcaaatggacgaaaggcaaggaaccagtactagaaatataaaaccatccctgtgttggatacgccctggaacaaaggaatataaggccaggattttactttctgccctggaactgacttccctttgactctgcaagttttactttcctgctttatgtctgataggcataaaatgcctaccattcttctttctaatacaattgtaatttcatcaatgggattagtgaaggcactaacaaaatctaaattctccatagtactgatcatcagggtgttctttagtagtgacttaaagaaaatcatgctctttgaaagaatatatataagttgcctttacattgctcactgagaaaagataatggagcccaaatctaggcttcttgttcctcgcctcccttttttttcctgggtgatcatacttttcaaggttatgttctttcatattcagtgttgaccatgcaaaactggtgaacaagaattggttctgggatgatttgttccagctataaagtagaaagcattttactaaaataggatgcttagatttgtttggatctacagtttattcttaactaaaattccaggaactgttggtaacagtctagattcatggcaaccagtttttacaagaattagaaagaaacgaataaaatgttctcattataaggttcaggaccgaatttgaaggctttcaggattccagatggcaaatggtagagcgaacgtgaaaatattagaaatttatgctcaatgatcatcatcttctgtccagtgaagaatgtagtttaagcaggatgggtgcgggcgtctgatgtcctcatttatttccacctctgtagctatttaagtgatgatcattcttggtggtggttaaattatgatgcacgaaatactatctccctaaggaccttgctacaggacagaggtgattacaagaaattgttgctgctgatgtaatgtttcgtataccaagattaaaccacaagatgaagtaatgtacattttttgcctttgaaatgcagctggagggaaaccagggtaagaactattgccaaatgaaatataatgccccaggaaaaatataagatactgtaaatgtaaaatcattacaaaactgaccatctgggtcatatattaaaccacagctttcaatttgttatggtttgaggaatgacttcacagtgtgtaccccttcctccgtaccttcctcagcctcaggaaagcattctattttcatgagtgtagaaaaaaaagtaatcttaaagttttgtttttaaaaaagagttccaatcaatagctcttaataaaggcacagtgtttgcttacttctttgcatttagtcctactatatagtcttgtgttgctaattccactttagctgtggcaaatataccagtgtgtagccaccgggccatgaggtaaattgaatccgtgtggagctgacagttgaaaaacctctgtctgcctcagttcaggaaacaagagcgtgttcaactcactttgggaaacccccaggcattaaaattttggcattttcatgttttgagagaactgaggagtagccctgttttgataatcatttaaaaatattttacttaattagagcagaatttgctcaggcagaaaatcacatttatatggtagccaggctgtaacacctcatagctacccattgtctctaatcagaaatgacagcctggtgactggctccatgctgggtgaagtccagcaaactgcaggccctgtaagtgcctaatcccaaacctgggcttccagtggagttggtttttttttttttttttttttttcagtggagttcttcaatgggtctggctttgaaatacttctatcctttctagtttaggaaagcaatggcacaagaaacccatatataagtcagctacttttttgatgtgtaattcacataccatacaatttcccatttaaaggctaaaattcagtggtttttagtatatttacgaagttgtacatccaaaaccacaatcaattttagaatattataattccccagaaaagaaacccctcactctttagccttcactcctagtctccccattcctcacacctctaggcaactactaatctactttctgtttctagagatttgtgcattctgataatttcacataaatggacaaatgcagtgtgtggtcctttgtgactgtcttcttggttcaacatgttgtagcatcaagcagcaattcatttcattttattgctgaataacattccattgcatgaatgcacaatttatttattcattcattggttgatggacattcagattgttttcagtttttaactattgtgaataatgctgctatgatttgtgtacaactctttgtgcagacatttgttttcatttctcatggagtagaattgctgggtcatgtgataactctgtgtttaatcatttgaggaattgtcaggctgttttccaatgtacctgcaccattttatatttacaccagcaatgtatgagggtttcagtttctccacatcctttccaacacttgttataatctgtctttttcaaatagctgtcttagcaggtttgtgaagggttacctcactgaagttttgatttgcattttcctaatgattaattatattgatcatctttatctgcttaatttctatttgtatattttatatagagaaatatctattcagattctttgcttatttgaaaattggattacttgtcttaagttattgagttataattgttctttatatagtctaggtacaagtcttttatcagtgacaggatttgcaaaaacttcctcccattctgtgagttttctttcttgatgttctttgaagcatgaaagtttaaaattttgatgatttccagtttatgtgttttttcttttgttgtttgtgtttttggcatcatagctaagaagtcattgcctatccaaggacatgaagatttacaactgtgttttcttctaagagttttattgttttagctcttacatttctgtctccgatcgatttcaagttaatttttgaatatggcataaagtaggggtccatctttgtccatttgcatgtggacgtcgacttgacccagaatcatttgctgaaaaggctattgttaacagttccctccctgccccatagcagccatgcatggggcaacttccagtgaggtgagtatgaggttgtggcaagcaggcctcagtgatggtggcatgatgaccatgctctggggcttcatctgtaatgacccgttcagtttcaacagcattaacttggagacacttacagaaacttacaagattcctttttacttacaatatcttgccagagtattttatcattgcagaggcatctagtggaaagttaatggattgtattgtgggtaaagcagaaggttcagtagctagggaagaatggcaccgttatgccacagctctttctgttgcccaaaatttccatatcttggtttggctgttaaactcatagagttgttggaggaaatttcagaaaggcacaagacaagggtgcctttggttggccctttaataatttactgtacccctagatagcacagggaaacaagtgtcttagtccatttatgttgctataaaggaaactgaagctgggtaatttataaagaaaagaggttttatttggcttatggttctgtaggcagtacaagaaatgtggtgctggcatctgcttctgggatgacctcagaaagcttccactaatggcagaaggcaagggagagcagacatcacattgtgtgagagaggaagagagtagagagggagtgctgggctctgtttctgaatcacttcttggctgggcatggcggctcatgcctgtaatcccagcactttgggaggccgaggtgggcagatcacctgaggtcaggagttcaagatcagcctggccatcatggtaaaaccctgtgtctattaaaaatataaaaattaactgggcgtggtgggtgcctgtaattccagctactcgggaggctgaggcaggagaattgcttgaacccgggaggcagaggttgcagtgagccactccagtctgggcaacagagtgagactccatctcaaaaaacaaaaagaaaaaaaaatcacttcttgagggacctgctagagtgagaactcagtcattatcatgaggatagcaccaagcccattcacgagggatctaccctcatggcccaaacacctcccatcaggccccacctctaacactggggatgaaatttcaacatgagattggaaggggcaaatattcaaactgtatcagtgagaaaaataaaataatatgagaattgagaaagaagcaaaacttttatgttgcatagatatgattgtacaaatagaaaatccacaattattcttatggatttattacaataaatgtttagaattaacaatgtttaagaagttggatataaattcagtacaaaaatcaattgcatttcaatatacaaaaaataacatttagagaaatatgtcatttgcagtgttaccaaaaaacattaagtgtttaggaaaaacctaacaaaagccatgcaagacctctttgaagtttataaagctttattgagaagcattcaacatgagctagctaagtgggcagatagactgcacttgtagattagatgacgtgatattataaaactggtaattctccccaaattgatccacagatccagtgtaattgcaatcaaaacctcaagtatttttgtgggatttgttaatctgattcctttttttttgaaacagtgtcttcctttgtcacccaggctggaatgcagtggcatgatctcggctcactgtagcctcaacctcccagactcaagtgatcctcccacctgagcctcctgagtagctgggactgcaggcctacaccaccacacctggctaattaaaaacattttttcatagacacagtgtcccactatgttgcctaggctgttaagctgattcttaaacttgtgaggtaacggaaatagctaaattaagacaaaatattcttttaattttttttaatatagagatggggtctccctgtgttgcccaggctggtctcaaattccttggctcaagtgatcctcccacctcagctgacaaggtattcttaaacaacaaaatgggcatacttgcccctccaaatgtcaggctataataaataagactttgtgttagcgttgtagtagttgtccagaccagtggaacagaatttgagaaacagatccaggaatacatggaatttgacatttcttagaggagaaattgcagatcagtggtgaaagaattgacttttcaaagtgtggtagaacaatttgacagccatgtgtggaaaaatttttcccagattactaccttatcatatgcacaaaaaataaattccagatttatgaaaaatctaggtgtgaaaagtaaagctaaaatgctctttaaagatagataatataggagagtgtctccatgacctcaggatagaaaataacttcttcaacaagccattgaagcaataactgtaaaggaaaagttcatatattcagtttcattgaagtgaagtcattttgttcttcaaaagatgtcataaggatcataacaagaccaaccacaagttggaagaagatatttgcaaaagcattacaacagtgtttgttggttatctggaatacatagagaagaactatagctgggaaaaataaataaataaataaatatgggaaagaccattaagtactatacaaaaagagaagagtaaatgggcaataaacaaaaactgcatttggccttattagtaatcaaaaatgcatattaaaatcacgatgcggcaccattataccatgagattggcaaaactaaaaatgtccaaagcaccaagccttggtactgtggggatggagttttactcaattctgtgagtgtaagctggtacaagcaggttagaaaacagtttggggccggctgtggttgctcacacctgtaatctcagcactttgggaggccaatgtgggaggattgcttgagaccaggagtttgagaccagcctgggccacatagcgagatctctgtctttacaaaaaaaaaaaaaatagctgggcctggtggtgtgggcctgtagtcccagctgctaaggaggctgaggtgggagggtgccttgagcccaggagttcgaggttgtgccactgcattacggcctgagcgagagtgagaccctgtctctatacacacacacacacacacacacacacaaagagaaaaaaaagaaaataaaaaaggaaagaaggaaacagtttgacactctaataaagtggaagatatgcatactcttttgacccaggaatgacctcataactgttgaccttagatattgcactatgagacgcaaaatgagaatattcatagtttttaatagtaaaagccggaaacttttaacaataggactatgggcaacttatgatatattcatacaatggaatgctaaacaacacacgaggctaagtttcacaatattaactgagaagggcaaatcaaaaaaatttaaaatataactccatttatatgaagttcataaacaggagaaactaaactatattaggtggtaaattagatattacttggcaatgcctaatttctttccatctatattaggtagtaatacctaatttattgctacttaatattgctatattaggtagcaagcagcaagaagataatgatcacaaaagtgaagaagtggagacctcttggtgagggaggggaagttgatgactagagggacctgagggaggctacctttgggccatggccacatgggtgcttactgcagtctttaatttgtacatatggatgagaacattgtatgtatgctatgactaatctataaaatgagcatatcaattactgcaacataacatatagtaatttttaaaaaccaagtaacagaattgtggttaaaaactacttttttgagtttatcttttaagaaactatatattatagattgtgaaatattagcatgaaaacaagaaagtcatgtttttatgctgcaaaataatggtcacaaatcctatgtaataaaaattgatattgtgatgtaaaacaaaggctattattttctcactggatttttccccactgttttagcacccttgttgacaatcattgactaaaaatatgaggatctggactcttaattgtatttatctatacttatgccaacaccatattttattgtcttgattaatgttttgaaattgagaagtgagtcctccaactttgttctggttttcatgattgttttggatattctgggtcttttatagttctatgtgaattttatgatcaactcattgatttctgcaaagaaaagtaagattttgatagggattacattgcatctgtagatcaattaggggagtattgtcatgttaacaatatcaagttttctgattcatgcacatgggatgttttcccatttatttaggtcctctttaatttctttctgcaatgtattttagttttcagagtataaattttaggcttattttattaaatttattcctaagtatttaatttctagcgatgctattgtaaatggaacagtgttcttaatttcatttttggtttgtccattgctactatatagatataaaattattgttggatattggtcatgtatcctgcaaccttattaaaattgtttattagttctaataaatgtttactttattccttaggattttctatatacaagatcatgtcatctgcaaatagttttacatcctcttttccaactggggtgcctgtatttccttatcttgcctaattggcctacctaaaacttccagtacaatgttgaataaaagtggctagaaaaattatccttgtcttgtttctgatctcaaggggaaagtatcattctttcaccatggagtctgatgttagttgtgggttttttctagttattctttatcaggttgaggaagtccattctccttttttctttaagctattgattatcaggatggatttaggtggtcttgctgctttggaaattgtagacttccttcttaaagcctgctccattttatccttctaagatatgcatgattttggaaagactacaagcttcccagttagaggagggccttcttgtttttcaccctacatacaatgagcctccttgttggatgccaaagtaaggtctttacatccttcattccctacagaccaggcttcttaaattatcaggccacaggtaacaaatatatttcatctcctgtaccaattctgatgttttggtagtagctgcccgaaggattgttaagaaggaatctgaggccaggcacagtctcagtgctgtcattaattagtgttatctggcctggtgcactggctcaggcctgtaatcccaacactttgggaagccaaggctggcagattgtttgagctcaggagtttgagacctgcctgggcaacatggtgaaaccccgcctctaccaaaaaatacaaaagctagctgggcatggtggcacacgcctgtggtcccagctactcaggaggctgaggtgggaggattgcttgagcccaggaggtggaggctgtagtgagccgagatcacacaactgcactccagcctgggttaaagagcaagagcctgtctcaaaaaaaaaaaaaaaaatgagtgatatgtgtcactggtctggtagtagggaaggctgcaaattgatacaacttctggattagactgtgcctgtgcctcaaccaattccagtggcctttttctcagtgccctccgtactccttcaacaacattaaatcttatggtccatacccctttgtaccaccctctcttctttagatctctgttacaaagcaatattctgggtctcctgtaaagtctctggccttccctcccccgacttttcccctcaacatatctctctagctttctcaactgagcctttgatcctgtgtactgtttgcttgggatattttgcccttcttttacatctctccttgctgaaaattgtgccattcttcaaggtccatctcaaatctgcttccctggttttccccatacctgagagactgttctgcccttaaactgccaaggcataggatatttgggtaccatacctagaattgttttccttcatgtacttttctgagttcctgcccagtactgaaaatatgaaattttttaagtccaggcagggactttatattcttagcatatgactccctgcttttactatggtggatgctcaataaatgtttggtccttttaaactctttgcttgctgtctattggaatgattatttttaagatttcatgttatttctattataggctcattagtaatgctctttattttgtgtttttcctggtgtttattccaggacatacaatatataacaatttagtattagtacacatatataactaggttatatattgctgcatgacaacctgtcttcgaatttagtggcttaaaacaacaaacatttattatctaatagttttagtgagttaggaatctaggcatggctttgctgggttctctggctcaaggtctctcacaaggctgcaatcaagatgttggctggggctgcagtcatttcttctgaaggcttgattgagggaggatgcaattctaagctcatgcatgtggttgttggaaggattcagttccttgtagtctgttggactgaaggcctcagttcatcactgactgtcagctggaaacccccatcagttccttgccccatggaactctgcatagggcaatttgccacatagcatctattttcatcagagaaagtgaaagataataagagagggtgaacaagagagaaggcagagtctttttttttgtaccataatcttggaagtgacatcttagtacttttgcgctattccatttgttatgagtcattatatccatcacccattcaaagggcaggtattacacaatgacatgaataacagatgttgtggatcattggaagtcatcttagaggctgcctaccataacatccttctaacttttaatattctaccttgaaataataatataccattttagatggtatattattcatgtgaaaacctataacaatatattttaattttcctcttctcagcctttgaactacctttctcatcatttttctacatatgttataccacatatagtacaatatagtattatttaattaatttatttattagagatagggtcttgctatgttgcctaggctgtttttgaactcttggcctcaagcagtcctcccacttcagcctccaaaagtgctaggattataggcatgagccactatatctggcctattatttttgatttaaataattatcttttaaagagattttacaaatgagaaaccaatatttaatatttatgcacatttttatcatttacagtgttcttcattcctttttgtagctccagcatcccatctggtgttattttccttgtgatgaaagaactttattatttcttatagtgttggtctccttgcaatgaattctccctcaaaaaaggaaaaagaaataagaagtgtaagaattgatagggaagatataaaactatcattacttgcagttggtatgatcatctgcagaagaaaaacaagataatggatagaaaaaatgataaaaactaataagaaaatgcagcaacttataaaaatcaatagcgtttctctgtaccgatgataactgatccaaaaacagctggacttctggcagtaattttctcagactgctcccttatttcacctaatttttgaaagacagttttttttttctgtaaatagaatgataaggtgtcagttttttctttcaatacttcaaagatgtcacactattgtttttggtttgcatagcttctgatgagaagtatgccatcatttttatctttgttcctttgaacaactttcacattttttcagtacttagataatgatttgctatggtgtggttttttccttttatttttggcttacagtccattgaaatttttagacttgcgcatttatagttttcataaaatttgcaaaacttttggtcctttttcttcgaatattttggtacttcattgaaccctgtggtgtttcccatagctaactgatgctctgttctgtttgtctcagtcttttttctctatgtatttcattttgaccagtttctattgctgtgtctttaggttcattcatcttttcttccgcagtgtctattgtactagaaatcccagcctatgtatttttcattacagatactgtatgtttcatgtctagatgtttgatttgagtctttcctgtaccctccatgtttctacttaacatgcccagtctttcctctagctcccctattaaatgggagcatatatataatgactatattttaatgtccttatatgttaagtctataatttgtgtcatcttagtttgtttctgttgattgatttttctccatttaagagttgtatctttctaattctttgcatgtctgataatttttgattggatgttggacattatggattttatattgttgggtgctttattttatcatatttctttaaatactattaaactttgaaccagcatgcagttaattggaatcagtttgatccttttgaggcttgatttttatgctttcttagggtagtatcaacgtagcctttagcctgcagctaattttatttcactaccaagacaatacacttttcagggctctaattattgccccatatatcacaaggtctttccattctgctggtaggaacacaaactgttcctgtgtctttgtgagcttctggggactggccctcctactttttctttttttagcaattcttttattggtcttgggtagtttcctcccatacgtatgccaatcagtactcagccaaagacataaagggatccatctgaagacctccagagctctctcctatgtagctctcttctctctggaactttttcccacaagttttaattattttggcctccctcttccctgatttctgtcttctcaatgcaggaaatcactgggctgtttgcactgcatcgtggaaagcctctccagtcagtaagctagggaagatttaggggtgcctcacttgttccccttctctgagggctagcaatcttgtactgactgttgtctagtgtctgaaagccatttttttttcatgtattttgtccagttttttagttgtttaatctgattgcttttactccatcatggttggaagcaaaagttgttaatacgtttttgtgatgccagactgaactttcattgtttggctattcaagggctaactcttcagcttattaaaatgcagagaagcttatatatatatatatatatatatataaccttatgttgataaagagagcatatatgacaggacacctttttttcaaactgagtagttagtagaagcatctagaagagaaaacatttggttttctaaactattaggaagatattaagccatttagggcagtgttccccaatcattttggcaccagggaacagtttcgtagaagacaatttttccacggacagggggaggtgggggatggtttcgggatgaaactgttccacctcagatcatcaagcattagattctcatgaggagcgcaacctagatccgttgcatgcagagttcacaatagggttggcactcctataagaatctaatgacgccactgatctgacaggaggcggagctcaggcagtaatgcttgctggcccgctgctcaccacctgctgtgcagcctggttcctaacaagccatggaccagtacccattcgtggcccagggatggggacttctgatttataactttgagtcactcaggctaacagcatcatggttaaggggatatttagcaacagaaataaagtgacttttctgagagtatgcaatgactccattcgccctaggtccaaaatgatgagaattgaaacacatatgttactaagattgtaaatggaagagggcggagggaggtggtgaacatcagcatagggcagaagttgtcacatccacactttcttgtatgtcccctattcctggagctgccttccctatttttttgcatgtctaaagagcaagtcatatcactgatctctgaataataaaagttaccatttattcagtgcttattatgttccttgcactgtgctaagtttatatattatctttcactgaatcctcacatctgcctatgaggtgggtgctattactattaccattttatagatgaggaaattcagatatagagaggtttaattatgtacttaaaggctatacagattagtgattggctgagctaggactagaacccaggctttttgactccatactctgtacttttgccttcatgtctccacctgagttgggatttcctgttcttccaaatcaatctcggcattatttagcactgaccacgattctttgcatcccttgcccccgctccccccgcccccagcacctccaagtatctattttaggcgactccagctcaggaagagcctcgatgttactcggcaacaggtatctctcaacctctaaaatgttccaccttctgatagaattccaccttatagttttgtcatgttgcttccttcaacactagatggtggacttcctcattgtctcctgattagaccttaatcactgctgcctttaaatgtcatgttccttcaaagctcaagacttagttggctctttcagttagtctttcctgatggatcacatgctgtcgaaatccttctaatgctttgaattatcagcatttaccttggatttggttagatggtctttctgactttctctgagattctctggtactttgaatctctttctagatgtttatgacatagcacccctatattcatattataacctgctcaaaattcccaatcatagaatatttactgagttcctaatatgagcaaaacactgattttaacattgcccttctcttttgagacaatcagtgtttccactgtttaatttttaattttttgtgggtacatagtagatatatgtatttatggggtatgtgagatattttaatacaggcatgtaatacgtaataatcacatcatgtaaaatggggtatccatcccctcaagcatttaccctttgagttacaaacaatccaattacactctttaagttattttataatgtgcatttaagttattattgactctagtcaccttattgtgctatcaaatagtaggtcttactcattcttttttttttttttttgagacggagtctggctctgtagcccaggatggagtgcagtggcacaatcttggctcactacaagctccgcctcctgggtttatgacattctcccacctcagcctcccgagtagctgggactacaggtgttcaccaccacgcctgggtaatttttttgtatttttagtagagacgaggttttaccgtgttagccaggatggtctcgatctcctgacctcgtgatccacccgcctccgcctcccaaagtgctgggattacaggcatgagccaacactcccggctcattctttctaactattgtttttgtacccattaaccatcctcacccatccccagtcccccacttcccttcccagcctctggtaatcatccttctactctctgtctccttgagttcaactgttttgacttttagatcccacaaataagtgagaacatatgatgtttgtctttctatgcttggattaattcacttaacataaagtctttaaactcttcatgtttattattcctccaattatttaatatgaagatctgcctggtgacagtattggagtgacgctcctatagaaccaaaagaggcacctgagttgcagttttcatcaaagtcatgtagtatacaccataggcattcagagtcactgtcagtccattgataagatgtaaggcaacagattagaacccacagcccagtgtcagcaagcagaagtgatgattgataccagtgagaggaaatagatgaactaacaagtatggccagctgccagatagttgtttatatgtcagtatcatcattgagcatcacattatcataacctagtacagtaatagatattcctaaagactgagacaaaatgcatataaagccctcatctaatgcctgacacgcataaagcacagaataaagtgtgtgtctatgtatatacattttatatatacacacaaatatacaaatgaaaaggctaaattataatcattgtattttatatatatcatatatatgtgtatatgtatgtatatcattatatacattgtaccttatagaagagaagtatacatgacattttagaatgatttccgtggaagtagctagaattaaaaaatatttttcgtttattgagaagtactttcagttatcacagtgcaacactgctttctgtaatgaggctagaaaaatgaggagccattgtatttaataaaataagaattttttctgtctccatggtaagattaacgaacacacttcaacataaagtaatacaattgctaccttcttcctggtggcatgctccctgtgttaaatttaagtgacagtaaaacgtaatgagttagaggagaaaaattttaatttattcgtttatttgaatagggaaacccaagagatcagtgatagaatttgaactgcgagacaaaaagaaagaagaggttttagttttgtagctaaaattaaggtggtggcacttgaagtgaaatttaaaaatacacattcacttagttttcttggccatattctgcttctcatgtgaaactggacttcctgccttttagccttgtattctgtccctttggaaactgtatcatcttttaaaaatgaagtacgtgactttcgtaatgatcttttatattataaaaataggccgggctcagtggctcatgcctgtaatcccagcattttgggaggccgaggctggtggatcacttgaggtcaggagctcgagaccagcctggccaacatggtgaaaccctgtctctacaaaaatacaaaaattagtcggacatggtggcacatgcctgtaatcccagctactcaggaggctgaagcaggagaatcacttgaaccccagaggcagaggttgcagtgagctgagattgtgccactgcactccagcctgggcaacagaacaagactccatctcagaaaagaaaataacatcaaaataaataacataacataacataacataacataacataacataacataacataacataacataacaataggaatttcaaaaaatctgaaacccgggcctggcacagtggctcacacctgtaattccagcactttgggaggctgagacgggtggatcacctgacgtcaggagtttgtgactagcctgaccaacatggtgaaaccccatctctactaaaaatacaaaaatcagccgggcgtggtggcgcatgctgtaatcccagctactcaggaggctgaggtacaagaatcgcttgaacccaggaggtagaggttgcagtgagctgagattgcgccattgcaatccagactgggcaacaagaacaaaacttcgtctctctccccacctccccccccacaaaaaaaaaaaaaacctgaaacccatcatgactatatcatgatgctgtagcctcaaaatggacttcacaagttcacctgtgattccctcaaaagcacttgagttttgatttgctgattgccagaagtgtatttgaacagtcccactttatatggagccccaagcatattaaatggagattccagataattagtgagctctggatgaagctcctgggatgcagtggggaaaaaactggatctggagtgttaaggtttgggctctgggcctgactttttcccttatcatttggaaattaggctcaggattgtgtattggggaaacacagcaagctgtatgcctatagtaaatagacaccctgtttagtggcattcaatagacctcaatgccatattcattcttccccaaccctatctgtcttggcttcaggcagatcttggcatagggcaccctcatcctcccccactgccacctagctcctgggtgaatgtctcccagcctgggaagagttctgttgaacttcatgaacaatgctgtctgcctagcattggagctcataccctgagactttgccttagtcctctcctttgtgcccagaggcatacatttgagagacagtcaatagagccttagacccctaactttgcacatataagtcctatgaaccatctgggccactcactctgcttagagcaattgcacactgctccctctcctttccttccatttacatctacagggagatttttagtttactaagccctggtaaatgacagttactaagatgtaatacaaatcttaacagtgggaacagtgactactgtttatcacgtgaatactataagtcaagcacaacaaccctttgtggtgctgctagagttaaggaggcatcctcagaggttgaggaatgtgcccaacctcagatgctagcaaatggtagagctttgttcagagtccaggtcctcattctaccacatctcactgcctctttatgttctgatgtctctactgtgtatatcaatgcttctcaaacgcagtatgtacacagttggccctctatatccgtgggttccacatttatggattcaacctaccacagacagaaaatatttcaaataaaaagcaataaaacataacaatacaacaataaaaataagacaaattttaaaagcaatacagtgtaataactgtttatatagcatttacatttattggatacgagaagcactctagagatgacttaaagcatatgggggatgtgtagaggttatacacaaatactttgccattttatttatttgtgtgtttgggtttctttttaagatggagtctcactctgtcacccaggctggagtgcagtggcacaatctcggctcactgcaacttccacctcccaggttcagatgattctcctgcctcagcttccggggtagctgggattacagacatgcacacccacgcccaactaatttttgtatttttagtagagacggggtttcaccatattggccaggctggtatcgaactcctgacctcaagtgatcaggctgctttggcctcccaaaatgctgggattacaggcgtgagccaccatgcccagcctgtgttgccattttatatcaggctcttgaacatttgtggattttggtaccacagggggtcttggaacattgcaatactctatgaatactgagggacgactgtatacatatcacctgggaatcttgggaaatgcagattctgatcttgtacctctggcatgaggccttgattctgtgtttctatcaagttccaaggtgctgctgctgctactgatccatggaccacattttgagtagcaagagtgtgcactatcagaaatacaaggggagtcaagaatcttataaccggattggacatttttaacaaaaatactgttgaaaatttacaggataaatttttgaacattttgaaagaacaaaatgttttatcaactagaactttgcttcattttcaatatggtcttcaaaaacaaaaacaaaaaatcaaaaccacaatgagataccatctcacaccagttagaatggcgatcatcaaaaagtcaggaaacaacaggtgctgaagaggatgtggagaaataggaacacttttacactgttgctgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttgttgtggcactattcacaataggaaagacttggaaccaacccaaatgtccaacaatgatagactggattaagaaaatgtggcacatatacaccgtggaatactatgcagccataaaaaatgaggagttcatgtcctttgtagggacatggatgaaactggaaatcattattgtcagtaaactatcgcaaggacaaaaaatcaaacaccgcatgttctcactcataggtgggaattgaacaatgagaacacatggacacaggaaggggaacatcacactctggggcctgttgtggggtggggggagtgtggagggatagcattaggagatatacctaatgctaaatgacgagttaatgggtgcagcacaccagcatggcacatgtatacatatgtaactaacctgcacattgtgcacatgtaccctaaaacttaaagtagaataataataaaaaaaaaaataaaaaaaacttttgttctttcagttaacatttttttttttttggtaaacatttggataaggaaacctgcttatccaaatgtttaccaaaacagtatcatccagatgatgacagttttgccccacttgctgaattcagcttcacattgctgacactctaagcaggggtctttgaatgtgcttcgggagattcacacttctcctccccatgatcatatacacagtcattcatatatgtttctttgtacatgttctgaggaagaatcggaactgttcatcacattctccttggacttgcaaaccagtgctccaggagaaaggtgcactccttctaatggttctggaattccccatcaccaaatccttgaccaagaagaatacatagtaatatatgcaatttatttgtatcaggtgctatgagttctcaggctgctgactacataattgaagcccttggaaaatgccagttgaatgctataattaggtaaaaataaatgcactaggccttttagataactttccagatgattgtcagccaaagcccaggcagaagtagtccctaatttccctagagctgaaagtcagtgaccttcagcttcccttttccacccttgtgattgtcattagggctgtgcatgtagcaccctcagccagcaatacggtagaagtgaggctcatcgttacttacctaggtctctgcattttcaatatctatctgcaaaatgagcttgatcaatatttaattattagtcaccaggaggtaattagagttacagaaaccaaaaagaatacatatagatgagctcaaggtgttctgagcacaccaaaccattctgacgattcaacatggaaacagctctgatcccaataatagccatagaagcctacctttaaaacccatccctgctcatttttattaggttggtgcacaagtaattgcgggttttgccattacttttaatggcaaaaactgcaattacttatgcaccaacctaatgcatttccatcattttcatagacctgagcacttatgagccatggccttgtagtcagactgcatggattcaaatcccaattattccacttaatagttgtatgaccttggtacattattgtcctctctagtctcagtttcttcttcctgcaacataagaataatgatgctaataataatagtgatagatagtactgctctcatggggtagttttcagattaaatgaaatgatctatgtcaagcacacagccaaatgactggcacatagcaagtactcactaaatgctaactgttgttattactttctaggccaaaaacaatatgtcctctttaacaggagcattgggtacaaagagttactgttgcctatgaaccttaactctttcagttagtggaggagaaattaaaaatctttgtgttatctattctgttcccttggtctttgtgcctatttttatactagtaccatgttgttttggtgactgtagccttgtagtatagtttgaagtcaggcaatgtgatgcctccagatatgttctttttgcttagtcttgctttggctatgtgggctaattttaggattgttttttctagttctgtaaagaatgatggtggcatttatctatcatcgtctttccttccacccagaacatcagagctagttgctacttacttccacattgcctctctgtttctccaccttcctagctttgatgatctgcatttctgctccattgtacttccctcacatacccactaccaaggtcacatatttaaccttacactttcgtatgtggatccactcctaagacctcaacctctgactacattcatcttggactacatacatctcttcctttctcacctcagaatctgctcttggtattcccaggactcattgatcttcataccgttccctttgacccagtatagaagcttctccctactttcagccacttccccccttctcttgccatggattcacactctcctgtatcctgcacaccattgccagtcatttcaacagatgactcataattccaaaatccctcaacaccataatcttatatcattcttgatttaatccccagcataatctctctgctcttgaagtaccaagtgttggtggaaaaagttgcaaaatgatgctcattgggtacacagatcagtagtactttctgatcttagctgggccctccctactgcttgaatgctctcttggatgctcttgtattcctctcttgccatcttctcagagaggcaggatggcacagcagttaatagcccaagcacaggcaactgatgagacttagacgctgaaatcctgggtctgctacttgctgcctgtatgattgggaaaattgatctaatcttaggctttagttttcttcacctgtaaattgggattgctcctcaccttaggggattgcttgtgaataccaaatgagatcatatatggaaagcacttataacacagtgaatggcacacgaagtacaaacacacacacacacacatgcacacaagcacatacacatcagctctattgaggtatgaattatataccataaaatctaccaattgtggcaggacacgttggctcacacctgtaatcccagcgctttgggaggccaaggagggcagatcacttgagcccaagagttcacgaccagcccaagcaacatggtgaaaccctgtctctacaaaaaatagaaaaattagcaggacatggtggtgcgtgcctgtaatccagctactcgggaggctgaggcatgagaattgcttgagcccaggaggcggaggttgcagtgagctgtgatcatgctgttgcactccagcctgggcaactgtaatgaaactctgatatggtttggctgtgtccccacccaaatttcatcttgaattgtaactctcataattcccacgtgtcgtgggagggacctggtgggagataattgaatcatgggggcgggtatttcttgtgctgttcttgtgacagtgaataagtctcatgagatctgatggttttataaatgggagttcccctgcacaagctctttattgcctgccaccatgtaagatgtccctttgttcttcctttgtcttccaccatgattgtgcggcctccccagccatgtggaactaagagtccattattaatctttataaattacccagtctcgggaatgtctttattaacagcatgagaacagacgaatacaaactctttcttaaaaaaaatctaccaactgtaattgtacaatttaatgattttagaatatttatacagttgtgcaattgtcataatctagttttagaacacttccattaccccacaaaattccaatgtgcctgtttacaaacaggcaattgtagtcaattgccattttcactcttgacctctggcaaccactgagtgaaccactttctataattttgctttttcttgacattcacataaatggagccatataacatgtagtcttttgcatctgacttctttcacacattataatattttgggggtttgtgcatgtggcatcatgtatcagtactttattccttttgatggccaaataatattccattttgtggctataccacattttgtgtgtccattcatcagtagatggatatttgaattgtttcctcagtgtttccaattgtgaataatgttgctatgaatatttgtatacagctctttgtgtggaaatatattttcattcctcttagatctgtacctaggagtggaattgctgggttatatggtaagtgtgtgtttaatttttaagaaactgccaaagaatgttttaaagtgtcagtaccattataccttctcaatagcaatatatgagattccagtttcaccacattctcaacaatacttgttagtgtctatcttttattacagtcactctagtgaatgtacagtggttctccttttgcttttaatttaatttccctgatgtctaatgacaattgatggcatatacttattaaacattcacagatctcctttgatgaaatgcctattcaaatattttgcttataattggtttatgttctcattattgagttgtaagagctctttatatagtatagatacaagtcctttatcagttctgcccataatgaattctctcagactttgtttatctgggaatagccttattttgccttcattttcaaaggacagttttactgcatgtagaattattggttaccttttttcatctttcagcattttttttttttgagacagagtcttgctctgtcaccaaggctggagtgcagtggcctaatctcagctcactgcaacctctgttcccaggttcaagcaattctcctgcctcagcctcctgagtagctgggactacaggtgtgtgccactacgctcagctaatttttgtatttttagtagagacggggtttcatcatgttggtcaggctggtctcaaactcctgacctcaagtgatctgccctccttggcctcccaaagtgctgggattacaggcgtgagccaccatgcctggccctctcagcattttgaatgttactccactacctacagcctccattgtttcagacaaaaagagcattaattgtattgatgctctactgtacataagaggcttttttctgttgtttctttctagatttttctatcctgtcttctcttttttgtttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtggtgaacatatttataagaggtcttttgaagttctcatccagcaagtccaatatatggggacatccagaaactttattgattgctttgtttttcctgagcacatctcacttttctgtttctctctaattttttgttcaaaactcacattttacataatatattgtagcaactatggattctggtgtttttcctctgatggttggtgttgttgctgtttttctttgtttgtttgtttgtttggtagtttctttgtttattaacttgcctgatctaaatatgtgaattatgtctcccacatcgtgtgtagcccccgatgtctgtgctcagtttttaaattcttgttttttatttttaagcatggctttctattggttcttttctctgtctgtgtagtttagtgtacagaggctgtgaccaaacatcttgtgccattaaggctactatcttctgttggtgggtctgtgtttggtagagttgctcattcagggtttaagctattttcaagtctgccctggctattactttctactgggccatcttacatcatatgtgttctctgtaagttttagttgttatgattattatgactgtatattctttcctctcagcagttgtaccaaaggcttttttgctctccagtagctctcctttctagcttcttcaatctcagcaggtgaccctccttcttgctttctgaaaagatgtcggccacacagtatagaacccatgacttccgatttcattttttttattgagatataatttacctaaggtaaaattcaccattcagagtacacagctctgtgtgactgttagtataatcacaaagatgtacaactaccatcactgtctgattccagaatgttttcatcacccagaaataaaccctgtgcccattagcaatctcttctcatttctgtttcccaccaactcctggataccagaagttgtagcatgaatcattgcttcattccttttcattgctgaataatagtccattataagggtagatcatatttggtttatctgtttatcacttgatggacattggattggttccacattttttctgttgtggataatgctgctatgaacttttgcatacaaattttagtgcagacatctttttggttctcttgggtttacacctccccactttatattttatttaatgtaaagtatatattataataatgttgttacttacttctcattgttgaagaattaccttctacgccatgaagaattcttaaattttattcccactctctatcaccacttgcaggaccttgctccaacaatatcactcctcatcagtatctctcttcttgctcccacagtatctctccttaccagtcatttcatcttctcctctgagtccatgctgttagtctacaaacatgatctgatatgtttgatcccaagccttcagttacctttaacacttcccatcattcttcttatctaattggttgccaaatctggccaattttatcttcaaattaattttgaaaattattttgtactcctcttccacattcctaccagtcaaatcactctctatgccccagattagacacagttactcttttctctatagcactttgtactttgtgatggcacttagtgtcttgtggaatagtcatttttgttttagttgtaatttgttaatttcctcctggctgcaagaataatcttttattcttactcattcttgcatccccagagcagcctagcattggatcagagcaaaggagtagcactcaaaacatcataacatctgcagattgtggtttaatttggactttcaaatttattatttctcatggtctctctcctttccatccttcatctctctccctccttctcttactaccattgtatataaaactaatttctatttatatgtatcttgaatggtgtaaggtcagagataaccagtttcacacatgtttgtgtctttccacagtgtcagacttttattgatgctatttcaatcacaaaatccatgagccacatggagttcccaaggaggcaattctccttcgtacttcccattcactcggaagtcagagccatgccacagaggcacaagccactccataagtcagtcaatattgcaaaccacacaaaacagtacatttcatctatatatatatgttacagattgaacattccacaacaaacaaattaacatttaacatcaagagaaagaggataggaaaaggggttaatgaaccagtctaggaagacagatatagacaaaaagaatgtcctggtctggaccagctggtttgtcaattttgcaaggaaaagtctcatgtgggcagagcctttggtggcagatgctgggtgcttatcacgagtgaaagcaagacggtgtcagttaagacagccatttggagctgctgaagtcctgctccttttatggccacagagtcctctggtgaggactgatagtggaaaagtatgcctatgtccttatctggttggttgcagtctttatttattaagcaaaacatcttgaccctcttaaaaaagtgccctatgaaatgtaagatggagtctttttctaagatggagttacttatgttaagggcgctctgtacaatatatgcttgacatatgttaggcactcaataaaaagctgttggttaacgcaataaaaaatggtaaaggagatatcaccaccgattccacagaaatacaaactaccatcagagaatactataaacacctctacacaaataaaccaaaaatctagaagaaatggataaattcttggacacatacaccctcccaagactaaaccaggaagaagttgaatccctgaatagaccaataacaggctctgaaattgaggcaataattaatagcctaccagccaaaaaaagtccaggaccagacagattcacagctgaattctaccagaggtacaaggaggagctggtaccattccttctgaaactattccaatcagtagaaaaagagggaatcctccctaactcattttatgaggccaacatcatcctgataccaaagcctggcagagacacaacaaaaaaaaagagaattttagaccaatatccctgatgaacattgatgcaaaaatcctcaataaaatactggcaaaccgaatccagcagcacatcaaaaagcttatccaccatgatcaactgggcttcatccctggtatgcaaggctggttcaacatatgcaaatcaatgaacgtaatccagcatataaacagtcccaaagacaaaaaccacatgattatctcagtagatgcagaaaaggcctttgacaaaattcaacagcccttcatgctaaaaactctcaataaattaggtattgatgggatgtatctcaaaataataagaactatttatgacaatcccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcgtctcagcccaaaatgtccttaagctcataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcaaggaaataaaagaggacacaaacaaatggaagagcattctatgctcatggataggaagaatcaatattgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaggctggaggcatcacgctacctgacatcaaactatactacaaggctacagtaaccaaaacagcatggtactggtaccaaaacagagatatagaccaatggaacagaacagggccctcagaaataataccacacatctacaaccatctgatctttgacaaacctgacaaaaaccagaaatggggaagggattccctatttaataaatgctgttgggaaaactggctagccatatgtagaaagctgaaactggatcccttccttacaccttatacaaaaattaattcaagatggattaaagacatacatgttagacctaaaaccataaaaaccctagaagaaaacctagacaataccattcaggacataagcatgggcaaggacttcatgactaaaacaccaaaagcaatgacaacaaaagccaaaattgacaaatgggatctaattaaactcaagagcttctgcacagcaaaagaaactaccatcagagtgaacaggcaacctacagaataggagaaaatttttgcaatctacccatctgacaaagggctaatatccagaatctacaaagaactcaacaaatttacaagaaaaacaaacaaccccatcaacaagtaggcaaagtatatgaacagacacttctcaaaagaagacatttatgcagccaaaaaacacatgaaaaaatgctcatcatcactggccatcagagaaatgcaaatgaaaaccacaatgagataccatctcacaccagttagaatggcgatcattaaaaagtcaggaaacaacaggtgctggagaggatgtggagaaataggaatacttttacactgttggtgggactgtaaactagttcaaccattgtggaagacagtgtggcgagtcctcagggatctagaactagaaataccatttgacccagccatcccattactgggtatatacccaaaggattataaatcgtgctgctataaagacacatgcacatgtatgtttattgtggcactattcacaatagcaaagacttggaaccaacccaaatgtccaacaatgatagactggattaagaaaatgtggcacatacacaccatggaatactatgcagccataaaaaatgatgagtgcatgtcctttgtagggacatggatgaagctggaaaccatcattctcagcaaactatcgcaaggacagaaaccaaacactgcatgttctcactcataggtgggaattgaacaatgagtacacttggacacaggaagaggaacatcacacatgagggcctgttgtggggtggggggaggggggagggatagcattaggagatatacctaatgtaaatgatgagttaatgggtgcagcacaccaacatggcacatgtatacatatgtaacaaagctgcacgttgtgcacatgtaccctggaacttaaagtatagtaataaaaaaaaaaagaaaaaaaaagttgttggttaaatagtctctgctaaatttgcgacacatcttcccagataagattcttctctccgaacctttttttttttcctttttttttttacacagagtctcactctgccatccaggctggagtgtagtggctcgctgcaacttctgcctcccaggttcaagtgattctcctgcctcagcctcccaagtagctgggactacaggtgcatgccaccacgcccagctaatttttgtatttttaggagagacagtgtttcaccatgttgaccaggctggtctcgaactcctgacctcagttgatccacccaccttgacctcccaaagtgctaggattacgggcatgagccaccgcacctggcctctctgaacttttttaccagtatttattttaattttggttgggggcagtagagagatgcagaaaaggaaaggaaggcatgaaactgcttgagaaatacatcagtgaataaaagttttttaacatttgtggtgtaatgacaaatcctggagaagttttagttcacacctggagtattccagcagaagttggatgccagccgctaggcattcattctgcagaggggcttctctgttaggtacaaggttgggttcaagtaccttctgaagtctagctcagtgtattttttggagtgtagtatactaacaggcaagaacaagaagtggaggagatgtgccaggggaggaatagtgatgacgttgtaggtgctcagctcccagatgatgggaaaagtgtttcatggcctcacacatcttttgggttttttgttgactgtctcccccattactcaatgagctgctacagcatagggaatgaatcttcaacttgtatttccagtacccagaacagaggcttgtactaagaaggcattcaattggtatgtaatggattagaataagttgaattgaagattgaactgaagtcaaaatctgatttctaaggttccttctggcctgaaaattcagactcctctgatttcaaccataacagcctggctaagcctccttgagagaaaccctgtgcttccttagtttaaccacctctttgtggttgaatagtataggttttcaatcaagtcctaggagggtgtcagtttcttgttgtacttaccaggatgtgataggatttcaaacaaggcccaaaagaatgtattttcaggagttgagatgtagccacactttctacatttacaatggcctgaaatgggttacagtttagaacaagctttcttctttatgatgcacaggatttctatgatgggtggctgttaggcaatgagtgtgatgggggagcattttcaatcttagctcaccttagcacaccttagcacaggactctagttacagggtcataattccccatgaggttagcccctgtagtatcagctactttgtatgtgatttaagccagtactgattattctcctgcttagggagaagcggtagaaggcccttggaactgtgagttttgcattccaacttgctaattcaacatagatcctaattccttaaatgcttgtaattagaaattctcgtgaactgtattggtttttgtcaagcaatctgtttggggaacttgaccaactggggcactgctggctagggtgaaatttatttaatttgtttttatgacattcttcatcttggaaatggggttttcaaatattgctttcccaggcatcattacttatttgctggtttttatttcaggattgggactagctcagggtgccagggaagcgttttgtggtgctctatattagagtcgtaatatccaagaaaattgtctgattgtatgtggtatcttggatgtggtaccttatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaatctctgttcactttagaattcacattgaacatgagctgatccaattgctacagccttggcagtgatagaggcaggagacagccaaatccctaggcagatagggaaaggtccccggagaatctccgacctgccccacaagtgttgacaccagatgttttgtgcagataagggaacctgcacagggggcttgcctgggcatgcccacagcatactggaggcccactgggggaatgggatggagccactaggagttcacaccttatgcaggggtggagcctggcctcatcagttcttgtgtggtggccctggtattcaattgtgagggggaaacctgcttggaggacccctctccttactgagagctttcttttcacttaataaattctgccctcttcaccctttaatgtgtctgcatgcctaattcttcctagtcatgagacgagaacctggatttaactgagccagggagcagaaactcctgcatcagtagcaattttacaactgtttattaaggaatacatcttgcccgaggaggttttatattgtatccctcaaatggctattttcccctcctccgtttaaatatttttactcaagtggtttccttcttttggaatgccagtcaactccatctcctacttgatttccaagaccgtctcctccaagatgcctctcctgtctcccctttccatacaatagaatttatgggtttatcactgttagtaccaagggcttcatcatctgctctcttatgttccctgcttgtcaaggtgtagcttattgtagggttcaatgagctgctagccactgtcccatttgactagcagatgcttgagaaaagcaagtacacagtttggattcgatcctacagtgtcttacatagttcttggcacctgcatgtttgctctaggaacaaccttccttattataccgagctgatccttttgggcagcattcattgagtcaaatggcctgtgtgaaacggggtctgaccctaagtggacagagctgagaggttagagctgaaggactcaagccccagacttgctacagattagtagggtgacttccagttacttcagttttctgagtgtagtttcctcattttaagctttgtaaatattaatatctggcatacataatttgaaaaaatgctgtaaggattagaagaacgaatatacgtgcaaacctttaagaaattataagtgcaaacacacgtagtacatttccatttttagagcttcatttttttcttatctgtaaaatagacatgtaaatgcctacctttcttattgggttattgtgaggattaagtagaataacatatgtggaagtgcttagcaaataggaggtgtttaataaatgttgcctggatatgaattcccctctcgggactgtcctgatgtgaggcttttccagcccttgggggatgtgcatttaaatcaggctgcttgtaccttggattaggcaacttaaaaaaagtgtagccttgttagttccaacttctcagctataaaatgcagagtaattaaatttgctagtaaatgtttccaggcctttgaatggcagccaataaaaaggactaaatattattcttttagaattcatgtccttgatgtagaggaaatatcatatttacttacacatactcctgccttggctttttagaagaaaactaagaaaaatgttttcccctctacatttcccacttgaaggtgttatctgtattgaaacagcaatgacagctgccagcaaaggagtgtgatttttctttgccaaggtaaaccaagggttaacatcaaggagtgttggggcccctgctggtgggctggaaccagagctaattccttagcagtcactcactcttctgcctcttcagctgtctctcacccccctcccaccataaaggagtgggtgttccttcaggactgtgcactcgcctccctccctctatccctctttttcccacccacacatacttcccagaacctctccaccctgtggctgatttatctttcctgggaccaaaggcaataaagcctcaaaactaaaacttgcaaggaaagacaatcctaatggtaaacacctaacccgcaatgctgattacttgaaaataagctgttattctgtctccagatcacaaatagcctcacttaaagctctacccctgaaagaactactgaaagattcaggaaggtcaggagatccagattccaattaacttagcacctgatgcctgtgtaactctggatgggtctcagttctctagtagttgaggactggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacctgcattttggaagagaggtatttcaggatcttctcattactgaagcctctcattgtaggaccatggtcatttttaaatctcccacattgaaatgaccagttggcaaaaaccttcaattacaaaatctcttccaaagaggctgagttttttttttttcttggatcacttcacatccttttgaataccctgaggcagtatttttatgggctaacagcaaacagagtgtcgtgtagaaccaagtgtgtcccttcactttctccaccccctgcaaagtttgtgatcttcaaagcatgctggattttaaaataaaacatctacttctagtccaagcctttggctgtagactttgggcttaagtgtgtttttccacagaggtgttacatccccatttctatcagctaaggaaaatgaattcattcaaggtctcccctgccattcatcgaggctccccaagaggagctttccagaaagatctgtgccaattgtaaacttacaagatcctcagcccataacaaaatgcccagacaccttggctctgctgacacaggctgagagagataaaggaaacagctggctgaggtcctgacttttttttcacatttttttcactttttttttcacaaaggcccgctagcctttgcagactggggactttaagattgttcactacccatccagcagggctgggcatacagataccaaagctccatctccagagacgtgaactctaaccaaggatcctcaaaccacttaaatcatgaacctgaaccttgaaatgaagcaaacattacatttaaactcccatgtttaaaatcagtttgcccttttcgctcactctttactctgggggatgcataaacaccttgggtgcctgctgtgacaatcaagttggcaatacatgccacctgctggaaccatagtctccaatctgaactccttccccagctacctgtttcctgtcacaggccttggcattccctgtagcttcattgcttacctcatagaatcatgcttctcattagagagtattcaacagcttcttgtcactggggggtgcacttcatttcctctactcttggacttctgctctacttggacttcatactcttggctgtctctgaggtagaggcagagagaacatccctgactctctgctgcccattttctgccatgggccgccccccccttccagaggaggaggtgttggggaacctctcccacatggcagaacaaccactcaagtctggggaggtctttggcagtcatcttgggccagatgttgtgctagaccaagactgagctgggatttgggttttctattctcacatagccagttggaaagggtggaaacacatgtgggggtcccaaggaaccatgagagacttctcatcattactgcggagtttgactatgatctggcatcctgggctgttgtgtggaggtctctatcatgaccgacctctttggcttctcttgtgccctaaggaaggtgttttttttgctagttttgttttatgtttttagactgagtcttgctcttttgccaggctggagtgcagtggcatgatctccactcactgcaacctcggcctcccgggttcaagcaattctcctgcctcagcctcctgagtagctgggactacaggtgtgtgccaccacacccagctaattttcgtatttttagtagagacggggtttcaccatgttggccaggatggcctcaatctcttgacctcgtgatccgcctgcctcagcctcccaaagtgctgagattacaggagtgagccaccatgcccagccggaaggtgttttaaaattgaaacaaagttgcatagttggttgtgttaattgattcaaaatctttcttttttgcaggggcagctctaggccaaattcttcttgcaagtttttatggatcacatgtttgtctaaagtacacacagatcattcccaaggccagagcaggaatgctctggaagtgccctctctgatctagggcaagcctgtagtttcagggttatcgatagacctcgcggagggcagtgtacaaggcctctggctgcatgaagagaaatctggtgtgtgggactgctctcagaagcagagaggtgtagaaggctgtcaaatgcataaagacaatgtctcttcacttggaggacaatttgtctgccaaggggacggtgagatttggcttcatctcttaagaacctgcattgagggctgctcacaatttcacccgaggtccagggcaattctctcctctccagatcccatatctagtgcttgttgctgctcattcagtatatggatacttctattcttaacaagttcataagtttgtttaaccgatgactgctcatgtctttaaagccattcattcattcatccattcattctctccctcccttgtcaatcaacaaatgtgttttgaaattaagtctatgctggaatttagtgattaataagacccagatccaccaaactatgagcttcctaagagcagggagtgcatatttcatttatgcatacacagtgctgggcatatgatttccataaatatgaatggatgcttcaggcaaatgcactttaatgaagtttgccacagaggcatctaattctcaaaccaaatgctggtattttaatatcttttcataaccagaggtctgagggcatgggaaaattgctgggaaggagggctctggaataacatgatattaagatagatgcatgagtgatgacccaaagcttcttgttgtcacccatagaataacttagtttcctgtcttccctggaagaaatgtaagaggatgtgtggggctagaaagagcaacaagcttatatcacccatatagtagaaaaggagtgagtggagcatcgagcctgatcctgtgcatttacagtagcagtaatagagtaaaacagagcaattagtgcctcatgtagacttggcattgagcaccccatcgcaaaatagccatgttacatatttcagtgtttaccagtgacaacgttttcctcttctttatgatttttggttcctgagatgtttaactggccttaatgcagttttgagagattgcaggaagtgatgggctgggttgggaatggctgggcattcaagtgatttagccatgggactcagcagtgcattgcttttactcctgaaggactcttggaagaaagctctgggcctctgcagagctttgatcagcttgttcagaaagagagcgttttatcgattttatcatggttacctttttttattgttaaaagtgtctatgttgtaaggcctctttgtgtgataaaattctgaaatgatctcacattgatttattttttcctgctttcaaaacacagcaatcttggtagtttcttagtatcccaaagggataaggagtcagcttctcaataaaccttttctggttatgaacactgtatgtattaaataataagcaagccttacagagtttatatgatcacattaagggatctgttaaattccaagagttattgttatgtgtgcaaaatactacagaagcacttgattttgttccagaagcactctgctgggaatgagtgcatattggttctagtgactctgccagtaattagctgtgacctttggtaagtcacttctcctccattccctcttgcatcctgatctgtaaaacgaggagtctcttagtcccttctaagtccctcaccagctttaacattctgaggcttaaaaaagctcataggagacaggctgttctttgcaatattttccatacaggtagtataaacaagtggagaggtaattgaaagactgactttcaaaatctagtacaaggaccttatttatatgggattttaaactgatatcttgagtcggactatgaatgactacgactatcaatcagttatctgcaccaataaaggacaaccgatgtgaatcatttggagatcttcctactcccagtagatgcaggtttcgtgccccagaataatactggaatgtgctcatgtctttagcacataccaactaatcttggtgagaagtgaccccctaaaaaggtgttggaaggcaagggaacacagtggctagagcttaacacatttgttggaaagaagagcatttttacactgctgacaatatgaggactatttgttttcttattttattattatacttttaagtattaagatacatgtgcggaacgttcaggtttgttacatatgtatacacatgccatggtggtttgctgcacttatcaacccgtcatctacattagatatttctcctaataatatccctcccctagcccctcactcccccaacaggcccccgtgagttatgttcccctccctgagtccatgagttctcattgttcacctcccatttatgagtgagaatatgtggtgtttggttttctgttcctgtgttagttcgctgagaatgatggtttccaacttcatccatgtccctgcaaagaacatgaaatcatcctttttctggctgcatagtattccatggtgtatatgtgccacattttctttatccagtctgtcattgatgggcatttgggttggttccaaaactttgctattgtgaacagtgctgcaataaacatacgtgtgcatgtgtctttatagtagaatgatttattaccctttgggtatatacccagtaatgggattgctgggtcaaatggtatttctggttctagatccttgaggaattgccacactgtcttccacaatggttgaactaatttacactcccaccaacagtgcagtgtaaaagcattcctatttctccacatcctctccagcatctgttgtttcctgacgttttaatgatcaccattctaactgggcatgagatagtatctcgttgtggttttgatttgcatttctctaatgaccactgatgatgagctttttttcatatgtttgttggccacataaatgtcttctttggagaagtgtttgttcatatccttcacccactttttgatggggttgtttgtttttttcttgtaaatttaagttccttgtagattctggatattggccctttgtcagatgggtagattgcaaaaattttctcccaatctgtaggttgcctgtaggttgcctgttcactctgatgatagttttttttttgctgtgcacagctgtttagtttaattagattccgtttgtccattttggcttttgttgcagttgctttcggtcttttagtcatgaagtctttgcccatgccaatgcctgaatggtattgcctaggttttcttctagggattttatggttttaggtcttatgtttaagtctttaatccatcttgagttaatttttgtataaggtgtaaggaaggggcccagtttcagttttctgcatgtggctagctgttttcccaataccatttattaaataggaaatcctttccccattgcttgtttttgatagttttgtcaaaatcagatggctgtagatgtgtggtattatttctgaggcctctgttctgttccattggtcaatttatctgttttggtaccagtactatgctgttttggttactctagccttatagtatagtttgaagtcaggtagcgtgatgcctccagctttgttctttttgcttaggattgtcttggctacatgggctctttttttgttccatatgaacttgaaagtagttttttccaattctgtgaagaaagccaatggtagcttgatggggatagcattgaatctataaattacttcgggcagtatggccattttcatgatattcattcttcctatccatgaaaattgaatatttttccatttgtttgtgtcctctcttatttccttgaacagtggtttgtagttctccttgaagaggtccttcacatcccttataagttggattcctaggtattttattctctttgtagcaattgtgaatgggagttcactcatgatttggctctctgcttgtctattattggtgtataggaatgcttgtgatttttacacattgattttgtatcctgagactttgctgaagttgtttattagcttaaggagattttgggctgagacgatggggttttctagatatacaatcatgtcatctgcaaacagagacaattcgacttcctctcttcctatttgaataccctttatttctttctcttgcctgatttccctggccagaacttccaatactatgttgaatagaagtgttgagagagggcatccttgtcttgtgccagttttcagagggaatccttccagcttttgcccattcattatgatattggctgtgggtttgtactaaatagctcttgttattttgagatacattccatcaatacctagtttattgagagtttttagcatgaaggcatgttgaattttatcaaaggccttttctgcatgtattgagataatcatgtggtttttgtcattggttctctttttgtgatggattacgtttattgatttgcatatgttgaaccagccttgcttcccaggaatgaagctgacttgatcatggtggataagctttttgatgtgctgctggattcggtttgccagtatttcattgaggattttcacgtcaatgttcataaaggatattggcctgaaattttctttttttgttgtgtctctgccaggttttggtatcaggttgatgctggcctcataaaatgagttagggaggcgtccctctttttctattgattggaatagtttcagaaggaatagtaccagctcttctttgtacctctggtagaattcagctgtgaacccatctggtccttcgttggtaggctattactgcctcaatttcagaacttgttattggcctattcagggatttgacttcttcctggtttactcttgggagggtgtatgtgtccaggaatttacccatttcttctagattttctagtttatttgcatagaggtgtttatagtattctctgatggtagtttgtatttctttgggatccgtgatgatatcccattgatcattttattgtgtctatttgattcttctctcttttcttctttattagtctggctagccttctatctattttgttagtctttaaaaaaaaaatacctcctggattcattgattttttgaagggtttttcgtctctctatctccttcagttctgctctgatgttagttatttcttgtcttctgctaggttttgaatttgtttgctcttgcttctctagttctgttaattgtgatgttagggtgtctattttagatctttcccagtttctcctgtgggcatttagtgctataaatttccttctaaacactgctttagctgtgtcccagagattctggtatgtagtgtctttgttctcgtcggtttcaaagaacttatttatttctgccttaatttcgttatttactcagtagtcattcaggagcaggttgtttagtttccatgtagtcatgaggttttgagtaaggttcttaatcctgaattctaatttgattgcactgtggtctgagagactgtttgttatgatttctgttcttttgcatttgctgaggaatgttttacttccaattatgtggtcagttttagaataagtgccatgtggtgctgagaagaatgtatattctgttgatttggggtggagaattctgtagatgtctgttaggtccacttggtccagagctgagctcaagtcctgaatatccttgataattttttgtcttgctgatctaatattgacagtgaggtgttaaagtctcccactattattgtgttggagtctaagtttcttcataggtctctaagaacttgctatatgaatctgggtgctcatgtactgggtacacgtatatttaggatagttagctcttcttgttgcattgatccctttatcattatgtaatgcccttctttgtctttttgatctttgttggtttaaagtctgtttcatctgagactaggattgcaaccctttctttgttttactttccatttacttggtaaacctttctccatccctttattttgagcctatttgtgtctttgcacatgagatgggactcctgaatacagcacactgatgggtcttgactctttatccaatttgccagtctttgtcttttaattagggcatttagcccatttacatttaaggttaatattgttatgtgtgaatttgatcctttcattatgatgctagctggttatttttcctgttagttgatgcagtttcttcatagtgtcgatggtctttacaattttgtatgtttttgcagtgactggtactggttattcctttccatgttagtgcttccttcaggcgctgttgtaaggcagcctattggtgacaaaatctctcagcatttgctcgtctgtaaaggattttatttctcctttgcttatgaagctcagtttcgctggatatgaaattctgggttgaaaattgttttcttataatcaatagcttaccaaccaaaaacagttcaggaccagatggattcacagccgaattctaccagaggtacaaggaggaactggtaccattccttctgaaactattccaatcagtagaaaaagagggaatcctccctaactcattctatgaggccagcgtcatcctgataccaaagccgggcaaagacacaacgaaaaaagagaattttagaccaatatccttgatgaacattgatgcaaaaatcctcaataaaatactggcaaaccgaatccagcagcacatcaaaaagcttatccaccatgatcaagtgggcttcatccctggtatgcaaggctggttcaatatatgcaaatcaataaatgtaatccagcatataaacagaagcaaagacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatgtccttaagctcataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgctatctacaactatctgatctttgacaaacctcagaaaaacaaacaatggggaaaggattccctatttaataaatggtgctgggaaaactggctagccttatgtagaaagatgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaactgcaacaaaagccaaaattgacaaatgggatctaattaaactcaagagcttctgcacagaaaaagaaattaccatcagagtgaacaggcaacctacaaaatgggagaaaattttcgcaacctgctcatctgacaaagggctaatatccagaatctacaatgaactcaaacaaatttacaagaaaaaaaacaaacaaccccatcaaaaagtgggcgaaggacatgaacagacacttctcaaaagaagacatttatccagccaaaaaacacatgaaataatgctcaccatcactggccatcagagaaatgccaatcaaaaccacaatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggataaagaaaatgtggcacatatacaccatggaatactatgcagccataaaaaatgatgagttcatgtcctttgtagggacatggatgaaattggaaatcatcattctcagtaaactaccgcaaaaacagaaaaccaaacaccgcatattctcactcataggtgggaattgaacaatgagatcacgtggacacaggaaggggaacatcacactctggggactgttgtggggtggggggaggggggagggatagcattgggagatatacctcatgctggatgacgagttagtgggtgcagcgcaccagcatgacacatgtatacatatgtaagtaagctgcacatggtgcacatgtaccctaaaatttaaagtataataataataaaaaaaattgttttctttaagaatgttgaatattggcccccattctcttctggcttgtagggtttctgcagagagatctgctgttagtctgatgggcttccgttgatgggtaacgcgacctttctttctggctgcccttaacatttttttccttcatttcaaccttggtgaatctgatgattacgtgtcttagggttgctcttctggaggtgtatctttgtggtgttctctgtatttcctcaatttgaatgttggcctgtcttgctaggtcggggacgttctcctggaaaatatcctgaagagtgttttacaacttggttccattcttcccatcaatttcaagtacaccgatcaagtgtaggtttggtcttttcacatagtcccatatttcttggaggttttgtttgttccttttcattcttttctttttttttccaatcttgtcttcacactttatttcattaagttgattttcaatctctgatatcctttcttctgcttgatcaatttggctgtttatacttgtgtatccttcgtgaagttctcatgctgtgttttcagctccatcaggtcatttatgttcttctccaaactggttattctagttagcaattcctctaaccttttttcaaggttcttagtttccttgtgttgggttagaatgtgctcctttagcttgaaggagtttgttattacccaccttctgaagcctacttctgtcaattcgtccatgtcattctccttccatttttgttcccttgctcgcgaggagttgtgatcctttggaggtgaagaggcgtgctggtttttggaattttcagccgttttgtgatggtttttcctcatcttcatgaatttatctacctttggtctttgatgttggtgagcttcatatggggtttctctgtggatgtcctttttgttgatgttgatgctattcttttctgtttgttagttttccttctgacagtcaggcccctctgctgcaggcctgctggagtttgctggaggtccagtccagaccctgtttgcctgggtatcatcagcggaggctgcagaacagcaaagattgctgcccgttcattcttgagtaatgtttagcaggcatagtaagccttcttcaatatttaattgtctgcatactgatggatatttttagggatgaagataagtggttcttgtttgcagtggatacgatgcttatgaggaaagaagagctctttttaaatagagtctcttgggtagaaactcccttgattaagttcctgaagtcttttactttgctgatcctcaattcagtttcatcagctcacccagagtttatcaaactttggaggaatgattttaagaaccaaatatggccagatgcagtggctcatgcctataatccgagcagtttgggaggccaaggcaggaggatcacttgaggcaaggagtttgagaccagcctgggcaacacagtgaaaccccgtctcaaaaaaaaaaaaaaaattaagttagctgggtgtgtcactgtgcgcctgcagtcccagctactcgggaggctgagttgggaggatcacttaagcccaggaattgggggctgcagtgagccatgattgtgccactgcccttgagcctgggcaacagcgtgagactctgtctctttaaataaataaatatgtaataaaagtggaaaaaacaggcaaatgtataagtcactgatctataactctaacgtgatagtttgtttatttactaattatattgccaactgacactgattgctcagacccttaagaggcactcttgtgtgaggatttcactcaagacaccaaattacagacagtgaatgttccatggagaacagagttgaaatacttccatgcatattgtctctgagaaaaccacctcttttccaggagaggttgttctgcagagggtgccagatcccaatcctgaagaatccaaacaccttttgaaattgtattctggggctgaggccctgcttgttcaccttgatcagacaggtgaatttcctcagcttcctcagccattgatttctaaatgatctcttactttgaggtgcagataagctttcttgatgtagatcctttccattttccttgtaggtacttcgtggttcaaactttcactactgcaactacggttaccataaagtgattactatgtgctagattgtgtactaagtgctttccatgaaatatttagttgtcacggcaaccctacacaggtctggccaataaacatttctgcaatgatggaaatgttttataatactagcaccacctaactctggtagccattaacacatgtgaatattgagcattgaaaatgtttctagtgtgactaagaaactaaagttttaattttgtttagttttgattaattaaaatgtaaatagctagtgtggccagtagctatggtattgacatgatgcagatacaagtactttgattctcatattacatgtagagaagctacagttcaaagaaattaaataattttctcaaggtcacagaacttgcaaatggcagagcaaggatttgattttgaagtcagtgtccttatccctatagtgtatggccactatttagactgtgcctgctctttttgtatccaaatttgttaagaaacacctctggtacatttgcaattaaccattgaaagaaataaaactgataattatacaataaaggacaacagtcattaaaacagcactaccctggtcccaaaatagaagtatggctaatggaacagaagaaaaaatgtacaggtatgaaaatagatgttcttgtgttatatttatattcttatattactgtgatgaactgagcatcacaaaagaataagaaaggaagagctatttaactaatgacttgggaaaaactggttatcaattaaacattcataagctcccaacctagtatattgtatgaaaatatatttcaaatggcataagattcaattattaaagaacaaacttgtttaaaaaatcaaatcacaagaaacagcagaaaattcatttaagaaaccatctgttccatggtaagttctgaagaaatcatgaaggaaaaaattacagatttgactgcttaagaaataaagactaatgaacaataaaaatatacatagaataaaaaggataacagatttggggaatatttgcaacgaataagaaagacaagggtgataattacattatcaataagaaaaccttaagatacccgggaaagttaatggaaaagaacgtgaacagacagttcacacaccagggaatataactagtgattgagcttatggggaatagttgaattagggcttttcaaagaggtacaaattaagtgatgacaagatagcatcttatgccttttgaattagcaaacatttaagaaaatagtaattctttgtgttgaagataaggcagaaaactgctgtatatgctgcctgcggcagctaaaattactctgatttaggaagcaaatttgatgaagtaatcaagaaccataaaaatgttcattcagtctgacttaataatccgcccctgaaaatttatctgagaaaaaaatcctaaggaaaattcacctccttttaccatcaaacctttaaagtagaggaaaggccatatattaaataatgtgaagattttaatttatagagttagccctaataaggaaaggaagggaagcaatctaaaatgctgagtcattggtgaaggccattaaatatattatgacacatatactctgtagaatattatgcatctgttaaagtgataattatggccactgtgtagcaacatggaaaatgtttataatggcaaacgaaaaacagcaggatacacatttgtatcttgtctaaaatttcaatcctgtcgaaagatacacatgagggccaggtggtggctcatgcctgtaatcccagcacttagggaggccaaggcaggcagatcacttgaggtcaggagttcaagaccagcctggccaacatggtgaaaccccttctctactaaaaaaatacaaaaattagctgggtgtggtggcatactatgactgtaatcccagctacttgcgaggctgaggcaggaaaatcacttgaacctgtgaaatggaggttgtggtgagccgagattgcaccactgcactccagcctgggtgacacagcaagactccatgtccaaaaaaaaaaaaaaaaaaaaaaaaaaagatacacatgcctaaggacccagactggaagggaactcaaggcaaacaaaaacagttggtatgttagggtcatgggacttgtttttatttttatttacctttgtcctattttctcaataaactcaaactagaaatggaaacacagtcacagaaatgaaggatattcataaagcattgtttcctgttggaagctgccttttattctcctttgccctcagacatgtactcctcattttgatgagcagcaagtgatcagaattatccagccttcagtcaaacataatctgtagaagaaagcactgctttatgcaaggagatttactgtgtgatggttggcaaaagaaaggatgcacaaagactctgtgtgggcagatttagcagaggtactgaaagtgaaaggagaggccatctggtagaatgtgctgtggcaaattaaactgagttttatgaacatgaaataccagaagaaaatccaaatgccctggacttggaaaaagcccatctgaggcaccataaaaccaatcaactacagactgacaatatgccactcataagctcagatatgcccattactagggacagcatcattcaagccagattttgcagagctcatttgatgtggatttcccgtaggggaaaaaatcaacaaattacccaccgtgtcccccacacatgcgcagatgcctgatacagagctactgtttcaataaatatggtaaatgcataatgatctggaaggcattggtttggcttctcctgcctcacattcattagtgaactctgacacccaaaccagacaactagacttgggtatggatataaggagccatttttccctccctccctccctcctttccctgcttgcctttctcttttccctcccaattattttcattctttcctctcccctccctccatctctccctccttctctcccttccttccctctgtccctccctccctcacttccttccttctttccttcctttgtttctctctccctcccttcctccctcccttccttcctttctttctcgctccctcccttcctccctcccttcctgccttcttttcttcattctttctttcctgtccctccctccctccctcttcctcccttccttccttccctccttcctctgactctctccttccctccctttctttcctcccctcctcttttcttttcttcttttcctaagcagttcatatccctatcctttagcctgtatgtctggaattctttatagttccactacacttgccccctcattttgtcctaatgttcctccaattctccatttcctctttatttttactctggggctctttcgagtgcatgtatcctgcatattcagctacttctgcttttcctcacctttaatgctttgattgcttccattagagtgttgataattctgtcatgatccttgtctgtatatagttcttccttatatttcaagtccctttatgatagctctgctacaagtgtgttttcaatggcactgtagttctgctgtggctttggggctgctttggttttctttggaaggagatagctacatgggtagcttgattgaggaagggcacaaaagcagtctaagtgtttgaaggactgtctctgggaagaggagcttagctattcccatgtggctagaaagggcacaacaaatcccactgggaggtgtacttagactctgtaaaaggaagcacattctaatatagcaggtcaaagactgaatgggctatttccagggccgacatatctgggtgttcagtttgtgcattgtacaaagacacctggccgagaaaatgaatgggagctgaaatgcagcccgtgctttgctcactaagccctgtgctctggagtgaggccatgccgacctagaagaacgggtgccaagataagttaccttttgatattccacataaagacaccagtatgtgctagtggtagccctagctatcccaggaggggatattgtctactgttgcagaacaagggagagaatagatgaacttgtgtgctagaggaagtgcttgcctcttctccaccatctccacatttcctggatgtgctttgattctattgcactgccaaacaatccctttttctaaacttgtctgtgccaatcttgtgtcttcttatctcacatatgctaacaacatccacattaagactctcaacttccccgagatggataggtgccatcacataccgtgctggattgaattctcatttcagagaatacatcttctttctacttttcaatgaggatcagcatcccattcttgcccaccacctagtactttgttaggaacacaggaggtaaggcaaactgaaagcactttgaaaactgtgaagaattttttcatcaatatcattagacaagatcctgttacaccaggaagtcaagaggctttactggcatttagtgcctcttgtttcaccatcaagattccctgtctacaacagttcatagctgagtctctattcatcaaactttctgcagggttgacatacacaccatttatttggctctcagtgtataacatttggtggtgagtcaccctttcctgtgtacatcttgtttaccccagatagactgtaagctcctggaccaattcaggaaaccacatactggtttcctggtatggaaaggaaatgttttatttcagaaagtcacttctctccatgagcaaagaacagtgagggtcattttaaactgttgtagctgaattccaaatggcaactgagatggtcccaagatttgggccatgtcaatttagggagtaggtaattaaaggcagtccaacaatttcacaaatttatagttaggtgccatgccgtgcactgtcttggaattcctcacaaggacattgtgtaatgtatactttttgaattcaattgaatttatccttccttccacctttcctcccttccttcaacaaatattcattgagactgtactatgtttcagtctttgttccaatgaacctaaacagacaaaagtctgtgccgtcatggaactttctattcttgtccagatctgccatttactagttgtgtgtagactcaaccaaatcacttccttctccggaccaagtgtgttcttctgtgtacactgaaggtttcacagatgtttccatttttccttcctattattttttctttaatcaacctccgtacttttaattgctttcttggttatctatttttgcctaatatccagtactgtaaggaaaataacaaggatgtactttttcttttcttttttttttctttttttttttgagacagagtctcactctgtcgcccaggctggagtgcagtggcgtgataacggctcactgcaacctctgcctcctgggttcaagcaattctccttcctcagcctcctgagtagctgggattacaggcgcccgccaccacacccagctaatttttgtatttttagtagaggcggggtttcaccatgttggtcaggttgatctcgaacccttgacctcgtgatccacccgccttggcctcccaaagtgctgggattacaggcgtgagccaccgcgcccggccgaggatgccctttttcaatggttcacctttgggtatttttatatctatgtttgcctagatcattcctttgttttgatatcatcaatttgtttagcccaaagataatggctgttgtatttccgtcttgagtgccaagctcacaatgagctgttactcagtttttgaagtattttctcccattataacatcaaccttctttcatttatttcctttagtcctctgtcctgagagcatcccccagagttatagccttggattctcaagctgcaggagattgcatgtttaaccatgataaatactcaggacaaaattgagcctttttttctctcataattttatttgtttaaatcttgactgcttatagtaaatatcctctcaaagataatttcatttccaaacaatttggtacctgatctgacgcagcttgagtgtttattttggggatgttgtttttcttttttaatgagttccccaaaatagcttttattgtttttacatctttcttttttttccccgggctatcagagggattgtagttagcattgctggaggattattagtttattaataataattatctcttaaatttcttttttggaagcagcatttggtcattattgaaaaaacagagcttttaaaaaatggaatgactttaaggaatctgaagaaaagataaatgtactcctgtatgatttttatagtgtttgcaatccagtgatcattctcacattgtttaagtttcagtttcaaggtgcgttgtccccctttatctgtggggaatgtgttccaagacccccggcggatgcctgaaaccctatatatactatgttctttcctacacatacttacctatgataaagtttaacttataaattaggcacagtaagattaacaacgacaacaataaaatagaacaattataataatatgctgtaataaaaattatatgaatgtagtctttttctctcagaatatcttatactgtgatcacgtatttcctgactgtgagtgaccatggctcactgaaaattgaaagtgaaaccacagataagggtggggactatgatagtaaggtaagattggtattaatatattgtctgagcaaggcaactaaatgtgttccttttggaatgcatactgttacaattcaggtttaattattaaacagcattggtctaagtggatgaaggttctgttttcgacccataatttaacacatgtcaagtttaaatgtacacagtaactcaaaaaacggcctgcctttggttgttgtttccaggatactgtgagcattgcaattagcaataaggaaagcactgaccaactcccggaaccacatctagttgcctggcatggaaaggaaatgcttttattttagaaagtcacttctctgcatgagcaaggaacagcgagagtcattttaaactattgtagttgaattccaaatggcaactgaggtggtcccaagatttgggccatgccaatgtagggagtagaggattaaacacagtccaacagttttacaaatttctagttggtgggtggctgggaactgtttattattgttaatgttactgaaaaatcacttgtttcgtgttaatacatcatcccttctccagtcctccagccccagtgaattttgtgttgatatagcaatgtgttcatagtgccactttactgaatcagttgttaaacaaatatttgtgccatacctactattttacagacattatgtcaggcactggggaatttatgttggtgaataaatagacatggttcctgctctcatgaaacttaaaatctggtctttttaagcaagctatttcacttttctgagagtcagtttcattatcttaaaataggcataatgcctatctggaaggattgtggtgagaataaaatgagactatgtctataaagcactggtgtgatgtttggcacatagaacatggtagaacctcaacaaatgatggctcttataatcattgtgagtgctggagagccccagtgctggtctatggattgaagagctatcgaagaggttcttgctgaaggttcaccccttggagtatctctactcaatccactgagtgggaagatttgaaggtaacaggctacgggggttgaacttttcccacatggacattttaaactcagttcaaatacatttgaatgagagagcaaagtacattaagcacagaatttctagaactcaccttgggaaatttaaagctgaccattttctctagcattttggaaattatcaaaaggccagacggaatgcacaattcacttcttggctgccaggagtgaaggagagaagaggtgaggttgaatgatttgaaattcagttcgtctgtgttagaacaagtcaaaacaattctagctgttaattttagttagttgagtccagagtaaaggtttgtaaagggcataagaaagcaacattacttttttctcacaatgagcacttaaaagatcttttaaaagtgtttctgtaatgtaaaagaaatagtcttactgcagtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgattcacttacaatcataatgtagggcttgatgtaaaacatgagaagacttgatgtttctgggtaacaatgggtgcagctcttgattattcatagtctgattatccttactggggagtatcctgtctcattttacttcttgttgtctgaatgcctaccttttacctttgtaaactccagatttaaagtttgtgtagggtggggtgcggtggctgacgcctgtaatctcagcactttgggaggctgaggcaggaggatcgcttgagcccaggaattcaagacaagcctgggcaacaaagcaagagaccatctctaaaaaaaaagaaaaaaaaaaaaaagccaggcaccctagcacacgcctgtagtcccagctactcaggaagctgattcaggaggattgcttgagcccaggagttggaggttgcagtgagctatgattgcatcactgcactccagtctgggtgacacagcaggagacactgtctcaaaacaagaacaaaaacaaattttgtttaaaactgaaaatggggggatagatggaaactattttactttttatcttaacagcttgtgcaggtagaacagtttaatgaggaaggagctgacactcttgcctatggtgtgttgggagattatagattttagttatccatgtttatgttgtaccccaggactacagattattggcagctggctataaacaaatgaccaaataaatctacagttgaagttacctagtgtctccaagatttcagggatgatcaaggacaggtagcagagcctggggccatcagctgtgtgttggcctcatctcattctgaacccctctcctactttaatcagaaccctgatacttaagggactgaactagctgtgacatccatttatccattttatagaatggctgtaggtaactacagggccataatcggaattctatacagggatgggtccctaggctcattaattgatgacagggtaggagaagactttgacacctacagattcattagagacagctgaatggatttattccaaggaggtcacctttgaaaacgcaatgaatttctatgggtggataacaatgcaaataggcaaggatgaagctttagatttaatctacatctgctgcaacaatgttctgatatagaattgtttagcccaagtcctaattgaaaaggtgagtaacattgatattgtctttctgaaatggattagaaatagggctggaaattggatgctaggaagagggacatataaggtttatgaggtaaaccccaataaatggaatttactatgattatattaaaaatagagacaatgtcatgtttatacagcgtgtaatatcatgcataatgtcaaatgccctttggagttactcctgtcccttgtactgataacatggcagttttttgagtcctagcatagggaaacagtgaaaatttccaggagtgcatcttttcaataatgcaaaggatacatatcagtgtttcacaaatttctctcttttttttaagagacagggtctcactctgttgcccaggctggagggcagtggtgcaatcagctcactgcagccttgaactcctgggctcaagcgatcctccctcctcagcctctggaatatttaaaactacaggcgtgcatcaccacacccagctaagttttaaagttttttgtagagacacggtcttgctgtgttgcccagactggtctggaactcctggcctcaagctattctttctccttagcctcccaaagtgctgggataatgggtgtgagccaccctgcctggcctcacaaccttttgaaaaagatcatcccctaaggaggaaattcaatttaaataatcctaatgagagaacttaaatactaaggaaaaagatttaggggaggaggattggatgtgaagggccacaatctactgtaatatctttttttttcactttccccccaaatcaattttcttccccttatggacaatatcacccttgttggaaatgcatgatatagatctgtgaagccagccaatttatgatgtgatatttaaattgtctctggttatggatattgtttccattgcccacattaaccctcaagaggagggcagtaatgccaattaagttcttgctatgtgttagatcctttccatgcattgtttaatttcacccttacaacaaccctgaagttgagaagttaagcgactttcccagactcatacagtggcaagtcaggggttgaacccaggcctttctgatgccagagactagaatatttctaacacttacttatcttacgggaggcattacaagatgtgtcttacatagaaaggacataatggtgggtgtttatttctgaagttgattttggagtctctggattgcattttggttaccctcaggtagaatagaaaagagaaacttgattaatactaaattttctcttttattctctccacccctctttaatggtttgtattgtgtttcttagtattatgtggaaataaccttagcttcttgatatgtgctgagatcctaggaactcagtgacttacagcacaggttggataaggttaatattatgttaataacacagattttatagctcttctactaatctttacatagattaatgcctctcaattttacaaaaaatagaccattaattgtgaagctggaagaggacaattcatggcagaaaatgttaggttagtagaacaatagtcatttacacaggattgttaaagaaagggaaaggtaaactgatgttcaacatctagtgcttgagaagttgctctgcacataaaatcaaaccaggcagctttgacctagctcttgggagagaatatatcaggttgtattgatgatgcattgatgagaatacatcagtgtgtatgatgtgggagcgtgtgtgtgtgtgtgtgtagatgtagaaaatagcattttcttatctggactttagacttcatagttaaagtaaattatgttcatacatctgtatgtgtagacttcctacctgtgctttaacgcctctatctccacctccatccctttcttctgtctccccagggggcaatggtgcaagtaaaccaaattcgaaatgcttggtcccagtgttgttagcagctgattcataggtgctcccctcattttagataagaagaaattgagatttgcaaaagtcacacaaactggagctcagattgcctgatttgtactggtatattgcactgtctgtcggccttcactctttctgactctctgcttcttagaaaaagagagtgtgggaaaatgtgctggcaccttcatctggtggccagagaccaattctaggccagaggtaagctttaaagagaataaaaagtgaggaaaattggctcaccagagcacgtcattatttacataataatacattgactacgatgtgggctttaaaagaaaaagaaaatgaaagtctttctcacaaaatactctaaaaataaactttttagggaacattataaaaccatacaatgtattttttcccaaacacaaagtcccactgaaatctgtctcttggttttttagatgccaaaagtcaactcatcttgatgtagaaaatgaggaggtgctgttagtgcatggagaaatagccttctgctaagaggtagttgacttagtttctaacttatgttttcgtttcatgctatgtgatcttggtcaaatcattttgcctctctggactttgatatccttttctgcaaaataaaagggttcaactggatgattttgaaagcacctctctcttctataagtctctgcaagtgggaagatgattagtttgtagtcttataatgtttagatggtttaacactgctatcttctagcttttctaaaagttttctgatgttgtcataggcagttttgtgtacaaaggtcatttgatggatgctaatgtacctttggttgataggaggttcgtaaaagaaatatgcatcaaaccttattattcgtgtattagataaagcagatctactgacattttaatgtcaccaagtaagtaatttataaagtcagtgtgccccactgaaacatttccaaagatatttactattgagtacttgggttctgctgagggtgaatactgaaatgtattctttttgtgctaatgtttgcagtacagtgtttcccagcagtcagaatgattgtctgatattgttagtgtaacccctgtgatctaacataggcttctgtgattataatgatttttatttgaaaaggtaattgtgtttgcctggcaacctccccacttgattttttttctgtatacacctctttctttggctctttaaaagccagcagtagagtatgtgtagttaaaataccttcttcttcttgcatccacgtttttgactgtgtctttgcattgccattggggggactggagagttaatatgctgtgttgcctaaaggaataaaagcaaaaattatctttgcaatcaaaatattaccagaaagaatttattaaaaattacaacagagagaaaaacggacattaaaaagagatttttatctttgtttgctttttgttttattggcttgccgagctttatcagtcattaatgatgaaggaaatagaagacctctccaaacctatgcatttgaattttgtccagttatcaagctttcccctgtgcacacccaattttttttactagctcaaggacaaagagatttttctcattttcccattttaagataagctatataggaatctgggtacatttgagtatgtgaggaaagatcaaggactctgtaagcatgcatctttccaatcatggcccttttagcaatttgcagtcattggaatgtgggagtttagggagagtgctgtttccagagttagacacttcggtaattccactactttagggtttcctgccacatgctgttggctttcagtaacaagtttcagtaaggattctcttggagtatgcatagaattttcttaacaatctgtgagtgattataagcagtatattctgggctcttgtgttttcgggagttaagagacctctcttttgcagtccccaagagtccatggcgctcatctatgaaaacggcccaagtgacagccagatgaatgtgtgctgagcgccactgaggctaagtgccaggaaagtagaaggcaccaccctgtggaagagggccaggaattctagaggacactactcctttgaacaaaaaggatgtggaaaacagttttctttgtttccttttgagttagctttgggcatgggctgatgccaagcttcgtcctatgacaggctcattgccatccatcctacccaggagggatgcatctctgagcatggagacagtgctgaggaaggcaggttggatggtgcttccttatctgattatcagacaagccatattttttcaaaggaacagtgagaacagatgatctttctgatctcgtgttaaatacagtactgggcatctttagcatatgtgctttaggttattgccttcttagcctgctcagaaaaaaaacacagcactggcagcattccgtttacttactcattagaatctaagggctggaagatcccttgaaagtcatctactccaccacccacccccatctgatgcaccagctgtttctacaaccaagtcgttatccttgcctatgcatgatgttctcaaagacacggcattagaacaccttccattgattgagttgaaatctttttcccattgctgtcatgcactgatgctagctgggcttcttggaaccatacaaaacaagtctaatgttcttctctatgccagcccttcggagctttatgtcacattccagtctcacccttcctttccatctcagctgcagtaaggttgattaacctgaattaaggaagacttgagggtggggtgagaagttgcacatctgttcctctgataacatggatttgattctccctctcccttttggtccctctgatagaaataggctctagttcttccatattcctcttaacaatgttcagatgtggtctcactagtgttgatgatctccgtctttatacttaactttgattcagcagtggagtccaagattctgttagttcttttggtgatctcaccatactagagattcctattcaacttgtacttgataaaaattttattattgtctgtgcttcctctaagccactggtgctcaaccggggtgatactgtcatcccccacaacgtccccaggacatttggcaatgtctggagacaattttgatttttatggcttgggggatggtatactactggcatctaatgggtagagtccagagatactgctaaccatccaacaaggatgcacaaaacagccccccatgacaaagaattatccagcccagaatgttaatagcatcaaggttacagaaccctgcttcaagccacttgtgtccatattccttccaaattttttctctgtactgtgaaggtagctttgttgactcaagtcaggatcttttgcttattcctatttaatttcatctggttagaaatcatacagctgtagtgtttcaagaccttcttggacttgatatatatcatcaacgaacatatctgcagtacctccagcttcatgcatgaacccctcttgcttctgatggactattaataccaaattcagggaactctcctcttaaccaaaagcaaattgttttcctagactggcatgggattccatggcaggtggactgatgatcattaggaggtgctgtgctcagttttttttcttttttacatttttggtactcccagacttccttagtagagagctggtgtgatctagaatggcatttgtatcttctcccacccaattagattagcaagagagagtttagccaagcaccactgctctgcaaatggagtctccaaatgccacatcagcagaaagaaaagtatctacactcataagagcatggggtagggggaaacaaggatgcataggttgttgcttggcaaatccattcactcctagcactgttccagtgatattagttccacatgcctagacagatagagaatcactgcgactggtaggcaggtcctgctgtctctaatgggatctgttttaaggaaaaagttcttgcatctattctgatttctgtatcaggccaaacaatgctagagttgctgacttaatgaccacattggctccgctgttggtcaagatcatcagactctcatttcagctttcaatgatattgcatcctgcaaacaaaccacttgagatgagcttggtataagggtcctactaagagagttctgattaccttattcacttgagatgaaatttttcactggagtgaaattaccagacaactaaaatgttttttccaagggacaaatgtgcaatttttgatccccaagagtagaccagaggccaaaagctacagccattctaccttgcctgctgtgtttctgtggcacacaaactaagaatggtttttacctggttaaatggtaggaaacagtcaaaagaagattttgtgacatgtgaaagttgtatgaaattatatgaaattcacatttcattgtccttatggcggggtcatcagaacgcaaccacacttatttatgtgttatttatgctgctttcttgaaacaaaactagagtagttgcaacagagaccttatggcccacaaagcctaaaatatttattttctggccttttacaggaaaagcatgccaatccctggtctagagcttaatttgtgtaaaagacccttcattttgtgacttttattctgttaggggctgagaaaataaacttcttatgaataacgtatttgatgggagtcttttggtgtctgagtgtggactcaaggaaggcaccgagggcttttgagactgctaaataaggcatctatttctatatatactgtcatggtctgggagctggaagaaatactttaagaagctcaagttgccggatgggatttctggattttttatgtgcacaactaatagcctctcaacctagagttgtaaggtaacttctaatgttcatagggattttgagaattgcttcctgattaactctaagagttgttcagttatttacattctttcagtagaattcttttatacctcctatgtgccaggtaataaatgtggagacctttcccaaagctttttgtatatatttaatttagagagcttctacctcaattttgttgcaattaaactgatgctaaattatgttcttcccttttgaattatggctgattgtgtctctcatcatacatagagatgttagaaagctaagctttacatttcagctgcttatattatatatacacacatgcaacacacattcacatataattgaactaaattgacattgacattgagagaatatcccctgatatttatctatgtaatttttattcttaggattagattaatcagtgattgagactgatcctctgaatcaatctctctctcgatgaaatacacaatatgtataatgtatatattaataattataattattaattgttaatatataataattagatattataactacacatatatatttaaaatttatattttctccagaactttgagttttaaccctagagagactctatcacagcacccagaatattctattttaatagttcatttaggataccaacactggaaaactccagttttccagtgatgaataaagttggaaactttattcatctagcacgacgtatggtgctcagcatagtagatgcctctgaaatgctgattgaatggaactaaactgactttaatcgagagaatagccttgagatttctttatctatataatttttatccttaggattagattattcagtgatggagacttgacctaaaaatatggctctgtaatttcactgatattgtcaagagcttgtttatgctccatcagcatcaggtccgtgggtgttgattccacttataggagtccctgtggtgttgggagggggccagaaaagtaaagagtggtctgctggaagtcagtggattagctggagagctcattctgctgatggctgccctggtagagcaccccatttggaagtggagctgaagggagagacagtagtgatgctaagagaaatgagaggaagatgagaagggaaaaattagctcatccaggcagaacctttattaaatttagttccagatcttgagttcacaacttaaataccctgtaagatcagaaatgttattatttgtacctgtagatcaagacttagaatacaggaggatcatggctatccaggatggaagagacattggagcctctctatttcagccctctagctcaatggttcttcatctgggttagtcagtggcttccctgaaaaggctatgtgtctatgcatttttcttgagaagagattccacgctttcattattttctataggatgagtccaggaaacctccttcatccccactcccccaaaaagttaaaagccacctctctagaagatgtgtgaactcttcacagggattctgataaacaattgctgacagatctcatgtaaaccttcctataaaagcgaatgtaggatttcatgaggcagcacagctggaattgttgtgaaattattccccacattgagtggaaatttatctctatgtaactttccccaacttcattttatttgtttgttctctgctccctaaagtaactgaaagtaagttccacccctcttctatggtcctttgaatataaggacacaatttgtatgccttccttaaggcgacttccccagggaaaagagcctttccaaacttttctcatgtatttgtgctttacagactcttccctgtgttggttgttttgtctgttttgtctttgtccctcataaagtcatggcagctagaattgaagatcgcatttcgggagtgttctgaccagcacaaatcagaatgctatcatctacaatcccctcgttctaggtaatatatttctagtaatgcccaattaactagtttctgtgatagtgcctcacactgctgactcataatgaactgttgattgctaaagcctcctccaagctgcgtttggaggtttggcatgtgaatctatttatacccacttttttatatttaaaaaaggcatcacattgatgcccaaatcaggactgttatgcacatgtatgtagatgagtaagtttccctttatgaatttaaaaaaacacacacacgtcatttaactttattattcttgttgctttgcaaaatattaaggacatcttgatgctttcagaatgaacaccaaaacccatgtaagtggtataatacttaacaatgttcacacatgaaaatacataagtggtttatttaattcatgatcaattatttgtttttgaaggaattttcagcattttttatttggacattctggaaatgaaatagtaaacatgattagttcaggtagcattgagaacttttaacggatataatacttatgaagaatttatttgcagcagaaagtggtcacttgctatttataagatgaggaagatagtgtgagccaagtaggaggtggagataacctcctgccaacagatgccaaaatgggagactgccactcggggctgcctggaatgcaactgcacctagaagcatactgtgttgtatgtgtaaacaagcaagaacatccttgtgtaaatgtgtggtggctctgctccttggagaaatagaatggtttctcaacatcattttcttataaattccttgctgttaaatcagtagccatttatccagatacttgtagtggagctagagatccccctctggttccaagtctataatgaattgtggataaagactgggctggcttaaacatcccaggcatggcaggcccctcatatgggaatagagtcaccaggatctatctccttcagaggctgcttctgtcggatgcactgatgaccagtgagagtattctactgtgtgtggtaatctggaaaggcccctgccttcatccacagatctgtctattcagggcagggggaggggaggaagagaacaggccagcctggaagcactgtttctctctgtctttctctctcgggattttctgggaatcaaaaggaaaatattttcctgatagtttagcaaaacatttaattaggggtggtaatgaaaagtgattacagcagcacaatgcgcttgcattatgagttcgagttaacatatttaggggtacttgcgcacaagctgtttggtgattagggaccaatccgctgaacatgaaaataaataaataaatgaaactgctgtgtgaaaaatgaatgtgctgaaattaggctgtgtataattgcaacgaaaccaaaattgagcagatacagttcccacagagaggtggaaaaccttgtcagggagcattcgccagcctgagctgttgtttgtggctgtgtgtggaatggactcaaagcccactgtggctgctggaaagtggtagggtgatttgatctattcagtcagaactagctgatgtagtgaccgaattatctcaagtgcttcccctcctgttatgtaggcaaaacctctaaattcaatgggttggattttttctaacctttaatcatttgcgtttgatatcatgtcttcattgccagtttcctccttaacccaacgtctttcatcttcaatcttcttaaactttaaaagatacaacccttcatctttcctttgatcttcacctgatgggcatgttagctgtgtccatcagtttcactaacctatttctatgaaaacagagaaaatgtttaacctagtatgacgggcctatagattataaaaataattgactaattttgttgtaaaaaaatactactctttgtaaaaacaaatcagcaaagctggagttttgtctttataaaacatgatgcttggttgcttgcttttttcaccttttaactggctatttgggtatcaagttcaactgaagtgtacttttgagaactgtcacagtagggcctccccattttatatggtagctcaccaaactgactgctgctgccagcacccttttggtttgctcttaattctattgggagccctattgctggcaagaaggctcctcatttaattcccataataagcttcattttcagcaatgcctccctaccctgagcttcataaagagtatcatgcctgtcgattttctttacagaaaggtgagcggtacttctgttgcccagtttgatacccagtagggagattcacaagatgccaagggtcttctacagaggaggtactagaagagtatttgtggagtatatgaaggaccaaggatgcagcaactaagcaatatgtatactgattatagatattttcttgattttggggggaaaaacctccagataagaaaagcagtctcattggagacctttggaaaaatgaacaataaatctttggagctcttctaaagttggtaagtctcaagtttctcccatagttctacgtaagagtactagctcattatttctcatagaaataattgagagactgaatttccttcaaagtatgaaattgggtgattgtatgagatcatgtgatttcatttcctctgttagggctttctcaccacttgtaactagaatttaagaacaactttgttgcacttgaaaaagaattaagctctgtaagcctactgctttccactggcccactccagttttaaaattgctttgcgatttttatgaaccacccctgtgaagttaataaaacacaaacatggtatgcattatatatgagagggaaatagaaaatgttcaacataaccgcttttatcattaagaacaggcagcatacagaatgatttaagaataagtgctaatgtttatgcatttttgtacctgcacatatattagaattgacttcaattcttagtcatggccagataaggacacaatggctgtaggaagggcaaagtaggaagaagaaaaaaaggggaaggaaaggagaaatagagtgaaattaatattttatgagcttccaaaatgtatcaggcactgtactaggcattttcacacacccaattccatttaatccttaaaacattcttgcaatatacaggcttttaaaatcccaataatattaataacatgtgttaggtacttagagagaaagggagggagggagagagagggaggatgaagaggaaggggaagaggaggaggagggagtgacaaagggaaagagaaagggagagtggggaggagggaaacccaacgcttgcctcattccaaaatatttgggcttgattgactttgggaacctgcattattgatctcatgattctgagtctcccctctacctcatgcaactaaattcaattgttaaattaactggatctttgtgggtataatatcaaattagaactaaagatacttgtttcatagtcaagagccaagtggttgacccagttcacagctcttcagctgctcttactacttctgcagaggctctaatttatttattatttttttttgagacagagtctcactctgttgctcaggctggagtgcagtggcaaaatctcagctcactgcaaactctgcctgctgggttcaagtgattctcctgctcagcttcccgagtagctgagattacaggcgtgcaccaccatgcctggctaatttttgtatttttagtagagatggggtttcaccatgttggccaggctggttttgaactcctaacctcaagtgatttacgtgtctcggcctcccaaagtgttgggatcacagacatgaaccaccgtgcccggccagaggttctaatttgaagaggatactcatttgcatcttcccacttccatgggaagctgttttttaccctcctcttctggttgcagatccttatcatcttgaacaattgttgatcctcataggtaacttttttttatgtgtataaatttaaggtttacaagtgcagttttgttacatggatatattgcctagtgatggagtttaggcttttagtgtaatcatcattggaatgatgtacactgtatctattaagtaatttctcatccctcaaccccttcccacactcccacccttccgaggttccagtgtttattattccacactctatgtgcatgtgtgcacattatttagtgcccacttataagtgacaacgctaggtatttgactgtttctgagttgtttgacataagataatggccgtcagttacatccatgttgctgcagaagacataatttccttcttttttatggttgcatagtatgccacggtgtgtgtgtgtatatacatacatgtgtgtgtatatatatatatatatatatatatatatatatatatatatatacacacactacattttctgtatgcagtcatccgttgatgggcacttagatcgattccgtgtctttgctattgtgaatagtgttgtgattaacatgagtgcagatgtctttttgatataatgatttcttttcctttgggtaaatcacagtagtaggattgctggatcaaatggtggttctatttttttttttttttgaggaatcttcatactgttttccatagaggttgtactaacttgcattcccaccaacagtgtataagctttctcttttctctgcattcttgccaacatctgttttttttttttccgactttttaataataaccattctgactggtgtaagatggtatctcattgtggttttaatttgcatttctctgatgagtaatgattttgagcattttattatatgcttgttggtcatttgtatgtcttcttgaaaaatgactattcatgtcttttgcccgctttttaattggggtgtttttttaaaaaaaaatagtgacggcaggtggtatgttcctcacacttgacttgtcatttacaactgaatttttcagctcacgatattgaaatccagaaccactttttctatagtcaagtgtgattcagcaaaaaataaaaccttcttgcattcatttggaagtaatatatgtccttttggaatttctgtgtaagtccttttttagtgagaaaaaaatcaagtccaagttaaaatgataaaatactaaattcggtgttgccaagtagagtttaatttcaattcagatactataatttataattctgggtcttaggagccaaagcctccttagaccatccctttaatccaggcctatcatttggagatctcatagctcccttcactgtaatcaccgtctggtgctagatagtggaactgagatacttctttgctaatgacctacttgctttcagatacagggcaaccagcggatggttcctgggatctcatctgatgagtgacatctttccggacagaactgatgactctctggcagtaaaagggtggagagggcagggcagatatgtttcacgagcaagaagggaaatagtgtgttgtaaagctttgctgtaggcctgccaggatctggtgaagtgggtgggcggggagagcttgtgttcacagaagagtcagatggttaaagaatttatgataattaaaatgacgtttctatgtaagtctgaaggaatacagccataaaaacataattgctgtaaaacatgctgcatcagactaaataaccacttgatgatggcaactatgcctgtgccataaagaaacctgtgcttttgtgaggagaaaaaaatatgtatttattatggctatttgcgtctcatgttaattgttcacaacaaagccattgattaagcaatgactccttacaagatggggctggatcaaataatgcacagagtacagcaaacaaaaaatggttgtgagatgaaaggatgattctgagaaacagggtcaagctgagaactctctgaactctccttgggcacctgcagtcatagttctagaagtgtgcggaacaatttgaatgagagattagatctgagtttcggggttttcttttcccaaattctactctgtaaagaatggcttgcctggatatggaagaagtgctaatggagggaaacaataaggactgtttcacaggaacctgccacacagggttcctgtttgaggtagagatttagtgacactgcctgaactcaatcagagtgaagccaggctttctgcattctgctagtttcactgcaaactgtggccagtggggccagcattcagtcagaaacacctgtctaggaagtcacaaggccatttatgattagtcttcccaatctggacatcatggagcagactcaggcacgtgaatggcgtctatttacacacacacacacacacacacacacacggctatactgttttcctggacaatcatttttcccacatttcctggaggaactactggaatcacaaatcacaatttgtggcttgccctgggtaatgagtcattggatggaatttcatttggtagatttaaagagagttagtgttgatctatgaagccagatgatttaagaaattgaagcagtaacaagtaaattgcttttctcttgtactgcaaaatgctttctaggcgtttttggcttttctttttaaaatggatttataatgccatttctctccacctcacggctcaagtaaacctctttgctctgatgaatcctaaatgactcctcatttcccacaaacagattgttcaaaggagttcttaatatcttgttttacactgtggaagctagaatttttaattctataggacacacaaatgaatatacattccctgttagaggctttatttattctgactcctctcatgaaaaattatgtccaactatgttcaaattccttgaccttataatcaaggcctgccactaaccaacctaaactcacttgcctttatttatttgttcatctggaagcaataggaaaggcttagaatctgccatgtagtatgctagttgttaaagaggatacagaaaagaaaaaggatctgggatacagataagtccagctgcttccttcaagcaatttactggccattggccagggcagatatgagagtggacacttctatgagatatgttgaacctgtgttgaagtgtgtgcaaaggactatgagaggagaggagagctgttgcttctcacagcagcacctcctctacatgggatgcagagagtccaagaatgctccaaaatggccttttccatcttcataatggccttccagccttcccatttgtgggcacaggggccccctgccctagcaaccttaaggtgccctgttgccagtacccttgagactccctcatgtttacggatagattgtaaattacacatgaaaaaggtctcatattaactattttaactttacagaaaccccacagaagtgcagcccacttggtcttgagctccttgaaggcgaggactatgtgatgccacatctgtaacccaagaacccagcacaaagtgttgcacatagcagatgctcaataaaagttttaaactgctgggggaagaaagtactatgggcatctggaagaggggccagctaactccacataggggactctggagctgtgctaaaaaatgtgtggtccactgcttcacttgaagagcctaaaaaatgtgtagagatttatgagggattaataggctcaagaattcgaaagggtactccagacagctcagagctcttgcccccagaatatgtgaggcatcgaaacaggaaagtaaaatgtttctagcagatttcttcccccctccaccccagacagtcttgctctgtcacccaagctggagtgcagtgtcgcaatctcagctcactgcaacctccacctcccaggttcaagcgattctcctgcctcagcctcccgagtagctaggattacaggcgcctgccaccttgcccggctaatttttgtatttttagtggagacggggtttcgccatgttggccaggctggtctcaaactcctgacctcaggtgatctgcctgccttggcctccaaagtgctggcattacaggcgtggcctaaaatgtttataacagatttcttatcaatctggttctctaaaccacagggaccacttggtgaacctgaagttttgtgactacaaggagatacataaatgtgtatttgagttaccttcatacagctacaatttggagaaggacgtccaggaagatactgagaggagaagtaatcatcgggtactgtttaagagagccgctgtcattactgcctttactgggttggggtcagagacaggtgggggaggtgctctgcaggttgtgttttatgtaattggtgctccgtcctcctccttctgttatatcactcatctgtgcagcttttcatctcatatgtattttccaccatggtggcctttgtaagacataaggtgagcaaactgcttattaaggtaagacaatggaggccccattttaaaaaggttaagatgtcctcaaaagtgtcagcgcatcccaggaatcattaacagtgtatggaatgcacagcctggtattttccaaaggccacactaaccttttcaagcatggaacaggctaaaaggaatggatttcttcaccatttgatgagagaagaaatctttttaaatgcttatttttatttgcttgctgagaatcatctctgtgaagctcaatatggagaaatgaattctgaacattttagcaactcacttaaaataccattagaaagcacttgggttattaaaagctgaaaacaaaggactaggagccctctggcactaataacacttagggagaaagcgagagccacctatgccctcatgtttgccaaaaatgtatttgaatttaaactcttcattgttaagaagggaagcttaagttttgccaaaccctttttgcctttcagtacaaccacttttccatgtaattggctcaacactgctatttgcataattgtcatatttttctgcttcccaagagggctgtaaagcgtaaaggtgaactgcaaagctttgacaaagtgcacatttatgtgtgatgtgcaattctcaaattacgaagaaaattatatctttttcattgagtttatcttacacttggaaatgaagtattcagaactcattgccccctgagatgagtttagcctgcttttctttaacttggccaaagtgcaatttcctgagccttgggtcttcaaataatgatgttgccacaggaccttgactgtatgaatgacctaaagcagaggcatttttctttaagccgcggaataacaataagctcttttagttggaatcagagatttcatcacagctgggccatccgttaagctctgagaggtcaaacagatcatttaacctctcaaagcctcagtttgtttaactgtaaaatgggcatgcctttaactcacacatgtattgagtgcttatatgtgaggaagtattttacccagggcttggtgcatagtaagtgttctaataaacacatgatattgcctcgttcctcttcttttatagcaggtggatggcatttaaatgaatgagagggcttgaactttggcacgggaaaagaatggagttgagtcctgcctatgtcacctttttagggagtgggaggatggggttgcagagagctgtgtgaccttgggcaggttacatagcaggagagcctcagtttctgtatctgccaaatgaggatggataatagaatgtgattgtgcatataaacagcatgtaaatgctcagtgttacctgtagttattaacatttcatccttaacagcggtcattatcaggtttaagatatggccctatgaggagttaatgggtgcagcacaccagcgtggcacatatatacatatgtaactaacctgcacattgtgcacatgtaccctaaaacttaaagtataataatttaaaaaaaaaaaaaaagatctggccgtgaaaacttatgttccctccaggtttgctgtgtgttgtcccatcacttttcacattggggagagtggaatgttcaacttcccttcctgtgaatgctcctggaagcctcctgcttacttccccaagtggggactagatttttacaggtttcctaattgctgtgtgcttctggctgcagcctgagggcatcagattacagtgccaaatggaggaatagtattctgggtgtgatactgatcagatcaggaagatatcaggacactagacatccggcatctgacagctggtcacaggggtcacttttgatccctagtttccccttgacaaggttagccactacatgccaagtgtttcatgggcagaattctagccaagcactaaactctgacagagaaggagaaatacaggctggcaggagggctggcattgccctaatgtcacagctggcactcacattccaatgaatgaatcttggatcaattgctaatgtacggggcccaacacaacattaacagatcaaaataagaggaagttggaaagtattcaagtttccagaaacaggtagttaaatatattaacgtaaatctacttgataaacttatctaatcattttaaaaaaatgaaaacatggtaattaatgttagaaaatgcttatgttgtaatgttaggtcaaaaaggataaaaatatatagtataattagaaatgtaaaacaacaacaatagacaaatctataaagacagaaagtggattagtagttgccagggtctgggaataatgagggttgtggaatcattggccaagggacgtggggtttgttctgggagtgatgaaaatgttacaaaattgattgtggtgagggttgcatcagtgaatatactaaaaaccactgaatggtacactttacatggatgtgttgtatgttatgtaaattatatctcaataaagctgttactgacaacaagaacaagtcttatacatacaaaaatagaacagaaagaaattttccagaaggctaacagtgtatataagttagtagcaaattgggactgatttttcttctgtattttttcacattttaaaatacagtgattaagtttaatgatcacatatgtagtctcatatattaaaataaaaaaactattggaaaggcaaataaacaaaaatgaattaatgccaacttttttagctcatggaattgaaaatataaataatttaaaaagtaagagaaaaaattatttttaaactagatgaaaatgtagcatagagtatgtggccccgtgtactctggattaaatatcaatacttaaccttttcattaatattttggcttgtaatgaaattgccaaacacaatggtatacataagacacatggcataaatattggaaaatctgtgataaaaaaatttttaataaactgttttctcagaattgacgtctatccttgtttagatttagagcttttgaaactttcagaatataaattaaaaattatctttgtaatcataatgcacccctaatttacatgtcctgatcttaaatctattatttatattagcttttatcaaaacattcagataagtgatcttcaaatgattagtacttaagtactggttggagatgaacttttgcaagtgaacgtcatacaatctattatttctattggagcttaattctgaagctcagagactccctagctctcctcgcctcaccatggtaatttattattatcctttgtctcctataatgtttgcttctttggcctacctgtagcataaaccttttggttgttctgcagctatttcagttaaataactcaagccctaaaaaccacagaaagaagagaatgtgcaaagcgatcatatttatggaccaccagatccttctcagcataattgccaggctttttatactgaaaggcaagaaacagctgccttgttctactttggtgtccaactcagctgtttcagattcatcctgttgctttaagcatctgttgacaggtgggaaagctcactgtgaagagaaacattgttgccctgggtggcttctgcctaagacaggcctgacccttttgtttctcccctggaaaaggaccgaagtgttccttccagccttattaagtacagctgtcgggtacattttagtagatgagaaccatttccaaagtatctcggttctgagaactgagaggcagtgtccagaaggtagttggacaagctcgtgtgctgtagaatgtctgtaagtggctgggacttacagaggagaggcccgcacgttgctagtcctccttgtcttggacatcttgagcctcccacttgaatatcctcttaggctctcattttgtaccagaaattctggaaactggaaggctattttgttggaaccccttattttacagattagaagaccgatgccagggttagttaagtgttttgttttatgctacaaagttggttagtggaattcttctgcctatataataacatcacagtatttcagagttgttttctgtcctctctttgtcaggtttctgggaaatctctttctcctcatgtttattatttggcccttaatccagcataataaaattacaggtacatatagtttgtcacaggatttccagttaggtctcagagacctaaaggaaagaaagttattgaaagttctggaaaaacaaaagtcctgagatagtttcttgacatacatcttctttgaaatctttaaaatcaaacaaaacaacccctagtgtcttccctgtcgcccccttcactaccttcttttgtattctgcatatgtagccattctcttgggcaatagcagaaaggtacatgtggattaatggaatttatgtattcactggcggtaaaaggcactgggaattcctgcactgggtgtaaaaacttgggccttggggacctcactaatgacttttcaagagcagttctttacagagcccaagtcttcaatcttgtaactggaccatcaaccccagtgacagcctactttgaaggaggcctcataaagacaaggttcaggctctttctaacggttttggctaatggaagacctggaggggaaaaatgaaattgttctcaaacttcttacaggtagaaaggagaaaatctctggaagttctgagaagtgacaggaatgtaaaattttgtgtttaaaatgtaagaagtagcaggggatgatgaagaatgcttaaaaatgcttgtttttattataggcagtggaaaaaatgtgagtctcaatttgcttgccctggaattgctccagctagcagaataaatcaaggctagaaccagatcagaatttcttacgagatgacagggatctgaaggactttacctctatagtcgttttgcctttttaggcactgggtgacctggtcccatgtccatcctagtgggccctgtatgatccaatccaaaggcccctttaggtttgcgttttatcattccctctttctcagaatttgatgtttgtatgtaaaagcactctggaaaatatttaaatcatggtacaaatataagagaagtcatgcaggtatggaattgctttgagaagtatcattttattaatttgtctggcttgataccaattacctgatgcagttgttaagggcagatccatccagaaacctttgggttctctgctccctgattttgttttgcaaattatataaccatacttcatagaaaacaccagtggtggctatgttgttcacagacacaaagtgattctaaggcaaccacaggagagagacacaaaagaaatcacacaaaaatctctcatcacaacataaatattgtgacaattgtgtggtactttttgtcttttttgttctctctgttccttttttgtcagtacaagtaagtcatcatgaacaaataagcttttgtatcctgcttttttaacctgacatgttcacagaacataacctagtcacacacgggcaagtacatcttctatccagtgatttgtttcaccatcaccctgcacatcacttttctcatgtttcaaatgatttcctcagaagagacatctggaaatgggattactgagtcaaagattctcaacctcttttaaggcccttgatatgtagtggcaaattgccttcctgaagggctgtgccagttgacatggctggcaggggcaaggcttgagtcttcctctggacctgtacatgggtacagttaacattaaatttttttaatgagtataatttacatacaataaactggacaagccttcagtgcataggcttggggaatttttacatacctacatttgggtaaatgccacccagatcccagatctctctctctgtagacagatagatacatacatacataaatacatagatacatagattgatctatctgagcagcatttatatttatatatgatatatcacatatgatttatatatttaatattatatatgatttatatgttagtatgaatcatatacacataggcttaatttatgcataaacatatgtgcttcacatatctttacatagataaatataaatataagtatgtatatatatatatatatatatatgttccttacctacaggatccaacacaagattaacttagatactttccagcttagatattaacttagatctttccagatcagaataagaggaagttggaaagtatctaggtttccagcaacaagtagttaattatattaacatgaatctactcgatagactattatgtcatcattttttaaaaatgaaaacattgtaattaatgttagaaaattcttatgttataatgctaggttaaaaaaggataggtgtgatttttatatataaaatatatgtacagcatatatatagctacatatttaaatatataaatacagcatatatatatttatatacttaaattataaatatatgtacagcatatatatacttaaatatataaatatgtatatgctgtgtatatatttatatatataaatcacacctatgtttgtgtgtgtatgtgtgtgtgtgtgtgtgtgtgtgtgtgtgtgtgtgtgtgtgtgtatatatatatatataaaatatgatatttccattatccccaggaagttttctagtgcctagttggtatgtagtgcccagtcggtgtctccacccacccccaaggtaaccactattctgaaagtccctcatttttgagtgatttcggaaatgttcttctctcatctgaaatgatttgacaggcagtctctgaagggagattgccatggctttggtgttgctcggatttctgccaccttacattggcaggctcaagaagatatgcacagtctttatttcattgatgtccagttgcctgtattgagcttagctatcctgtgcccaggttgccttagggatcactttgtgactatgtgcagcttatccactaccttttttttcccttcaagaattaacaaaaccactaccatctgttctgaaccatgtgcggtagcaggtagggggtgacaatgaaggtgtgttacagaaataaagtaggagccatgctgactttaaagaaacacccccacccccaaatgctcctggctgttttctttctatagatgagttaaaacagagggtatgaagtgcttggtttgcaaatcctgcaatactttgccatggcaagtccctaggaagtagattaaaagtggatctcccagagtgattaggattgggcagataaaatgatatgtttgttttggtcaattgagttcgaaatacaggttcagacagtaaatactcccttgctgagactaaacagtcattttgttgttcattttgatgaaaatcatggctcccaattttccgtgaaagctatcctttctgagatagactggctcttcatgagttatgaagcacctgaaatcctctctaacagcaaaatcgaggggcaacatcaaggttaggaacatcacgagcaagaacttacggctcagcagtggttgtaggtgtaaattcagtgtcccaagtcagaaaccaagaggtgtaagcccaacatgaaaggcaaagaggggaggaaattaacaaagatggaggctaggaacaacgttaggggctttcatatgtaataatccatttaatatttgcaataagtttatgaggttgatctatataaatctccctttaaagggagggaattgaaacatgtccagagtctcacagttacatttcttctttgcctctttccttccctcttttctttcttttttccccttttcccactgttgacacattccaggacacacatcctcctcctgttttccttttccttcacatctttctcgtcctttgctgtaacatcctgtgccataacaaactgtcacttatccagtgtggcatgccctgtgaagccttccctgacaccgtgaaccatagtaagtttacaggacccttcagtgttggagttctatcttttgcagctcccacagcacctatagaagttgtgttcacagagcactcaacaatttctaggcttgaataatgctgtgacaaagatggggttctgttgggaagacactgtagccactgtcagcataaagatacaaatggtccttgtaaatggatggagggcctttgagtgatttcttatcaatggaagtgccttaggaaatgcccagttgctgccttaaaatcaatataattatccaacattggtcactgagtttgttcctttgccaccctccccacttgcatgtggaaacctttttggccatattttattttagtatttcgccaaggagttttcagtcatcttaattaataacaaaaacacatcaagctggaaggagatggcctgaccatagtacattcctttaccaggactctgtagacaggtccccagctggcatacggatcaggagctcccattccctccaaggacccgtgaacagttcacacctacagtgttagattagaacagatgtgaaattcaaatgccactaggttgttataggtgttctctgaaaagaacagtggtaaaataattagtgcatctaattatcagtgtgttcacatgctttatatttttaaagggccacagcagtggccctttatatatatatataatgtgagctatatatatataatgtgagccatatatatatataaaatgtgagccatatatataattttaaagttttttagtagtcaatttaaaaatgttgaaacgtgaaattaattttaataatatatatttaatttaactgagtaggccccaaatattatcaccttgacatgtaaataatataaaaatattaatgagatattttacttgtttttgttctaagtcttagaaatctggtgtgtaatttatacttacagcctacctccttttaagctggctatatttcaagtgctcaagagctatatgtggctactggcgatcatattggccagcacaggcccaaagaaacttctagtggagtctttcttataaagatggagctacgtttgttcataggcaaaaccaaaaccaaaacaaaaaatgactctgtatgtttattggtcccatgctctgtgctaggcactagagtggggagacaaaagggtgcagtgcagcctctaccgtaaagcagtcacacgtgaaaagtgaaatcattttggttgtaatttataatgtgtccaagcacaaggcagtttttgtgattaattctcaagcaagtgattctggcagcttaggactgtgagtttaaaggagaaagtaatccctactatttgagatggtcatggaggacaggggacattggacaaagtataatatttgtctgagatggggaaagaggagaacaagcagttcatgtgggggagacagcttgaacacatctacagaagcattgtgacacagagagtagattagcttggctataactgagaattcacataaaggaaattgtggaaagaaagatgggattccttttggctgtattaaagagagttggactatatagagagatggctaagagacctcagttaacaacaggaatgaaaataataatcgcagctagcatgttcctgattagggtccagtccctgtatcaaattctttgcatttttttgtcactgaatattacaaatgagaaagtggaatctctagagaggtagaagtacttgtccaaggtcacacatccagaaagttggcctagcaaaattttgaatacagaaccttctgagttcagagcatttactttaaccatcaggagatatgctcctgagaacgttggaagcagtgatctctgtgtttgattaatgggacgccccccagccctattgacaaaggtgctgcccaagtgctgacgtaccacctcaacataggacagagaatttccaggccaaggattctctgcagtttgtgtcctctgaacagatacaaatgggccttttagcatgatgcccctgaaagttgactgaagtcactgactcaggtctttacaacccagtgttccactagttggtttcctcctttctctctcctcgtataccccagtatcatactagaatactgggatctcagagaccttttagttcaaggccctgttcttatagaacagaaaacagaggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaaggcctgaaatagctagttgctacttaatgtttgctgcttatcattgcatttgctgggacctggtgcttgtcatgcttatgcagtacaaggagggaccaaagaggcagaagacagtccctgccatagtgaagtgtagtcattttagaggacaggactaaaaaacacgaagcaatgaacaaaccccccaaaatacaatagtgtgctgaatgatgcagtgcagatacttcttagaggtatttaggtgtagctgggctagattgtttctgtattgcatcaatagattggtccatgttgactattccacttcacaatatctcagggatggacaagatggcagagttcaggccccaaatttaccaaaatagaaattttctccatcaactaatgagtggataaagaaaatgtggtatatataacccacggaatactactcagccattaaaaatgaaataatgaaataatgtcttttgcagcaacttggatggagctgaaggccattattattattattattattattattattattattttttatgaagtctcactcttgcccaggctggagtacagtggtgtgattgatatcagctgactgcaacctccacctcctgggttcaagtgatttttgtgcctcagcctcctaagtagctgggtctacaggtgggtttttttttttttttttttgtatttttagtggagacagggtttcaccatgttggccaggctggtctcgaactcccaacctcaagtgatccaccagctttggcctcccaaagtgctggctttacaggtatgagccatcgtgcctggcctagaggcattattctaagtgaagtaacataggagtgaaaaaccaaaattcatttgttctgacttataagtggaagctaagctgtgagtctacaaaggcatgcagagtgatacagtggactttagagactcagaaggaggagggtgggagtgggccagggattaaaaaaaactacacattaggtacaacatatactactcaggtgacaggtgcactgaaatctcagaattcaccactatataattcatacatataacccaaaaccacttgtaccccaaaagctattgaaataaaaaaattaaaaaaatatgtaagttccatttcagcatgagaaatacttcttagaggagtgttcataacataggttagtccccatgagatttgtgcataaagaggactccataggcaagccattccatatcttcctcttggagacttaaaagacatgttcgttcgtatattaaaggctatacagctttcaaacttttttatcaaagtcttgcagtttgtaactttgactttaacccagtattaaccaaactagtcttcctacagagcctttatttcgtagtccatgttccatgggccttgtggcagaacacacaatgggaaatgctgctttacagtggactcttggctccccagtaatggctaaatgcctgatttggttatagttctgtcagcccctgttccttccaaacgagaatcttgtgcaggaagtaagaaagagaaactagcccaagctattttgacaacaggcctctgactgaaacaacctccctgaatggttgataaacattttccctctcttaagggaaaatcatgcacagaaacaagcacatataaataatttaccaagctgtaatatgctgtaaataacaaccctgctaaataatgaattaacccaactgctgattcataggtaaatgtctcttgtaaagcagcatttttatggattttatagcttagttaatatccactcatatttcattaggacacttcaggtgaagtattggggtaataatctggatatatttgaaactgacatagcacatatcaggagtccaggcagagtttggggagctgccaggatccttttgtcttagctagagcatgaggagagattgtactgggccttactcttctccttcctccatggtcttggtttgcccagctcctcagtgcaagcctgagttgctgagcaggatgcggctctgatatcagagagggtgtcctctctgagaccacgggcagggatggaaggagaggtagctctgggccaggggaagaaagggacacagaaatcactttggcctactcgacagagccagctcttctgagtttttatgacacaggtgtgcagactctggagctgaactctggatatttgcatctttaccacttattaactttctgacttgggcaagtcacttatacactctgtggctcagtaccctcacctgttaacagggacaataaaagtacctactcctagggttattatgaagattaaatgagtttgtattgtcaagtgctggaacattgcttggcacataagcaagtgctttcatttatttattttttgagatggggtctggctctgtcacccaggctggagtgcagtggggagatctcagctcatagcaacctccacttcccagactcaagtgatcctcccacctcagcctcccgagtagctgggattacaggcgcatgccaccactctcagctaattttagtatttttagtagagatagggtttcgccatgttgcccaggctgatctcaaactcctgggctcaagcaatcctcctacctcagcctcccaaagtgttggaattataggcgtgaaccaccatgccgtgccagcaaatgctttttgagtacagtattagctgttatatttgttagaactggactcttttagattcttcattttggcattctccagctctggtgttggattctgagaacctagaccctggggattggagggcctgggtggggagggggtcaccgggatcactcagatgcctcttcttgcctctaaagaatgggaacgggggccaagtgcggtggctcacgcttgtaatcccagcactttgggaggccgaggtgggcggatcacaaggtcaggagatcaagaccatcctggctaacacggtgaaaccccgtctctactaaaaatacaaaaaattagctgggcgtggtggtgggtgcctgtagtcccagctacttgtgaggctgaggaaggagaatggcgtgaacccgggaggtggaacttgcagtgagccgagatcccgccactgcactccagcctgggcgacagagagagactctgtcttgaaaaaaaaaaaaaaaaaaagaatgggaatgggaagcaggaactatgatttcattacagtgaggaaaaactgcttttgatgatctctcagtaactataagtaagaaatattctcttatttaaaaggaatgttatctatctttgttaatgagggttttatggtggggggaggtgatgagaattatcagtcaaatcactttgagaaggaggagatctgaatttcataaataaaccctaatttgttaatgggaactgatgccaaaaacaaggagtttttcctccttgcggtgacactgaatgtcctgggctgtggagggtagaaacaggacattctcagtgttccagctcacaggggtggagttagagtaaatatcctgcccagtttgccatcacactaacactgcataccctatcatcagcctaatgacctttcaattctgattgaatggaagagcactccggcccttgatccaactcgtggttgattacagtgctcatgccccattaccccaaatattcctataaattaccagagcgagcattcacgcttatacaccatcatagatttagctcatgccggtggttctcgatagcagccatctgaagctccttttgcccacagctccctggatagctccaccattccctgcatgctagtcttgtggtttggtcttcagcctgctgtctgtactttctcacacgttgcatgggctttctccgatgcctacaagcaaaatctcttttccattcttcctttctctggctcctgggttcagaaatctctagggatcattatcagtcctctggctgccccctctcctacctacctccatctaccctagctctaggacagacctatggcgatgcccaactttctgcattttgaaataggggtgattgctttgacttgggccctatctattagggtctttcatctgtctattttggacaaagacaatagcagtgaagcagggggcctttgcattgagaggctcagactctcaaactctctcttaaaaaaaaaactgtctggcattaaggggcatagtctgcttgccttcaatagacctcaggctggggaggctcgaggtgcctactagggcagccagtttgcatagtgccttctaaaagcaggaagagccacccttgctgccttacagcctttgtccttgggccttagaatgaaacgcttcagagctcacaattaacatttggccaagcctcttcctcacccccacccccgtgaagtgggaagaaatacggtggcgtgacattcactttgacaaagctctttttcttttctctacttctcaaaaaagcctaaagaaataaaaacagttgctaagctactgggtgggctctatcggtgtgttttgttgcagtcttggcgttaaggactcatgctatcatatatgcagcagcttagactaaagggaggaagcaaagtgcttgagagggctctcttgcaagttcacttttttgtcaggtcaagtgcttggctctgggatggcaggggacatggagcatgacaactgcaattctctctccagatgggaaagtagaagggaggatttcttccaatcctcaaattcttccaaaagagaatgctgttttggaaccttgtctttctttaccatttatttcagaaaggttggatctctaggaagcatgggtcatactcttagttctctgggtattgtcttttgtacacatcacatgcagttggtgctactgatggggcctggacactagctagttctggtgagctcctagctcagtgtgccagaccgttgtactgtattgtatttaatttttttgtctccagcattttcttttcaaagctggtgaatcccaggttttgcaagttttcatttaacaacattcacataatccctaaattcagcatggtttataacttgttaggtccgtttgctatatacaaatgccatacctccaattggtactgaggaatggttccccactcctgatttaaaggcattaacactgagaatggtggaaagagagcctatttcccaacactgctttgcaacatcctctaaatctttcataatggcctaatccacccattgcgcgttggttctcagtgtggggacaatgggggcattactgattttaaacttgttttcatcaactagctcattctgtgtagagttgagtttagaaaaaaaaaacataaaaattaatgcagcctgggacaccctctgtggaggatacattgaaaatacatcttaaataaaaacccaggaaattgtcccttctgtctttcacctgtcagaatcagcaatagaattctatagaccattcagtggcatacttaattaagcaacctatctgctgaatgtgctgggggttggctgacagtgcttttcactgctgatttggatgacaaaggatatggtgagatactcaacagtctggtggaatggaaagaaactcccaattggtcacacctacctatttctcttggcatgttgcattagctctgataatacagaaaatagactggcttttatgcattgagaaagtcagtggacaccaacctcttgccttttgctcttccacagcaagccctgagttttgcacacatttccattacagatgaatacagattttagttgtaggtgagaaacatgagcttgtaattttcaagagacaaaacctccagctgctttttttaatcctagtgcagaatagttccttcctgatcatcattctatattttgatggcagttattgcctatccctaatgtatattattagtattagggacagttttgcagtgtttatctggtgccagacacatgccaaagcatcatccctcttgccaactctgtagggtaatactctattttgcagatatgaaaattgaggctcaaaaaacttaagtgacttgcctgaagtcactcaaccaaacagtaagtggtgggtcaagcttagaacatagagctcttctaccctgcagtccgtgcttttaaccgctctcttgcatcgtctctcttgaaagccgaaagagtgtcacacagtacaactattaataactaggggttggggcacacgtgtattaggattacaaaccttttgggagtctctcccacaaaattgggctcttcacctaggttttgtagagcctttcagtatccataaagcccttcaaactagatgcaaaaatatgtgtgtatattcaagggagataggccagagttttcatcaacttcttgaagaagtccatcacacacaagagggttagtaacttccacataatcctaaagtgcatgtagcacttgccaggcatgaatatgattcatgaatatgtgcatgaacttaagcaaactcatttcattctcaccatagctatcagaggtaggtatgattatcatgcccattttacagaaggggaaactgagactaagagaggttataaagctaataagtgacagcactgggatttgaggccaagcagtctagctcctgcttttaatcacttttgactgcaatttcctttttatttacttgcatatctccagcacagtgcccgacacataatgggatgtttattgatatttgttcaattgaattgatttgcacactgccggctctgtgtagatttcatcttaggaatcattctcaaaggtgtgactccgtaagtcttggctggacgaatgaaaagaatcaacatggtcaaaagataatttattagagtttctaaagacaaatggcttggcaaagcataggcattttactttcaatcagtgttccctggagggctgttacactgatttccaagcccattcttctcccaactggctcactagattgttccaattggttatgtggtgcccctgagtatgggctaggtaactctgcaggccccatgaatctatgtgatgtttcatttcctgattactatgcataatctcccctgccttttatttccaagtgaccaaccagaagccacccaaaccctctgcatattgacatgattcaaatgtaggtctctacaaggtatgccaagcttattgaggggaaggtggggggagatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacatgttccaaggtttaactttgtggcctccactgtttccctaattttacctgctgcgatcttattttacttttcattttattctctaatcaccgccaattagagccctgagtccatgctggttctgttgtctgcctctcagcctaatgggcctctttgtactgaggcacagaacccagctggcagcgagacttcctagggcccggaagcttcattactctttgttggcagtgaactctaaagttgctgtctttggagttgggttttctcaagtacagtcacttaacatttggtctcaaagttgttgtttttcagatttttttctcttttttcctaagtcaatcagatgcatgagctaattataagccagcaaatattttgagaaaacttccctccagtggagacccttgcacaaacttcagactatattcccagtaattaatatgctccttttatttcctttgaggtggaaaacagtcattgacaatcattccctacccatttggttcaaataactaattttgtacctgaagactaattacagtagtgacaccatcttttcctattaggtctctcacttgaagaactcagagcaatttataacctttgaatcttggggactagtttaatctgttcgtgggcagcatagcagtgaacattgttatcagaaatatagttaaacctctttaattgagcccctattaattcaaaaggtaataattcaaacagtgtgaagaacaaacttgaaacgtctatgacaagaagaaagtaagttggcaaaggggttatttaaactgccaagtagagcacacttttagaagtgccagttcacatgcaaagaactggtaagtacacacaaattgttccattaatagactcagaatcttaagattaaaagccctgtagtacaactgttcataactcaaaaaacatttgttgagtaatgctatgtgctggggcctggggatataatttttttgttaatagcttcattgagatataataaatacaccatataattcactcatttaaaatgtacagttcagtgatttttggtatagtcaaagagttgtgaaaccatcactacagtctattttagaacatttcatcactctagaaagaaaccctgcatcctttagccatcactttcccatccccctattactcacagccctaggcaaccactgtggggatacaaatttgactaaaacacagtacctgcctttgagaggatggcaagctattgaaagagacatcaggcaggtgaagcgtacttatcatagcatcgtagaatgttgatattgagaggcactaagaagatcatcagatataatcttctcatttcacatatgaggaaactgaggcccaaagacaagaaatgacttgcccaagaacaaaaagctaacagagccaaaattaaaactcatgtattgtgccatcttagcctgttgcaatgttaattacaatacaaacttctggagcatagtaacagttgagagcatggattctagagccagactgcgtggatttgattctcagcttaccttttataggctgtgtgacctcaggcaagttacttaacctctctcagcttcagtttcctcatttgttgtcttgaaataataattgtaactaccttataggactcttgtgaagattaaatgagtttctatatgaagtacttaaaatagtgtttggcacagaataatcgatacataaaatgattgttattattatttcattacctagttattaaatataaaaacatttcgtaatgtcctaaagtatattttaaatatttgttcttcaggttttaaatcctgactgtattcatacataatttctatttcgtttcttccaacatatatttttgagtgttaggggctaggtataaaaatgatgtttaaaacagagttcaaatgcctaagaagttcagtcaggtaaggaaggcaggtgaacagatatgtagctataaatcaaggcaagcaacaggaagtgccccaaataaagtatgtatgaagcataaagggtataagaaaggcttcaaggaggctgtggcatttgacttgggttttaaaatgtgagccagatttcaccagactgaagagggcgagagaagaagacattccaggctgaggtaacagtagaagtggagaaaagaaagtatttgccatggtttgggaaaggctaagtgttgtatgtgttcatcgcatagggttttgcaagatgtcctgggagacgagcctgaatatagatggggccgtgctcagtaggaaaagggaggagaatttatacttactgaacaccttttatataccaggttctgaggttgggcgcagtggctcactcctgtaatcccagctacttgggaggctgaggcacaagaatcgcttgatcctgggaggcagagaagtgagccgagatcgtgccactgcactccaacctgggtgacagagtgagacaatgtctaagaaaaagaaaaacaaaaacaaaaaaactatataacaggctctgtaaaataccaagtactagatatgtatgggtaactattttgattctcacaatcatcctgaggaagcagtgtagacaggtgatataaattgatcaatatcacacccaatatgtggcagactccagattcaaactgaagtctctctctgatgctaatgcttattccctctccatataccacaccaactcctgaacttctgtaccagcttggacgttatggaaaatgggagctttaaatgttcttgaaggccaggcacggtggctcacgcctataatcccagcactttgggaggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaaaagtcaattgtgaggcttttacggtaggtaaaaggcagcgaggacatgaactaggggcgtggtaatggagaggaggggacacatataagagagggattgacaagacaggacatgtgaccaatttgatgtggtcagagcaagagtcaaagagagtcaccaatgaaggcatgattttttcagcctgtatgttgtgatgggttgaactgatggactgagataagaagcctgggcatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataaggaaacggaggtcaacattgctaagcgctaaagaatggccaagttagatagactgaaaaatgtcccttggatttagtaattaagtaatttagtaattaaagaggttattgagtaataagaagcaaaccaagtagaatattatgggtggaaattatgtggcagtggtttggaaactgaatgaggaatggagacctggagacataaatgtagacaactctttctagaaacttgtctggtaaggtatagagagatgacagaatcttgaagacaaacagatcctgaataacttttttttaattatggagaaagttgagcatttattttggctgagaggagtgagtcagtgaagaaagagctagtaaaaggggagaaatcgggggataacggataaagattggagaggtagcaagaggaccaaaaggaaataggaaaccacagagagatggttagctatggacttgagcccttcctctgagatggggttttgaagcgaggatgcacaggggcacagataaactaaaggctttttccaacagagtctgaggtatttgtgattgattattttctttaatttagaattctctgcgtaagaaaccttgctctttttacactatgtaaaatccttatggaaacaagaacaacaaaaccaaacacaaaaacctactttatttaaatgtgggagaagggcttgaataatttctcccccccccaaaaaaaaaaagatatacaaatggccaataagcaaatgaaaagatgctcaacagcattaatcattagggaaatgcaaatcaaaatcacactgaaataccacttcacacccattaggatggccattattattattattttattattattattattattattattattattattattatttgagacagagtcttgctctgttgcccaggctggagtgcagtggtgcaatctcggctcactgcaacctccacctcctgggttcaagcaattctcctgcctcagcctccggagtagctgggattacaggtgtgcaccaccatgcctggataatttttgtattcttagtagagacagggtttcaccatgttggccaggctgatttcgaactcctgacctcgtgatctgcccaccttggcctctcaaagtgctgggattacaggtgtgaaccaccgcgcccggccaggatgtccattattaaaagaaaattaaaagtaagtattgttgaggatgcggagaaattgcaacctttgtgcactgctggtgggaatataaaatggtgcagctactgtggaaaacagcatggtgctttctcaaaaaaattaaaagtagaattaccatataatccagccattccacttatgaatacagaaccaaaagaactgaaagcaaggatttaaatagatatttgtgactatagtcaataataatttaattgtacattttaaaataactaaaagagtataattagattatttgtaacacaaaggataataaatacatgaggggacagatatcccattttacgtgatgtgattaatacacattgcatgcctgtatcaagactgtacaaacaaaatgtgatatatatatatatatatatatatatatatatatatatattattcagcctttaaaacaaagttctgacacagctacaccttgaagacattatggtaagtgacggatgggtgaactttgaagacattatgctaagtgaaataagccagttacaaaatcactgtatgattccccttgtatgaagtacctagagtagtcatattcatagagccagagagtagaggttgccagaggttgcgaaagggaggaatggagtatggactttcaatttggaaagatgaaaaaagttctggagatggtggtgatggttgcacaacaatgtgaatgtacttaatgccactgaactatatacttaataatacttaaaataagttttaccaccattaaaaaaaaactttctagagccaccattttagcttgactggggtctcctgggttgttcgtaacctagagtagtggctctttccactgctgacagatagcaaatccagagcagacacctcgtgtaagagctacctcttagcagaactatgattcaggtttgtgtgcattacatttaagccagctgacatatcactttctttctcactgctgtgtacacaatagtgacatgatcaaacttgaaagtgcatgagaaacaatcacttggagaacttgttaaaaatgcggattcacaaaatcatctcttccatcaaactaatgtagtaggtatatcagctagtttgtgctatataacaagccacccccaaaactaagtgatttaacataactgtttattattttatagcctatgagttggctggatggttctgctcatctgggccaggcttcgctgatcatagatgtactcagctgcagtcagccagtgggttaaccagggcttggcttttccaggatggcctcagttgggatgactttaatctgctctacgtggcctctcatcctcaaaacatcagcccaggcttgtttttgtgctgtggcaggagtctaagcaagcaagcacaataatatgagggaacaagaagaaatgcacatgagctcttcaagtttctgcttgcatcctatttgctaacgtcctattggccaaagcaagttacatggctgagtggagattcagagtgggaggggtgtacaaagagggcaatagcaaggatgtagagaggtcactgggtccactaatgcagttaatctactacagtaggtttcagtaaagcctcggaatctacatatttagcaagcttctcaaagtgatttttttctttctctctttctctctttctgtctctctctttctctctccttccttccttccttccttctttctttctcatgatctcactgtcacccaggctggagtgcaatggtgccatcacagctcactgcagcctcaaactcacaggctcaagcaatcctcccgcctcagcctcccaaatagctggaactacaggcatgcaccaccaggcctagctgtttaaaaaaaaaattacagagatgaggtgtcattatgttgccaaggctgatctcaaactcctgggctcaagcaatcctcccacctcggcctgtcaaagcactgggattacaggtgtgagccaccatgcccagcctaaagtgatactgatgcaggctatcccttaatattttcagaaatattattctagtatctcttaacaccaagattggaaccagcatcattgaacgttcagaaaacgaagactcagtggggaagggagcacttattcttctccttatttccagcttatgattcaggcctcttggtctcttagaggcagatgctgaaacgaacactctctgtctgcttttcagacaatctcatataatcatttacttgttacaaagaacaatggagttggattaaactgataaagtgttatttttcaatgcaggtcaggaaggcattgttggtttgttttgcattgctcattataatttctatttttgtcctggggaagctcatggtaatggaatgaagcatcgaggtggtttatgggccatgtgataggatcataaagttgaggttgttgcttggacaatacctttcttagaatagtaatccaagcaaagagaacatggacaggaaagaaaagaaacaataagaagaaacttcagttatttagccagttgtatgaggttttcattgctcagatccttagttaaaatgtgggatcagaggcctgcaggtaatgcctgagctcaggaaaggcagggaccatgatgcttttgcattcctgatacgaaccacagtgccaaccacattgtcagtactcaaaacgtatttgttgaatgaatttctgctaattcctgggatctattctcagagattctgattgagcaggataagtaaatagtttttcacagtgtggtccctgaaccatctgcatcagaatcacctacagggcttgtttaaaaaatgaatgccagggccgggcatggtagctcatgcctataatcccagcactttcggaggctgaggctggaggatcacctgaggtcaggagtctgagatcagcctggccaacatggggaaacccagtctctactaaaaatacaaaaattagccaggcgtggtagcacaggcctgtagtcccagctactctgtaggctgatgcaggagaatggcttgaacccaggaggtggaggttgcagtgagccaagatcacaccagtgcactccagcctgggtgacaaagtgagtgagactccatctcaaaaaacaaacaaacaaacaaaaatgaatgccaggatcccaccttctacttcttgcgtttgatgcatgagaaatcctagtttacacattttattaaatctgggactggttgtaactggcactaatgtagtcttgtgtgaaggtagtggtgcgatggtcattctctacccttgccccacctgagagcctctagagggaaggctgtggtccagtgcactgacctgaaccctcaccacatgcgtcccacacatatggaattgggagcagtcatttagcatctcttagccatttcgctctaatttctttgtttgccatttttgttgactttttccttgggaacctgaatttaaactcatgccacttttttgtcttccttattctagtgggtaggaatttgatcttgaccccaaaagcaatgataggttcctacagttctgtaaagtatccattgcttctgaaaggccttctttccccattgtctttgacaatttagattttccaagtgctaggattttggagaaagtggagccatgagcccaggcaagtggggtagcctgataatgccctcccatgacacatggggctggggatgtaaaaacttcagagtttccatgtcaaataatctcctttgccctgtggccttcggttacaggaatcatttatattacaggcacattttgaaatatcaaaacaaattggacactttttccctattaggaagaaaggcatgttaatttaagtgtggagtgtgacatttggaaatgtaaaaagaggcttttggggagtagttgggggtttgagtggaatatctccctttttgtatatctctcttgtttttattcatcctgtgtcttattcagatagtgattttcattcacctgcctgatcttctggaacagggattttagagaaagccattttctcagcagctccacaagggcgagatttccaaatgggcaaggaaaggctgcagagacacatctagcttggaagtaaatgcaccaagccagccaaattggaattgtcttatagggatccttgtgtgctgtcacagaagagttttcaggaggctttcctttgggcactaatggccaaccactgctgctgagtttctcccagccttctggagggaatgccagccagcgcactctcagctgtgacatgaccctcctaggagctgttcaatgctagcgccgttttgctctgatgcccagcaccctctgcttttagtcactttccttagcgtcctttcgcagtgcttgcatttcagccaaaatcgtgcctcgtgacttttcttttcctagagttttcgcttctcacagtgaagaatctatcagctgtttcctgaatccttctatgtcttttaaggtgttaacattttcaattttgccacattcagcatttttggcctactctgacctgagctcgataaagagcatcagaaattgagtaaagacagaaataagtccctataagcatgagccctggcactgtccacttcctcctcctcccctaccctgacagcactaatctcccttcagctctactcattggaccccctttattctttaggctctctttagtgatttatcttagtttagctatgagaagaatcaagctttttaagggcttcgctgaaaacgtaatgaaagttgtttcaactctttaaattttaagtgaattgtggccatctcaggcccactagttcatgtacctgatacaatttttatttggagccactgtattcacatcttcctgggacaggatttcacataattggggtaggttaatgagtgtggatttggcactccctttctatagagagtggtaaggagctcaggccttggagtcagtcaggtgtggttccaatcctggatctactattaggttggtccgaaagtaattgccatttcggccattaaaagtaaccgcaaatacttttgcaccaacctaatacttagtagctgtgcagtcttgggtaactcgtttcacctttcttgtgtctcaatgtcctcatttgtaaaatgggcacaatagtcccaatcacataggttgaagactaaaccaaagaccccatttcattagcttagccttatccctggcagataccatgaactcatatgtcattataattatgataatttacttaccctttcaattaggggtataagatgctacacagttttcctctaggacagggcccgcaaaccatggcctgcagcttgcctgtgagctaacaatgattttcatatttttaaaaggttgaaaaaaatcaaaagaagagtgccgtttcgtggcatagggaaattatatgaaattcaaatttcagtgtccataaataaagttttattggaacacaactgtgctcactcatttatatattgtctatggctgcttttgctctatcatagcagagttgagtggttgtgatagagattctatggcctagaaagcctaaatatttgccaccttgccgaccacttgccctaagacatttagccatgtctctggaacatcactgtgatagatagttcaggaattatttgcatattatcatcactgttattccaaaactctgactgcgtgtgtttctgtgtggagagtgatttacaaaggaagaaattatacaagtcataacaaaaagaaaaaaaaaaaattacacaggtccatgtaagacaaatgagatgaggcttttgtggcagttttagctaaggactcactttgtgccttcgagggatcagaaagaatttagaagtagtagcaatattggttaggagaatttacagattctcttgttttcttttcctctatcagtaccttctctgcaaggaggagagaatggatgttagtttctccttgtaagatgaattgaattgcttgtgttagtgtactaggactctgggttggttgtgaatgtggtataccaaggcaaagtctcatctgagcaaataccaccataacaccctgttctcccccaaaaggcaatctctgtagagaattataaaatcttagaatatcaagattggaaggagcctggagatctgagggaatgatattgatattaatatctccttgccgatgtagatacaatatcctgtttgaaggcaaaacattgtgtaataaacccagtctactcaatctattcaactaaggtggcctctagtgggtgtctgagtactggaactagatttgaatacttgtgagatattaaatttcatatgctttacaaaacgtgcagccatccgggcacacaaacaaaatgcccacttttggatgtgaaagtgggggcaggagtttttcccatttaggagctaaaagctctggagctctggtcctcagattcatcttgtgtctggcctgtggtcgcagtgagatgccttttcagtagggatgaggtatacttggggctgggagaggggggacatttggaggtctggcctcccaggggtaggtatgtgtttagccgggctatgcagatgaaccaatctgggtgtctctgtcagggaagaggctaggaaagctgctggtgagaggggtcagagactggtttgccccaagggggatgggggaggcagggaggctgtagaggagctgttgggccagatcttgttgagaaaatctctcagacccgagacttctcccctcctctcatttcctatatttgggctttcacacttaagggactggtcttaaggagagatgtactttttaacatttgatttgcccatgttgtgccccgtacttctgcgtaccaccagaagaccacaatgacaaagaccagcgaaggccaaaggtggccatgtgtgtatagaattgacactccaaggtcaccggatctgcaatctaccaaacagtcttgactcacaccctcaggtttcatatttgaacctcctttgcagggctggtcctggctcctttcaccttctagactgcctttcctttcttactgtcctctgagaggcacactgaacatctgtggacagtggcagttggtagctatatatatacatgtatatatatcagaatttcctctttgtacactgtagcagtggacttccattttgatgatattatacagggtataaatctgcctatctcaacaagttgctttaaagaagaatcagtttcaatgtccaaactaccacttcagtaaagtaacagagccaatgccctgtgtctttttcctttatttatttatttattttgacataggttcttgttctgttgctcaggctggagtgtagtggtttgatctcggctcatagcagcctcaacctcccgggctcaagcaatcctcccatctcagcctcccaagtagctgggactataggcacatagctaactaatttttaaaaattttttattttgtagaaatgaggtttcaccatgttgcccaggctggtctcaaacttctgagctcaagcgatcctcctgcctcagcctcccaaagtgctgggattacaggtgtgaaccaccatgcccacccccctttttcttatgaatgggtgaagcaggagaagagcagtgagtatggctagagatgctgacaccatgtagtatagcaacttgtgggcttctgccttcttcctcaagatgaggccaagaagagcactgggacttccagcctctggtgcatgtgtttcctctgggctaggtggtatgtggtgtccaggtatctgcacacttgctcggggcagggttctaagcagtggatggtggcaatggatatggccaacaagagacaatcatggcagtgtcactgagctgtgaactcccacagaatcttttggcctcccaagctcagagaagaagcttaagggagaaaacctgtcaacagtccttttgccatatttattcactggagtcacacttttataacaggcataggctcaaaggtgtaaataaagccaattattttagttcagcattgattttcatatataaattatcaatatagttttgatttagtaataaaaataacagcctggagttttatcccctgccatggccagtgagagctgtttttaagctgtttctttgtacagggaagcatgtgtcaaagtcacacctcctgattaataaaaacaataaccttttagtccttcctatgttccaggcattgtgcagagggctcacaaatactatttcatgtaatgctactcataattctctgaggtagattagtatttgtatacgtatgttatagacggggaagctgaggctcaggaaatcacttacccaagacagcagctggcaattctaagaaaatttttgaaattctaaaatgcatctgaggacctggcactgtggctcatgcctgtaatcccagcactttgagaggccgaggtgggtggatcacttgaggccaggagttcgagactagcctggccaacatggcgaaaccccatctctactaaaaatacaaaaattagccaggaatggtggtgggcacctgtaatcccagttactcaggaggctaaggcacgagaatcgcttgaaccagagaggtggaggctgcagtgagccgagattgtgccactgcactccagcctgggtgacaaagcaagactctgactcaaataataaaataaaataaagcacgtctgctgccttcacaccccattttctgtaccatgcatgtcaacttctatagggcccttctcttgtatgggtgtccattaggtcatatcttgcagatatggcagagctagagacctagaggtaaagcaagatactaggaaaacaagtaaaagggagctattttctgggagactaggaaaaagaagagactaggaaaagtaagtgaagaagctctaactagtagggggccaataaggggcaaacaaaggagagaagctggctgcttagctaaccaagtagagagcctcggatctggaaggaactggaccgaacatctgtaactgggcagggctggccttgggcctgtcttgacttccttgaaatgtctcttttacctggcctccttctcatggctgtcatcaagcagccctgttgatcatgttcctgaggaaggacagaatggggttggggagattaagtttattagcaaggcaatttcctctagggagaccccaaacctggcttggtaactacagtgaaaggagagcgtttgagccccttcccccttctgcttgatctcctctccttcaccaggctttcttcagacctggttccaatcattataaggcagatctaaagccactcttcctgacactgaaactttgctgagcctggaaaaatcacagaggctcagtttggtgtttttgcatgcaaaatacgagaggcagaggtgaaggtgcattcctggtgccctgcggttcccaggcagtatctgagtgcattttcacctgttatcgcttgcctttcaaatattcgttagctcccccagaagtttagccacgagtcatcttctaggggaaatagctgctctgctctgtttgtagaatctcatagtttattttggaatgaagatgtattttcctggaaaagtgttactactttacagtgtccccttcatctgcgaaactgaaaaggcaggcagccttgctgtatgagaagaccacacacttgcggacagaaaaaagatgcatccgggcttctcttcaagtccaagacaattgatgacaaaggaagtatgacacaaacttattgagatctgttattatccttgtgctgcccgggttttagacaaaaacaataagcagattacataagtgagtgtcaccacttttgcataaccaaggtttcatttttctcttctcacttggttagtcttccgtgagctaagcaacatcatggtagttttctgtagtaccacttatggctttccttgttatcatcacctgcctttgacacatgccttcattaatgagttgatatatttaattatatgttatacagatattttatattacaagcaatgttaattgcattcattcagaacagctcccaattaaaatctataaactacttagacctctataaaaatcccaccatttaccttacagcttcacattaatatttaccctggagaggataaacatctcatcctgtatttatctgttagatcatttttgttgtcataaaaaacaaaagccacatgtttaattggatcccttcggtatgaatttttaaaataatagtaggaatccttacttgggaagatggtttcatagggcatcctaaaaccatcctttgttccaaatcctttgaggatgcacacatttaatgttttccttcttactactatgctatgaacttaacagtgctacatgctaaagtacaggcagcagaagttctctgggaaagtggagatccctagcaagtaaggaacccaagagaaggccattctaagctgtagtcccttgttggaccaagggaggaaggaaacagatagcatccacctggcgctgcaattctactggcctgtggggtggtctggctttaggaagctcactgtgtaatccatcagaggacaatcctgccaagtcttcttttcaagtaaaaaatgttaatgtttctttccatactttgtctcataatcaatattcaattttcaaggcagtaaaactaatcaaagaatataaaatgaatccaacacaagagaaaggagggagaatgagtaagctgcaaatgggactgagcaagaaaataggaggatattataactatagaattttttttttttgagacagagtcttgctttgtcacccaggctggagtgcagtgacgcgatctcgactcactgcaacctctgcctcccgggttcaagcaattctcttcttcctgttggtgaatttctcccaggaggcatgagccaagatcctgtttcatgggtttctgggtataccccttgaaacaccagagtcaggagtcaggaacaacacctagtgtattagttggttttcacactgctgtaaataactgcccgagactggataatttataaagaaaagagatttaatggactcaaagttccacagggctggggaggcctcaggaaacttacaattatggctgaaggggaagcaggaacgtcttacatggcagcaggtgagagaagaaagtgaaggaggaacagccaaacacttataaaaccatcagatgtcatgagaattcactcactgtcacaagaacagcatgggagaaaccacccctatgatccaatcacttcccaccaggtttctccctcaacacctggggattacaatttgagatgagatttgggtgggggcacaaaaccaaactctgttacccagttagaaaccggccagtcagcatgtagtccctctggagctcacaattgcagatcatggtatgatggagttctccactgcacggtaggctctggggcttaggcaggcatatggggcagcagtcaacataggggatggtgggagtgaggtgctctacagcagtggtcctcgacttttttagcaccagggaccagtttcatggaaaacaatgtttccatgggcttagggggtgggagatggtttcaggatgcttcaagtgcattacatttattgtgcactttattttgataattattatgttgtaatatataatgaaataattatacaactcactataatgtggaatcagtgggagccctgagcttgttttcctgcaattagatggtcccatctggaggtgatgggagacagtgacagatcatcaggcattagattctcataaagagcacacaacttagatccctcacatgtgcagttcacaatagggtttgcactgccatgagaatctaatgccactactgatctgactggaggcagaacagagctcaggcagtaatgcaagtgatagggaatggctgtaaatacagatgaagcttagctcgctcatctaccgctcacctcctgctgtgtgacccggtccatggcctgagggttggggacccatgctctacagcactgttatggcatgttccagactcttgagaatcggtccttccttgcatctcacctcaccttcaactttattgttcacttttagttcaacctttgccagcaggtaaagaggtaaagagaacaatgtgtcctgtgaagtatttatgagagaagcagataaatcattagatttattgagaacttttgaagtgcactaggcatctcacacacattacttcattgaatcacctccataatcctatgtggttgataattatattatccccacattctggatgaagaaagtggagctcagagaggttatcatgacatacatactgctcacaaaaccattctgtggcagaagtagattcaacagctcaaaaataaaagagggctgggcacagcagctcacacctgtaatcctagcacttttggaggctaaagtgggtggattgcttgatcccaggagtttgagaccagcctgggcaacatagtgagaccctgtttctaccaaaaaatgcaaaaaacaaaaattaggcaggcgtgatggcatgcacctgtagtatagcttcttgggaggctgaggttggaggattgattaagcctggaaggttgaggctgcagtgagcagtgattgtaccactgcactccagcctggatgacagggcaagaccctgtctcaaaataattaaaaaaaaaaaaagtaaaagagaacatgatgatttatggggaaattgacactaaaaatgtcttggatgaaataaagtgacccaggcatcaggatttaggggcttacatgggataacactgttctactccatagcacctcacctgtctaattagtgtctaattagagacatttttaatcagataagtgcatttatgaacattgcaatttttcccaaagtttaaccatcagtttctctgaaaggacttctaaagcctagaaactcacctcttgttaatagtgctgctcttcctcttaaggattctgcccaggagttcaacaccagcctgggcaacataggtagaactttgtaaagtggaataatgctattctaataacttatttagcaaacatttactgagcaattaccctgggtcaggcctccttgcaaggttctggggacatagacatgagggaattctcacccttgaggccatcacagtcagctagggaagaaaagaagtaaacagatcattataaaaccctgagataagtgctactgtgaaggtatgtaactctgtcccctgggtgctttggaagtgtgagagcttgggacattgtagcaggatgttggtagctccatcagatctggagtcttttccaccttgaacttgagatcagcctaaagccaaacacttgacttttaaatgatttgattttaacagaatcaactttttattatgcaaactcaaaagatgtattctgtagagttttactgagccttttttccctttaaaataactaactatatgttttgacatgcttcaggggactttttttgtaaaatagcacaaataggacaatactggaatacatcagtgtgctgtgaagcctgaatgagtaatacacaagtgactgcactttcaaaaatgtaaagaaaagtaacatgctaaaaatcataaactacaaagaggcggcatagcttggtgagacaagcgttgacttgtgaacaggaaaaaaaggatccctgctggctattctgctgagtgaccccaggaggtccctgttcctcttgggacctcagtttcctggttggtggaatgggtattggatgagaatctcaatctgaagatctgcattccctttcaagtcgctaaaatcctggacttctacgataatgctgcatccttctgaggttccaaacaacaatatgcagtaggggccccttttgcttccttccttgcatgtatccaggcagtctcctgagagcatccagcattggggaggaatggggtgtattgaagggaaaagcaggtgccccattgggaatgggacactcccgccccccgccctacctccttctttcaacttgacttccttttttttttttttttgagacaaagtctcattctgttgcccaggctggagtgcagaggcgcgatctgggctcactgcaacctccacctcccaggttcaagcgattctcctgcctcagtctcttgagtagctgggattacaggcatgcactattatgcccagctaattttgtatttttttagtagagactggctttcaccatgttggccaggctggtcttgaactcctgacctcaggtgatccacctgcctcagcctcccaaagtgctgggattacaggcataagccaccgcacccggcctcaacttgactccctttcttgtcactgtttctagatggtcaactagatcaatactcagatcagctcttctttcagaggaacaaatgagaactttcctcttgttctccatctcctccttctcctaatgcacacacatgtgcatacacacactccactgccatcactagagagaaggaattaggtccaaacctctgttcgcactcagagtcttaaagtgacagctttacgtttacaagttaggcattaaatggaattccattctccctgtcaagtttcagacaggggaaagcccagaattccaatagtgatggtgttcttggcaagcgctttttacagggtggtaagctaatcagtctgcagttcggcagtctgaaggcttgagctttcatctgacttggaatatataaagggcttggcattgcagcttccaaccctatgacttagctttgagcttcgcatcttcccatcaacttcgtagctctctccatcaaccaagtacccactacaatcaaggagaaaggatatggcagattaattgaatctttgtgtctttttagcacctgtgggctatggacttcttgaaattggagttacttttattcctttgaattgagcccaataccccgcttcagtcagggtgcttttaccttcccagaatcctcttgctaaggacaagcaggcaggctaatcggggactactgaagttttctggctcaaagaacataatgcagtgtgtttacaaatccacctcttcgccttcaccctaaattttcctttcctttatatgattttagcactttgggtttacattaagctctcagttacttaaagtaggctgaagaaaataagaagtgtagtagtgcttcactccccagtgatgaaatagggggtaattggctccaaaaatcgttgcatgtcttgtccctttcagggactttaactgctctgttgcccttgctccatggattggggctgcatcagtagcctaatgtgaggggaatggttgaaagtaattgtcagagcccagagctccacttgccatggaaagcctattgactttaatagtgaccatctggctgggcacctctgaagatgtctcagttaaggcctatttggtgaatggacctttgcttatttgaaagctacactgctgttccaacctgatcattgcattttatgtgatgggcactggaagtccaaatgaaagtttcttagaaaacactcccattaaatttaccagtccatgtgtgattgccactttcagtgcagtcagagcacagtcattctctttttattgaaagcatatggtaggtacttagagcataccctaggccagactcagttatggtgccatcaagggcagcaagaattaaaaagaggaaaatggtatccaggtggcagtaggaattcggtaggttggatggaaaatattcatagttaacgagctttcataaggagaacagaaacaagttagatgtgatttgcagatccataggcaatcagtctctgctgagcagaggggaaacttggagaagattctcagaagtgtgcctcacccttgacccaaacctttccctgaacatgtgcaataaatattattaagctttgagaatttctttaaaataatatctgtcaatggtaagtgccacatgccaggccctatgctaccagcatcatctcatatcatcctcacatgtatcctgtgaggtggaggatactatcccaatgttacagatgagaaaactgagacttaaacattaagttgttcaaggtcatacagctaagaagtcacagagctgctttgattaaagttctgtctgaggctgggtgcggtagtgcatgcctgtaatccaagcactttgggaggccaaggtgggcggattgcttgagccctggagtttgagaccagcctgggcaacatggcaaaaccctgtccctaccaaaaaattacaaaagttagccaggcatagtggtgcacacctgtagtccaagctacttgggaggctgaggtgggagaattacctgagcctggggagcttgaggctgaagtgagccaagactataccactgcactccagcctgagggacacagtgaaactctgtttcataaaaaaaaaggtctctgtgacttcaaggcctttgttctctatactattaggaagtccagtaagtgaagaaaagtacatgtaaatttcactaaaggatcacagcttcttgtacggaagggctttgagcacgtcggctgtggctcctgtgcagccagccagatctgcctaagcagctctgggagtagggccacacaggaatctgtcacagggaggattccacattccttcagcccctatcagcacagtcaaagaatggtaagaagaatgcagagggtggctttgaaatactcacagccttccatggataaaccatggagacattacactcatttgatagaagccagacacaaaaggccatattattgtatgattccatttatatgaaatatcagaataggcaaatccatagaaacagaaagcagattcgtggttggtaggtgatgggggaaagacttcagcaccatccccttccctctcagtctcagtgaagtggaaggaaggagtagtctcagctagggaaaagaggggaaaagctgaagacgacagatttctatgtctcccagtttaattacctttccctttgctctcgcctatgaatgccactgcctgcaggttcttagggaatcaaactgggacttcagtctggaaatgtgctttcaggacaaagacccatgcatacgagacaaggtgacaatcctaaggtggcccccagtacttcggggcagtggaaaggaccttgcgatgggtgccagaaggactaacatcaaggccagctctaccatgtctgaggtgtatgactgtgggcaagtttcttcattacaacttctgcaactgcacagtgactagcataatcctttcccattaggcactgctggatcattgcaaagattaaatgagggccaggtgcagtggcttacgcctgtaatcccagaactgtgggaggccgaggtgggtggattgcttgagcccaggagttcgagaccagcctgggcaacatggcaaaacccagtctctacaaataataataataataataataataataatcatcatcatcatcatcatccaggagtggtgaaatgcacctgtagtcccagctaatcaggaaactgaggtgagaggatcgcttgagcctgggaggacagggctgcagtgagccatgatcatgccactacactccagcctgggcaacagagtaagaccctatttcaaaaataaataaataaataaggagacatatgtgaaagcatttccgaagtctaaagctccacatacacataagtgattataagaaatttaacaaagggtagtcacataattgacattgtcctttggaggagagaaaattggtgctatccccttggtggacaggttccctcatccttaaagcacatttccagagcagaaggaagccttcatctaagtccaagcgctacatttctgatatgagagctagtttgagatttaaatgaaccctgtctctcaagacacagctttgcatctattttgcattcaaatttatttatctagagacaaaattgtgcattctttaattctactcacagcgtatgcacgcagaccaaatgaggtgctgatccagcaaaacggcaagtagccttttgcttccctgaaattgctaattttacaaatggcagagtggtgaaacgtggcacggaatatctattttactagaatccggcaaaacgggcacatatggtcttgtcaagaatgaatcaaacacagtttcgggattataattaagtagttgaaattccaaaaggaagaagttaatatgaacaaagtgagatttcgattgcttttggttagcattctctcaggctccttcctttacacattatcaggaacatagctactttgatttcttgtcctgaaaaatgtttaattgtaaaatatcaaacgttttcaccccaactctaattgtacttgatttgacatctgtacaccatgctcagggtaccaaatattattaaatgtaataagtccaggcatagaagtcaagccaaatgttcctacgtaagtatttaggttgacaccttctgtcaacaaagctaaacctctgaccaattctgtagcaggccaataaagatacaggaggaagatgggaaccattagaagaaaacactctctcctcatctctctctctttcagtactgtttctacctgaaatcagggacatattccattctggtccacaagcccagcatctagcacaggggctggcatgtaaaaagagttgatttgggctgggcgcagtggctcatgctgtaatcccagtactttgggaggctgagatgggtggatcacctgaggtcaggagtttgagaccagtctgaccaacatggtgaaaccccatctctactaaaaatacaaaaattagccaggcgtggtggtgggtgcctataatcccagctactcaggaggctgaggagggaaaattgcctgaacccaggaggcggaggttgtggtgagctgagattgcgccactgcactccagcctgagtgacagagcaagactccatctcaaaaaaaaaaaaaaaaaaaaaaaaaaaaaaggagtttatttggagatttgcaacttgtcatgggaaacattcccagggtttcttctagagttgttgtggacctgattttgggtgctaagtggtaactcactatatcttaaaaacacatcagctaaaaggtggaagcaatctacatgcccatcaactgacgaaggggtaaacaacatgtggtatatccatataatggcacgctatttattcataaacaggactgatatatgctacaacatggataaactatggagacattacactaagtgatagaagccagacacaaaggccatttattgtatgattccatttatatgaaatattagaataagcaaatccatagagacagaaagcagattagtggtgggcaggtgatgggggaagagggagattggtagataatagttaaaggatatgaagtttctatttgaggtgttaaaaatgttcttaaattgattatggcaatggttgcatgactgataatatactaaaaacctcaaattttacactttaaatgggagaattgtatggtatgtgaattatatttcaataaagctgttatataaataaaagtttacttcagattattttgatgtgcacttgcagttcagaagcttgagctagattaacagttcctaaccttagttttggctcctaactcctgtctcctctcagatcttaggaccttcaggttccacacagcctaccttgctgctacctagtttttgaagttctaattcccgaaacaaagaactcccttgaagagcattgatgccatggcggaggagaggaaacaagaacttttggttttaagctgtgtctacacttaaccaccttgtgcccacttgggtaggtgctctatcattgaggatcaggacccaattattcccattctcatgtttttccaggacctgacaaatcctaattcagattgctattccctttgagagtgaaatagcttaggtacgtttcttctacaacaatgcagatattctattaatgaaaggagctgctacaaagtaatttttaatgtttatataggaaagtgtaactttttttttttctggagacaggctcttgctttgttgcccaggctgaagtgcagtggcacggttatggcttactgcagcctcaatttcctgggctcaagtgatcctcccacttcatcctctcaagtagctggaactacaagtatgtgccactacacccagctatttgtttgatttttttttttttttgtagaaatgggctctcactaggaaattgtaagaaaaaggagtagctttcttaaaaccctggtttaacatgacaaacccaaaacattgagctgtacacttcattggttaaatcttctttttgcttatttaaagaaaggacaagaaaaaagaaaagaaaaacttttttgctagttcacacctcaaggtacacccagtttctgactttaaagggaatcagtccaaagtaacaaaatattattttgacatctgaaaaagaaaatgctcgttttataaattggatagtgatttctaaccattgttgatggacatagatatcttttgttaaagcctcatcaataagctcatatttctaggagatcatattgcgatgagaattatgaagagggaactggaggtccatgctggaaagtcagtactcctttaattcaactaaaaatatttattcaatagttaaatattgactgtgatatcaagtattttgaatgttggtaaaaattaaaggttttggcaaaatagacaatggtatacttacaagttttctgagggtggttcccagaatatattacccaaaatactatacagtgagaagtgatagtcaccattccatgtctttgaccacaaacatatcttaagattttctttgaagagggttttttagctttttgagacagagtcttgctctatcacccaggctggaatgcagcggtgcagtcatgggtcactgcagcctcaaactcctgggctcaagcaatcctcctgcctcagcctcccaagtagccgggactacaagcacatgccaccacatttggctaattaaaaaaaaaaatgtagagacgggatctcaccatgttgaccagactaggctggtcttgaacttctggcctcaagtcattttcccaccccggcttcccaaagtgttgagattacaggcctgagccaccacacccagcctgaagagggtttacaaaattatttcaccaacatgtaagaaaatgtaataggcattttaaagtttaaccattgtcagtcactcttttaatgccttagtacccagaacagtgctacttttagagatacgtatgtatctattttctgaattcatttttggttgcaaagcatcattctacaaacattatgaaagagagccaaatactgtgacttcaaggattatccaatactctataattagtttcatgaccaaaatgctttgaataactgaaaagatgagtgaatgactggatacatgaatacatatcatccatttatatgaaaatacttttgaatacaggcatatcttagagatactgcgggtttcgttccagaccaccccacaataacatgaatattgcaaaacagtgagtcacatgaattttttggtttcctagtgcatatagaagttatatttacaacatactatgttctattaagtgtgaaataacattatgatgactaaaaaatgtacatgccttaatttaaaaagagtttactgctaaaaaaaagaggctatcatctaagctttcaatgagttgtcgttgttttgctggtgaagggtcttgcctcgatgtgcatggttgctgactaatcagggtggtcgttgctaaaggttggggtggctgtggcactttcttaaaataagacaacagtgaagtttgccacatcaattgactcttcctttcacaaaagatttctctgtagcatgtgatgctgtttgagaggattttacccacagtaaaacttctttcaaaattggagtccatcttctcaaactctgctgttgctttatcaactaagtttatgtaatattctaaatgttttcttgtcatttcaacacgattattcacagcatcttcaccaggagtagatcctatctcaagaaaccactttctttgctaatccttaagaagcagctactcattccttcaagtttgatcatgagattgtagcaatccagtcacatcttgctcctcctctaattctagttctcttgctgtttccaccacatctgcagtgacttcctccactgaagtcttgagcccccaaagtgattaatgagggttggaatcagcttcttccaaactcccgttaatgttgaaattttgacctcctccattgaattacaaatgttcttaatgacatctagagtggtagatcagttccagaaggtttttactttacttttcccagatccatcagaatcaatatggcagctatagccttacaaaatgtatttattaaatgataagacttgaaagttgaaattattccttgatccgtcaactgaagaatggatgttgtgttagcaggcatgaaaacaacattgatctctttgtagagctctgtgtagatctccatgagagctctcaggtgaccagatcagtgagcaacaatattttgaaaggaatcatttttctgagcagtaggtctcaatggtgggtttaaaatattcactaaatcatgctataaacagatgtgctttaatccaggttttgttgttccatttatagattactgactgagtagatttaacataattcttaatggccctaggagttttgaaatggtaaatgagcattagcttcaacttaaagtcatcagctacattagctcctaacgagagagtgatgctgttcgttgaagctttgaagccaaatatagatttctctctagctatgaaagccctagatggcatttacttccaatataagtctgattaatctacattgaaaatctgttgtttggcatagccaccttcataaatgatcttacctgtgtcttctggataactggctatagcttttaactcagtacttgctgtttcactttgaacttttatgttctggagacagcttatttccttaaacctcatgaaccaacctctgctagcttccaacttgtgttctgcagcttcctcagcactcttagcctttacagaattgaagagagttagagccttgctctggatcaggctttggcttaagggaattttgtggctgttttgatctatccagaccactaaaatgttctccatatccgcaataaggctgttttgctttcttatcatttgtgggttcaccagagtggcacttttaatttccttcaagaactcttcctgatcaatcacaacttgacaaactgtttggcacaagaggcctagcttttaccaagaggcctagttttcagactatcttggcttttaacgtgccttcctcactaagtttaatcatttccagcttttgatttaaagtgagagatgtgggactctttctttcacttgaacacttagagaccattgtagggtagttactggcctaatttcagtattgttgtgtctcaggaaatagcgaggcccaaggagagggagagagatgaaggaatggctagttagtggagcagtctgaacacgcacaacttctaccaattaagttcaccagtttatttgggtgcagtttatggtgcccgcaagtaattacaagagtaacatcaatgatcactgattacagatgaccataacagatatagtaataatgaaaaaatttgaaatattgtgaaaattaccaaaatgtaacacagagacatgaagtgagcacatgctgttggaaaaatggagccaatagacttactcaatgcagggttactacaaatcttcaatttgtaaaaatcccagtatctttgaggcacaatgaaatgaggtatgcttgtctctactttctgaatatgcttttggttgcaaagaatcattctgcaaacaacatgaaaaaagatccaaacactgagacttcaaaggttattcaataccctatcgttagtttcataaccaaacaaagagaaatgccttgaataaccaaagggatgaatgaatgaatgatggatagataaacacatgtcatcaattcatccaaaaatacctcttttttttttttgagatggagtctcgctctgtcacctaggctggagtgcagtggcttgaactctgctcactgcaatctctgcctcccgggttcaagtgattctccggcctcagcctcctgagcagctggcattacaggcatgtaccacaacgcccagctaagttttgtattcttagtagagatgggggtttcgccgtgctcaccaggctggtctcgaactcctgacctcaggtgatccacctgcctcggcctcccaaagtgcagggattacaggcgtgagcctctgtgttaaaaatactttggagtatataggccaggcacggtggctcacgcctgtaatcccagcactttgggaggccaagacaggtggatcatgaggtcaggagctcgagaccagcctggccaaaatggtgaaacccccatctctactaaaaatacaaaaattagctggacgtggtggtgggtgcctgtaatcccagctacttgggaggctgaggcaggagaatcgtttgaatctgggagatggaggttgcagtgagctgagatcgcaccactgcactccagcctgggcgacagagcaagactctgtattgaaaaaatatatatatatattatataaatataataatatattataaatatatacatatatatacatatatgtatatatatgtgtatatatatatgtgtatatatatatgtgtatatatatatgtatatatatatatatatatacatatatatatacacacacacactttggagtatatagttttaatggtggtaagtgctctaaaagaagaagcaagtgctatgagagcatatattagggacctttgacccagcttgggatttatgtttaatttgagacgtgaaaatgattaggagctaagaggggttaggctggagagagggtccaggtagagacaatatgtggatccaagaaggaagaacaaagggatcaacaaagtgatagaaataggccgggaggggtggctcacgtctgtaatcccagcactttgggaggctaaggcgagtggattgcctgaggtcaggagttcgagaccagcctgaccaacatggtgaaacctcgtctctactgaaaatacaaaaattagctgggcatggtggcaggcgcctgtaatcccagctacttgggaggctgaggtaggagagtcacttgaaaccgggagccggaggttgcagtgagctgagacagggccttggcactccatccagcctaggtaacaagagcgaaactctgtcaaaaaaaaaaaagtaatagaaacaaagacaggaagcaaagagaaagaagataatgacaaggattaaagatgcagctttgaggatggcaaaaccgcagagaggagaactattaggatggtgcaaaggtaattgccagtttcaccactaaaagtaatgacaaagctcaaggtggtggtaggagggacagctgagtgactcctgagaaaatgtaaagtgctgaacctttgtagtttggaagacttggttaaccagaatgattcattccccaattatgccacatcttcaagattttactgtaaaagcaagcaggctggccctggcattcctaccataagctggtgcttcaacttccacatctggcagaggctctagatgtcacataaattgaacatagtcatccagctcaaagggggcttggggtcattgagtccaattttcattttatagctacaaagtactgataactaaaatttacaaagtaatgcacacgtggcagccactgttctaagtgtttactgtgtattaccccatttaaccctcagaacaacccagtgaagtagaaactattatgattcccatttacagatgagggaactgagacacagagaagttaagtgacttgcctatggggtcacacagctcattagtggtgctgtagaccttgggtataatcacttgtctgtatctctcaaaaatcatacagctggatagcagcagatccaagaatggactcggctgtctcccagtgcagtgccctttctactatggtaaccagaactcgacggtgctccctcagttggttgtaaataacataatcccatagtaattgcaaggatgagaatgaacttttcagtctccctgtccccacgtttttggaatggttctacctctgagagcacatgaactcagcctagttttggggctggtctgcccccaattttaacttccatcatggcattgccatttgaacagtgagtgttttggagctggcagaaggtatttttgcgcttcaattcaattcagcgatcgtgttagaagccatcctccaagtgtccaatgatgttagtgtgtccctttgggagtgatttatagtcaaatgggctgcattatagggtgatgtgctgaacaggggaccaaagtatgaccagcaatgctagagattagatttcaaggtcgttgagtaaacctgttgtcaggatttccagggatgatttgattgggaagaaaatgcatctttgtttcatcatttcaaagcaattttatgctttggttctccccgtttctgtcttctgaacacttccaaggccacacttgagcctcagcatcagcctgaagtcttgtgtgatagagttgccatgcaaggtctctctgggggtatgttgaaagctaccagtaagacttgactttgataaaacgtttaattgttttcttttgcctcaattaagttgagaagactcaaatgtagcttttaaattgaaaagtgtaactgagtgagaaggtttatatcaaatattgaaaggctaaggagccttttaatacattgttagctgtcaatgtgtttcaacaaattgtttcagtcactgttgtgtttcagtcactattacaactggggcctgcaatctgaagtgactcaggggtccatatctctggacaaggatatccacttttctgaaccgaaccaaggacgaggtagagtgggacagaaaaggacagattctagagagctttcccaagggacacgtctggcacctggaagtggtcgagcctaatgtgtaaagatttcaaataccatctggtcatttctttaggacctcatttgacaatctgtgggattgttttttgatgtggtgccagcccgaccaaatgaagtttctttcaatggtgtggttggtgtctgctgagaaagcagaagagggggctcttgtttagctcacaaccattgtgtgttaggcattatgcttgagcattttacatgttctggaagtattctcaaccctggctgcgatttcagtcacccagggagcttttcagaaacactgaggctcacacctgtgatcccagcacgtttggaggccaaggcgggcagatcacttgaggccaggagtttgagaccagcctagctaacatagcaaaaccctgtctctactaaaaatacaaaaactagccaggcgtggtggcgtgtgcctgtaatcccagctacttgggaggctgaggcaggagaatcacttgaacctgggaggcgccggttgtggtgagccgagagtgcaccactgctctccagcctgggtgacggagcgagactgcctcaacaaacaaacaaacaaacaaacaagcaaaaagagacattgaggctcagttcccatatcctaagattctaattcattcagtcttaagtaagaatcggggcgtttgtaattttaaaggcttgtcagatgactcatgtgcaaccgaggtggagaacccctaacttagagtgtcttgttgaatttggggatatttttctgctctgctcatccatccgcttgcaacttagagggagagtcacattcttcatggtgacaagagtgagaagtgtatacgttggcctcaatactccgaatgcctgtgccaaattccttcggcaccttgctttgatggtttggattgcctccctctcctgcctgattccagctaatattgctagctttccaggcgaatatttttggcaacccttgccttctgcattcaaaagaattgcttgccttcattactttatgactctcccagtgtgcaaaagtctatggagaggagacttttaggaggccccaagcaaataaggcctcatcttccatttaaggcttcattcccaggaactttcccaatacaaacctcagtgctcctgggctggccttgctggagagggcttcctgaggcggagttattgggacctgagggaggggttcctagagtgcagcaattccagactgaaattcccaggcttggggtctccctgggaattccctcaggaggaccctgtgtgcatttgggtgaaagaaagctattgttgaggaaatttgccctgccagggaccccagggcctactttgggtgtgtgtgggtgggtagagatgaaggggaaagttccagctgcttcagatggtggcgaatgacttaaacaaacaaggactggggcttggaagaggagagactgcacgtgcctgggcaggtttcaggttcctgacaaagagacaaatctgagagagatttacagacaccctctccatctatcacacaaatctgtgtcaagattttgagtctgcaaaacagcaccagcattatttcattgtctctgtgatttaggaaatgagattgaacacttgtggaatacccactgtgtgccaagcaccaggcaccagggtattcattcacccatatgttaccctagcaaatgatttgattttcaaagtatgccctgaagtgcctatgattactatcccaattttatggatttagaaactgaggcccaggtcactgacatgatttactcaaggttacacaaactgtgtaagaacctgggttaacctgacatataattgaagttatgcttcttttacttcacctctcatgaccctcttcccctatgtctttttaaaaggatatacatattgttacttttcttctcctaaatgttgcctagatttgctttctccatagtttcacctttcattcttctttggttcctgaatctggcttctatcccagcatctccaatgaagcagtactcctgtaggtcatttgatgaccaaaccatcaaacccaaccctaatcagtccttatctaacctgccttcatagtatttagcatgaatggtctctctctctctcttgaattggactatctcattcattttcataggtgtaccagctctatgctgatcaatctcaaatctacctctgcagtcctgacctctctcctaagcttcaggcttatccatctactgcctactagacttattcatctgggatatcctacagaggctccacacactcccaaaaggaatccagcatttctcctaaccaccaccccattcaaccccctttgcaggatctatgaagccagcaacttgggtgtatcttttccctcacccactcatctaaatcagtccatcaagttctctccattctgttttgtgattatttcttaaagacgatctctctcttctctacgcccaagactccttctttaagtgaggattcttttcaagagccttctaaaaagtctctctgaatctgcttcactgcatgagtctgttttccatgccgctgacagagatcttttgaggtgctaattaaactgttccatggctctcagaacctctattttccaaagtacatttgcaacctatttttccaggatactctgtgaaaaataggaccactgtggtcaagtagctttggaaactttctgtgtactatactttttgtttccttttggagattcagatagcatattaaatgtcctgagaatcccttaagttaaaaacaggcttacatttacatacttcagcatcccaaatggatttcatcatggaatcacccctcctcccaaacactcatatttttaagcatgagtcctgctcacaaccttctgcagaacacatttgaaaccacaggatgaatgctgtgatccttggcctgccatacaaggctcttgttcatctgacctctgttcacctgttgatatggttaggctttgtgtccccacccaaatcacatcttgaattgtaatccccataatccccatgtttcaagggagagaccaggtggaggtgattgaatcatgggggcaattcccaccatgctattcttgtgatagtgagtgagttctcatgagatcggatggttttataagtagcagtttcccctgcctgtgctctgtctcctgccaccatgtaagacgtgccttgcttcccgttcaccttccacctcaattataggttccctgaggcctccccagccatgtggaactgtgagtcagttaaacctctttctttataaattgcccagtctcgggcagttctttatagcagtataaaaacggactaatacacttgtctagccacctctcccccttaaattctcactactctcaccattcttgagaatactcatcttcctcacatacctctgtgttgtggttttgtttttgttttttgcttgaaaagctattcccctcccctcaccatctcggcctgccttcaactcatcattgaagacccagctcaactgtcttcccctctatgaagctttctcttattttctgcaagggagaagtagacaccccttctttttacttagaatcttcctttataccttgaatattacacttaggacatacgaagttattctatgtctacctagccttttaacctttcaaaccaattgggttattgtcttatatcttttcatgttatgactacctttatctcctgtcagaagtttggactcatcactgacccaacagaaaacagtcttatcctttctagtttttggtaagacagtgtatgtgagaaaccttacagttaggtatgggtggaggacatgtcaatccagagtgtttgctaatgtgttcagctacagtccacaatagcatgtgccacagtatgctgtctcacctagatggtgtgtagattggcttgattgtaggtatatggtggataataacatcttggcacagaaacaaaacccaaaggcaccttatcccctgctcctaagacaggctcaaggctcagcttcagctagttagcctggatctgtattcagttttccagtcatcttgaggctgggggctcggagtagcagcccacctcatgaatcctgctcgtcagtaaggggaatattcattgtcaagggcttactctgttcaggcactgtgctaagtctttgcctgcattatctcatgtcattctcacaacaactccattaggtggaaactcttattttcatcatgtaacagatgagtgagcgcactgaggctgggcaagtaaaatgacctgtcaacgagccatagcttcaggccctaatccagcctgtggcactgccctgatgggttaccttgggcaaatcaattgatctaactgagactcaatgtcgtcatctgtaaaataggaacaatactagtgtctatctcatggaatagttatgagggttcaatgataggatgcatgcaaagtgcctggcatagtgcctgacacttggtaagtgctctataaatggtagctattatgcgctcacatcagagacgttgttttcagccaggatgaagggaggcatgagggcagttttatactgaaggagagggtaggtctaaaaattatttggatgatgaaaaggtcacaatcctttgggaggcaaaggaggaaaaatttatcttaaacacagggagggagatggcagccaggtaccagaactcttgatgtgtaaagggctggccatatggagactgaacaaagtcagtgaagcttggctcctgtgcaaatcagagatgggctcaacatgtattccatgtagctgatcttgcatgtgcacggtggtttctgatgcctcccccgtaagggcagcttcatccactcctgtgagaaatgcagctcacagatgtggaggaccatctggagaagggatgtgagtgaaggtgggtgactgacagtgggtggagctggagctagggactcaggcggcagacctactgggttagaattacgactgtgccacttgctagctgtgtgggtttgggctatccactatctctctgagtctcagtttccttatctgtaaactggcaatagtaagggtaccaaccttatagggttattgggaggaacaggggaatttattcctgtgaactacttagcacagaccaggcacatggtaaaggttcaagaaatgctgatttttcatcattattatgtgttctggacgtggcaggggagatggggccaatgtggaggatcatagggcttgctgaaacagtcccaaatgaatcttcttcaaattaacctctgcaaatattgcctctgcctccattaatttagagaagctttgcattcttttctcttaagtttattttgcagctcatgtcttaatgagctaaaaaaaaaactatagaggttttgatccaatttcagactaccctgtaagatatcagcatctgacagttctgctgtactctttcaggcattttacttgaaatgatagtaatgtgatatttgcatccagtgcaaattatgaattttcactaattcttagattagatggggcttaactgctaggatgcagcttgcacatttaatctacttcagagcagcttcacttactagatggtcctcatgggtctggggaaaggatgtaaaatatcatcaatgaggtatgaagcatgttttaaaagatggagtcttgttttcagagtggattgaactgctgctaaatcacagccattacccaagcacacatagcatgtattccagcctgagttgccaccagtttttccttgtgacttgatccagtcctccattccctgctggcagtttgtgcacccctttgcttttccctgtgctgctcaggcaggtggttgctgcctaattaaacacccacacagcaattctctctgttttcttcctccattccaggatactgtttattcttgtttttacatttttttggaaaaatgttttgaagcaccttttgaaaaaagaaacatagtgctgatgatcagctaaatgtttttatagcttttcaggaagtgtgaaatgttctgatagctggcagccaagtgtcaagaaggccttggagaaaaagaaaaggccaattccaactcctttaaggcaacttttagaaaagatttagggctttaaattcagcttcacatactacctcccaagtcctctctaattagtagaaggtaaaaacattttggccgggcctgtaatcctagcactttgggaggctgaggcgggcagatcacgagctcaggagtttgagaccagtctgaccaacatggtgaaaccccatctctactaaaaatacaaaaaaaaaaattagctgggtgtggtggcacgcacctgtaatcccagctactcaggaggctgagacaggagaatcacttgaacctgggaggcggaagttgcagtgagccaagattatgccactgcactccagcctgtgcaacagagtgagactccatctcaaaaacaaaaaacaaaaaaacaaaacaaaacaaaacaaaacaacgttttttgctcaatccagcatctgatatacattttaactactttattgagttgaatttatatttaatagagttgtattctgcatgttgaatacatacatcattgtatccagaggccattgtttatttaaagaacttatagaacaattgtctattttaatttattatagaagctacactataatttggttgtgattgcctttatgttacatgcatagtcgtatctgtgatatacttggagcctaatctctggtcaagattgcagcattattttcatgggaaaatgtatgccatgacagtgacatgacttctggcctgcagcaataaatgcatcataccaaaactggagaagtgagcatagcccggtgtctgctgcataatcggaattcattcaaagtctgctgaatgagtgaattaattgtctatattctgttcagacacaactacgtggaacatgaaagactgagaactgttctctcaagttccatcataatcgacaacttcagacaagcccctcaactactcgctgtccccatttccttagtaagggctatccatctcataaagatcttaagaagaaaggacatggagcattagtctaaaatgccattctttaaaagtgatatttaggccgggtgtggtggctcaggcctgtaatcccagcactttgggaggcctaggtgggtggatcacctgaggtcagaagtttgagaccagcctggccaacatggtgaaacctcgtctctactgaaaatccaaaaaaaaaaaaaaaaaaaattagccgggtgtggtggtggcatgcctgtaatctcagctactcgggaggctgaggcaggagaatcgcctgaatcctagaggcagaggttgcagtgagccaagatcgtgccactgcactccagcctgggcaacagagtgagactctgtctcaaaaaataaataaataaaataaaataaaagtgatatttaaacttcattaaaagtagaagaaagccaaatgcatcattttaacttattttttttctttttactcaaccagatagttggtgacatataatcaacacacatttatcgagggatgctattgtaggtactcagcaccgtgctagacacagggaatgccaatgttcctgctcagacagcttccaatcctgttgaagagacaacccttctcaacactggttctattgacattctgagctagataattctttgttgtagggggttgccctgtgcattgtaggaagtttagcagcatccctggcctggccctggcctactagatgccagttgtacccccttcctagttgtaacaatgagaaatgtctagacatttccacggccttccatttcctctgtgatgcaaaatcgcctcctactgcaaaccactggtgtaaaaagtgatctgtcatgcaaattagtatgagacagtcaaatgaggaagtaatagggagtggaattcactggcgtgaatgagctggagtaatcagagacttaaactggacctttaaaaaactgagtgggattttgataagtggcaagattattgcaggtatagaaaattgcatgtgctatggttctaagactgcggtgctgcaatttggtgggtttgtgggatggcctagtgactaactgactggcttgagtgaatggagaggaatgcagatagtggacaatgaggcgaataaggtaggctggttgccacaatgtcagtttaaaagagcggcaggatgcagggggggtttggatagtgactctgccagtagtgtgtaggatggtttggagtgaggatggatgggggaagggctgtaactccccttatccatgcttttacaaagagagaggggaaaacaagttgaaatagtgaacacagattcctaatgcagcaatagcatctcctaagctttgtgtgcactagacatcacatcgctcatgtcatagggtagattctgcagatttgtttttctttcttctttttgcctgtgatttggagatcagaagatgtagatgccacagatttgtctttgaaagtaattgtcttgttcttcacattaatatacttcattaggtcttttagattagctcctgggactaaaatccatattcttcagacagctctctttgcaactgtgtcttgcgacaattctcttttcaattatgttgtgccactttcatatttctttcaaaatgttctcaatcaattttgccggcactttctctcctccaataatatggcaatgtattatcttattcgccatccaccccatgatcatacaattgttgcaagcacctggaaaaaacttttttttcattttgtcaaacttcatagtatttacattgatgagtttaacaactacatggcatgtagaatgtccatgaagaactccacataatcagcatctaaatttgagtatttgaatgtttagggcaacaacatgatctcaggacttctttttttcaggacctaagacaaacaaaaatggctgcaaaacatgagccttgtactgtggctgatatcattgaagcacgagttagctgcaagaggaaaattcacttggtttagtagcggaaaggtgatagagaagatctctagcacaactaatctgaaaattattaaaatctaaaaattaaggtagaaaatggcatgagaacagttttaaaagtcccatagttctgttcagtgaatctgagctcaatcggcttgccatttggtaatacaatgatgtggccttggcagatggtgagtcagtggaaggctcagtattattcaagctcagtttatataggaaagaagcagaaacaacacccccgttttcttgcattatgtctcataaagaaatctttttagtaatttcacttagaaaaggaaatactcaatgtaccctttcacatatctgaggtaggataagctcgcagaatcagtactagccctgaagcttctacatgcctcttattgtgtgagaggaactggaggaagagcggcaaaccatatgatcgctgacctcaaggagctcacgactgagctgaggtaattgagtagctgtgtgtggcacacctaaggtcactatggtctggagaactgtagaaagtttcctggaggaggttgaatttatacttggttttgaaaagtaatgtagagagaaaggtatgggcattttgagtaacatgagaacagaactagcgtggtgtctatagggaaaagctaggtgctctgctcagctggtggagggaagcagagaagctgtatatttagggaaagagtggaagtaaggctgatggacaggatgcccctggctgtgatgagagtgttttggaaaacaggctacttagtgtcgtcagcagtggtaaccactgcagtccatggagcagagatggatcatgaagaaaacggtactttgggccgggcacagtggctcacgcttgtaatcccagcaattttggaggccgaggtgggaagatctcttgaggtcagaagctcgagaccagcctggccaacatggtgaaaccccatctctactaaaactacccaaattagctgggtgtggttgtgcacacctgtaatccccactactctggaggctgaggcaggagaatcacttgaactcagaaggcagaggttgcagtgagccaggaccacgggactgcactccagcctgggcgacagagcgagactccagatcaaaaaagaaaaaaaagctactttgaaggggaaactcctttaaaactggagcagtcctaaagtgttcaacaacccaagtttacataaaatgaattgtgatgattcctgtaaatctgtaaatataggtcatgctgatctgttccctgaaggtgcttaaaccaacctcaacttcagtcgtccatgcctttcatgactcactctggctttccccagatagataaggtctctctgcatgagaagctgggatttagcttcatagcagttttgagacacggtctgtaggagcaatttttcaagaagcaagactatttgcacttcgtcctaaaaataaatgtttggggtggagagcagaaaacagcaaatagcactgttttataaatgaacaaggaggttcaggagcttttctctcaaccccctaaaccttcttctgggagttcctccaaacctaaagtcacacccatctgccagattgtgtaaagctgagtcctcggaatgtgaaatttatgagggcagggactttgttatgtccattctttattcccagcccttaaaacagtgtctggaacacagtagatgttctacatttccccctttaaatcatatgctgtggaattcataaactttccatttttgacacagacattatttgaataatcatctttattttcagttcatccatttcatattgagtttttaaaatagcagctttattgaagtacaattcctaagatacacaattcacccttttaaggcatacagttgggtggtttttagtttattcagagttgtgccaccatcactactaattctggagcagttttcacacctccataggaaatcccataattgtcagcaggcactccacatttccttttccctccagcttttggtggtcacaaatctgcttactatctctatggatttacctatattgaacatttcatgtaaacagaatcacacactatgtgatcttttgtgtctggcttttttcatttagctaaatgttttcaaggtgcatccctgctctagcactatcagagcttcacttcttttttgtgaccaataacattcccttgtatgagttaatcacattttatttatctatttatccattgatggacatttgggttatttccatttctcagctattatgaatggagctgctatgagcattcatatagaggtttttgggtggacaggtgatttcagttctcttggatatatacctaggagtggaattgctgggtcatatgatgatttcaaatttaactttttgagggactgtcagactgtattgcaaaatggctgcaacattttgcacttctaccagtagtgcatgagggttccaatttctccacatctttgtcaacactggttattcctggtcttttttatataaccatcctataatgttaatgagttaatgttgacttttggattataaatatattatatgtatatattatattataaatatataatacatatttattatatattacatatttataatatgcattaatatatattatatagtatatataatcaatatattcacatgattaatatattaatatctttaatattatatatttataatctatttatagattgtaaatctataaatatgaaagtttatgttaatacattataatatataaacatatatataatctattatttttatatctttacataaatatataaatataaaagattacattaatatattatatattaatatataatctaaattatatattaatataattggattatataaaatatattatattttatattacataatatataatatatgttatattttatattatagactatattatatgttatattttatattatagaatatataatataatatatattatattttatattatatcatatataaaataatatatatattatatattatattaagtatatattatattaataatgtagttctatatttttatatattgtatattaatcattacagttaattatattgtatacaatataattatattgcatacaattatattgtgtacaatatcattatatagaatacaattatttatattgtgtacaatatcattatatagaatacaattatttttattgtgtacaatataattatattgcatacaattatttatattgtatgcaatatatacatatattaattatatatatattaacaagtgtgaaagtcttatactttgcctcagaaatggccttgccagcacaatatttcccttcttgcatctttagtttgatgtgttgttgttttatttcctcataaagcaaatgaaaaagagggattggggatctgctaaaccagatgttagcactttttaaatttagagtgtggtggtcacaagaaaacacaactgggccttgagacggcatggaaaattctagaaatgtgtcatttcacagcatctgtgcagaaactgcttctgtgccagcatgttacatttgaaaccacattttgtgtgtgttcaacttttacacagatctcgagaaaagtgaaattgaattttatgcatctgtaatttgatttcagtccatgaccaggccatttctttataataattataagaatgtatccaatatatgactttcatcttctggtaattacaacaatttaccatttatagaacacatagtttaagacaccataagtaacatttcatgctaattgcttttctgaaaataaagggctctgttgtacacatccaagaacaatggtaggagaaaagaaaattgattgatacatcacatcaaagaggagatcaaaatgaagtcatccaatatatgccaaaggctctcataaattacaaattttgaactcactccaaactttatttttaggcaaatacagtatcttcaagtctcattatgaaagttacttcaaagatgatttgatgtgacagtatttttcccaaggctttgcctgttttctattcctaaggcttcccatgcgagcagggattcctggggcccaagctcaagcaaccaacttatactttgaatttgaactcaaaggacaagaagcccatttttgtgatgtgcttccccatttccttcttttgagcctaattgaagaattaaaagttgtcttcatttctaaagttatatgccgaacacaaaggggggtttcaacagctgcttcttgtcatgctgtgggaaaaaaataacatctcatctgaaaaatacctccaggttctccagatagttcttgcttttctcactcacatttttctctttacatgaacagatttggctcctcttcttcttttgtaggtagtatccattcagtaagatatttttcagatattgagagtaatacattgttcattagaaaacaaagttaaacatccataaaatactaaaaagaaaataaagatcacctgcagtgtcacaacccaaagtgtatcattttgctttagtttcttacactgtttgtttgcttgcattcattctttctttcactcgttgcatatttactgagcacctactatgtgccttgcattgtggtaagatacaaattgtgatcctaattttctttataataattaggtttataattgttggcatagtccatgcctcctctcctagactttagtgtctgggaccatcttactcaccatacatcgtattatgaccatttaccaggtcattaaatattatctgaaaataaaaagtttaatggctgcataagacttcactttcagcatctactagaatttactatttccttattgatcatttaagatattttctttttattctgctatttttgataattataattaattaattccattttgaacatcatttgtaagggtatacacatttttatggcttgtgttgtattagccacactgcccaccagaagagccctactaatttaagcatttaccgcagtaggtgaatatttctcaaatgaagttgaaggaagttccaaaatggcagacccaaggaactgaaagacttacccaatacatccctttgcctccaaggagagacagaatgaccactaccaccagaggggaagccagtttgtttaagagaattgaaaaacaccagggagagctctctcaatataatagtactgggatttgggggcaagaataagcagtggtgcaggttgtttatttacatacgtttataaattatctttacagggctaagagtgaactggatgaatggtgttggcataacctcagagaggcaatccaaattttattaattctctgttatgtgtcagagcttgagttaggtgctatgagtgatgcatggatgaactaaacacagttcttggcctcccagaatgttaaaatccagtagcagggaaaagtgtgtgcgagctggaatttgaatgacctgggttccaattctgattcttctacccattatagcagtgactttggagaggttacctgatgtctctgatcttctgttttctcatgtgtaaaacagggtgaataacagagttcttgtaagaaggaaatgagataatgtgtataatgttcttaggagagtgtgtggcacataacactatagcagcactcaggagatgataactaccattgctttggtaatgatgtttcctatcttccaagggttttgtgatgattcaatgaagtaacaaatgcaaaacacttagtgctactacagtctcaaattaagatgacgatctgatgataatgacaacctttttggtgaagaacatatcacaagcgagttgtaccaaacataaatgagtaacaaaagggtagcttgccccttgtctcagagaaagtgagtctcggcatgggttgctgcagaagacagtgttggctctccacatcctgtgacaccaagacttattaaaaccagacattcaaagcaattgcaagttctgatctacacaactgttggtcacttccgcttttgcgcctacctcatttgaggcacctggagtgtgttttttcttggtagaaccgtgacaacatgcctattgctggcctggaattgtctaccaagcccaaagctttttagcagtgggtgatatttgtttcttgtgccatcgctgaataatgacttttgtagtctgaaattaaacaagcattcaagggctctaagtgtctggcaaaaaaagttagtggctggaaaagctgcagaggatgtctatgaaatgcaattgatgaacacacttttccccctgagctgctttcctgttaggtggtggaaactggtctatttcggtgatgtgtgctgacttcttcccttctggagcccatgcattgggtgcctccaggtttcaaaagaatgaggacaaattaactgttcttctaaagtactaatgctgcaggcccttctgaaataaaacctttgcagaatggaaaatattattgtcttcttgctttcaaaagttacttgtttacctgttgctcataaaatgcaggataatttgtggttgggaaaaggtattctttgcctgatgggtttaatttcagcaccgtagacttccctgaagattacaaagctattctattgctacacatttatagagctcaccccgaggaaagggaattagtgtctggcattaccttcctgcctgccaattttacctcactgattcaacctttgaaactgatttaatcaatggatcagcacattattcaaaggtggaaatgttattacagagaagctttcaggagggtggatgattcgtacaggcactacacaggacttttaatcacaccacataaaagaagcaaatttgaatgttgcttatgcccagaattttgatgaaaagtaaaattttgatgaaacgtgaaaaggagtactaggagaagcccatggcttggatttatgttggcagacatttcttctgagaaagaaaactcagtatgttctaatgtaaagatccacaaaatccaaaaaccacaccaatgggtaagcctattgaaagtaagagagatgagaggttgaacatgataaggaagctgaaaagccaagcctgttcccaatagtcactacactccagtggaagaattctcagtttttgtgcagagtcctgcattttgcatagctcagttgctggacaagtgaatgatcattttcctcatctgtcaaatgggaatagtaatacttctcaaggtgtttgtgaggatcatcagatactaaggattttacaggtttttattttccttatatgatgtacacgttctttacattgaaaaaattatttctccaaactagaatcttaagttccatgggtatgatgggtctgataaagtatttggcatctcttttactaggtagatcccactcaccctgagttttttttttttttttttttgagacagagtctcactctgtcacccaggctggagtacaatggcatgatcttggctcactgcagcctccacctctggggttcaagtgattctcccaccctagcccccgagtagctgggactaaaggtgtccaccaccacacctggctaatttttgtatttttagtagagatggggtttcaccatgttggccaggctggtctcaaactcctgaccccaagtgatctgcctgcctcagcctcccaaagtgctgccaccctgagatttgacttaatggagcccatgggagatatagataccttgggtcattagcaaaaccttcaacgtaaagatgtatcaactctgagagaccctggctaggtctactaagttaagtggaagcaccacaacatcatggttaaaaggaaagcctttgtgttgagccaggtgttgttttgaatctcagccctcctgcttaggaattatgatcttgggcaagttacttaacctctctgtggttcaggttcatcattcaaaaagtaacaagcatcatactacccacctcaaaggggagcagaaattaaatgagattaagcatgcaaagcataggagcaccatgccgagcatagaggcacaataaagggcagttgagaggagtggcggcctggcagggtggctcatgcctgcaatctcagcattttgggaggccgaggtgggaggatcacttggttactttatcaaacccaccatacccatggaacttagattctagtttggagaaataattttttttcaatgtaaacaatgtgtacatcatataaggaaaataaaaacaagtaaaatccttagtatctgatgatcctcgcaaacaccttggaaattattactattcccatttgacagtgatcacttgatcacttcaagaccagcttgggcaaaacagcgagacctcttcactactaaaaatttaaaaaatcactgggcatggtgatgtgcgcctgtagtcccagctactcaggatgctgaggtgggaggattgcttgagcactggaagtcgaggctacagtgagctgtgattacgccactgcactccagcctgggtgacagagcgagaccttgtctcaaaaagagaaaagggagaggagtagcaggattgacagcagcggtggcgttgccccttgaggatggaaggtctcagtcatcttgaagtctgctggagcattagttccattgaacctctctttgagggagactatgttctttgtccttggccttttttgcctacctagaactggctgatcttgcatggactgctatagaagtcctttgtaatcaggtcgttgaggtcagataatcgagttccaatccaagctctgtcatttgccagctgtgtgacactgggcaagttgagttactcaacctcgcagagccccttgttctcagctgcaaaatgataatacaataattatttgctgcatagggttattgagagaatgaaataggataatccatgtaaaagtacctcaaccattcactggaacatggtaagtgcctaataaagatatcttctgagtatggaagcaagacttcattacatgtggtattgatttacaattgagtgcatttcatgatattaaaattaggtgagaattggtggtatgaaaatgcaaccacatcaccacaggcctcacacccatgcttcctgtgcagtctgtggaactgtgcatcaattaaacctctcttcttcataaattacccagtctcacgtatgtctttatagcagtgtgagtacagactaatatacctggaaaagttgagtgctctaggtcaactggcctgtttagtggcagggctaggattagactgtcaggaccccaagattccactttgtgacattgtcctccagagccattgccttcgcatactgattcaccttcctttctatagtttctgccctccatttaaccacttcttttgttcccctcaaatcccagatggccagccttttaggcctgcctttcttagatatgatatcaatcatatcatttcaaaatataaaatgaatttgttattttagttagttaaattaatggtgaaagattcatttaccaataattttgactgctcttcatttgttctgggatccctgtagtaatattctagctttctccatgcaagtgaatgctgtactacagtgattttcaaacattagttgaattagtttcaccttggggtctggttgaaaatacaaattcctgtgccccatataacaggattctggttcctgagtctgggccgaggctcagaatctgcacttttaacaggctttgccacgtgagtctaaggctagtggtatatgcagcccacacctttagaaaactgcttggctttgagtcagactgcctggcttgaaatccaggctctgccattgactagctggaagtccttgggccttggtttcctaaacttaaaaaggagaataatacatactagtccatgtaaggttgctatgatgattacatgagataataaatgtggagcacttagtattgtgctgaacctacagttggcactcaagaaatgttaagtaatattattttaaaatctagggccgggtgcagtggctcatgcctctaatcccagcactttgggaggccaaggcgggaggattgcttgagcccaggagttgaagaccagcctgggcaacaatatgagaccgtgtctttacaaaaaacattagctgggcatggtggtgcatgcccgtggtgccagctactcgggagactgaggtgggaggatcacttgagcccaggaggttgaggcttcagcaagatatgttcataccactgcactccagtctgggagacagtgcaagaccatgtgtcaaaaaaataaaaataaaaaatagaaataaatctattgaaacacacacacacacacatgcacacacacaaagtctacaatgtgtttttctggttattaaatggtaattagtgttaacagaagattctccttgcattaacacacgtgtgtctccacacgcattctttaaagcttagtgctaatgttctcttgtccttgaggtgtttgtgatcttcctcttcactggaataattgttcattttatatctctcccacttgtgcctcccatagaaggcattttgttctgcaacaaattctagtgagaattttgcatctctctcttccaggcttgcaagctgctgaaggacaggggagcagttgtagccatcctgcaccccaactcatacaccgtggcccaggtcttacccagtgcttagcactctgtagtacttaaaaccacacttgctatattcacctgaagttctggaagtgagaagcctcaaatgaaatactcaagaccagaatctctttactctttctggtctgagcaagtgggaggtgagagaataaaactgggaagtgttggatcttctctggcttgtttgttctgcagtacgattgggagaaaatgtccaaaaatgtagaattgagaagaacacccccaaaaccaccccagcaattactgttgttttaaaaaatcgtaaccagatggaagacatttcctgaaatcacacctttgtttcttggagaaagaaaaagcccattcctgtgagtgggtgttcattaacttggtaagtagggaagattgagcttggcctggaaggaggtggatttttgcaggggcactcaacagacaattaaataaggaggggcatttcccatcagaacacatgaaacaagaggctggttgaattttctgcaactgtctgcttgaaggtttatattcaatgggtgtcaccacaacttacacctcatagaacagggatttggtccccaagagatgtaatgcaaatgtcacatcataaactcccagactgccaatactgaagggattttaggaatcgtctagaataagaagtacagaccacccaccattgttttgttagtgttaccaaaatgtcaatggttgttcaaatgcctttagttgctgttttactgcatattttctgattccaaaatgattagtatttcttggatttatactctggctctgccactgactggctgtgtgaccttgggcatgtcagttgcccttttgggacttcatttccttttataaaaggagcaaactaggttgaaagatcttaaggttctttttagctctaaatatgggagagtctcccagaaatagaaatgcaccactcctttttttggaaaattcattctttcctaatgttgaaatgctggcagtccagtgagtcaggtaaccatgttacaagaattgtctcacaaattctgtaaggaggtagggaacaaagatacattctgatgtatgtttcttctattaaatctattttggtattccaagtgacatttgttcttgcacagcttatgcttcacaccaacatgctatctgtcagggcacacactgattaagacctattctgagaaaacatattctctgtgattgaaatccaaacgtattgattgttttatttccatcaggagagattgctttctatttggtgatggatgacaactcttcacacctctctgtctgccagctggacagaggatgacacaagcagcctctaagtcttgtgtgggctgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcccagctcggtgcagagagaacatctcgagtctgcactgtctgctgtttctccgtaccacggtgtgctagcaggaaagccttcaaaggattaaaacccaagtatttatgagctaaacataatgtttccctctctctgggaatgcccagtgagaataccacttacatctgcacagaatgattgcatttcgcaaagtactttcacatgcgttagctcattaaattcttaaaacttttactcgtgggaaatagatagacactacatttttaccatgttacaaatgagtaactaggtatgccctttaatctctgatccctgaccccacaagccactcttcaaggcttgaacccatggcttctagtccggtctttccatcatcctgaggtgctcagttattcgagcctgtagctaatgactgcaggacacataatcatagcaactcacatttattgaactcttactatgtcccagacacttcacataattttaatttaatcttcacaacaacctagtgaggatcatatcattattgtcatcggcattttacagaggaggaaaatgacattcagagaggttaagaaacttacccagggtcacatgatagtaagtgacagagttaagactgaagctgagtcaattgaaaagtagaaaaattcttaaccatgatgctctgttgctggcaactccctgtcccttaccctttccaaaaacattaagaataggaaaaaaaagaagagtgagttttccctcttgggctatgctagcaacagaggcccaaggggaaatgctgttttaagccaacctcttggaaagggtcattagcagctgacatgatgccaatatggaccaatatgtctgaaagcttgtttctgggtcttttgtggtctctgccattcttgtccctgtccctggcctccacattcctttccctctggatcctcagtaacattgtcatcctactttggacatgcaccactctccattttaggtgagatatgtagggttattgtaaataaatatttcagaatcagtattatttattccccacctatttctgaaaaggatctgaataaaatctgtctattaagtaatttgaagtttacaaaaagatctgaaaccttgtggaagaaagtcaagggagaagaagacatgaacaatggttctatcaagaacttggggtggaagtcatctcacacatttcataagcactgtgaacctggccctgggattgccactaaaaatacagagctgagtaaaacatggctcctgccctcaaagagctcaatatctagtagcattagaattactgaatttgaacattcaatttgactttgagttcaaaccaagacaataagtgaaacatgatggattatctagtactcatctgataaatggagtagtgtctgttcttcagaagacacaagctgcttataatgctgaataataatgatgaattatttcatatcagtaatagctaatattctttgagagctcatcatgcgccagctattgcactaagcaatagctgcattatcccatttgcatgcattatcccatttaatcctcacaaatgtcttcatgatgtatgcatataattacccccattgtacagatgaagtaattagggtaaggaggaattaccttgtggatccataagtaatacaaggggtgaaaacttcaatggagtttttacagaagattcagacccgtatttcataaggccagtgcacacatttctcggccatttctgtcttccctgtcactctacgggaagtggctatgaatatactgtctccaaaggctgtgactgtagccattgtgcttcggtattgccatttgggacctaacggttcagaagatgtaataactctccttgcatggaccaattacagaaaaactccctttgtaaagcaacagcatgagccagaacaggcacttcattatctgcctctgcccacagggaagtagagacgctggcgagaggatgattgacctgggaaatggcagggcttgggatccatgctttcagggtcaaaggccttcgtgcccacttccaggattggcttctcaggatgccctggtgctggctcgccccctgctggggtgggctcctggggtttctctctcagtgggatcccattggcagtctctcccctcccacagcagcaggcccattgacttctgggcactcacttcccaggacccttttcagtccctgagaatcagaagttcttttcactctgagagtttgcagacggtgttgcaccaagaatggatgtactttgcctgtagagggctttaatctagtgaattgtgctcagacagataaagggtaattttgcttcattttctgtacctttctgaaagtttccagggtcagttagccaggtctctgcaggcttctcagctccaaagcagaggcaaaagtctttttccaccatttattccttgcatatatggaagattcttaggcaaaaagtgattttttttcacccatatcttatcccagaaaacaatgccctctttttagttaaactgaatgactacaaatcatatcaccccaaattgagtaattgcaagtcttgttagttatcaaggttttattgagccttatttcagttgcttacatatgtttttgtttttaaagaaaaaaaaagtgtaacgcctttggcccgggcctcaaattcctttttttccctcaggcaagcacgcttacaagtgagggattcccagcctacaagggtgagttatgtgtgttgagagcagagtggaaaggtgggcatttactcgccctgccccctccactgaactcgaagtgctcattctctcccatgcctgtgtcctctctctcttcacacatggtcatgtatacacacagttgtacatgcacactttctccttgctaaaacttttctttgctctgagtagatgcagtccgttctcacactgctacaaagaaatagccgagactggataatctataaagggaagaagtttaattgactcacagtttcgcagggctgaagaggcctcaggaaacttacaattatggtggaaggggaagcaaatatgtccttcttcacatggtggcaggaaggagaagaatgagcaaaaggggaaaagttccttataaaaacatcagatgtcgtgagaactcactgtcacaagaacagcatgggggtaaccgcctccatgattcaattacctcccaccaagtccctcccatgacacatggggattataggaactgcaactcaagatgagattttggtggggacacagccaaaccatatcatctactctctccctggcctcaccccacattactgctctggtggccaatgctgtagtcacgaattctgccttttctcatgtctgccatttcaaggagctcaccccactcacctcaaaaaccgagcttttatagacgcagaaaactcttcctcctatatgcacactgattgatcacctacacatgccatcaagagcatgtactctggaattagatagtagtgagttggagccatgtctttacttattagccatgtgaccttgaggatactacttaacttctctgagcctctacttcctcagtgaatcataaatagaacctacctcataggattgttgtgtggggattcagtgaaatagggcatgtaatttagtacagtgcctggcccatgtgatcaataaatgtttgctattatcattaagcgtggtgatcttagctgattgtattgttgttgttgttgttgctgttgaagattttgcatcttctaggttatgtttctttgctgctcaggaggcagaacaagtttctccattgccaaattgtttgcttttttttattggggtgaaattcacataacataacattcactatttaaaattatactattcagtggcatttagtgacactcattatgttgtgaaattatcaccactatctagtttcaaaacattttcagcaccccaaaatgagacccgtatgcattaaacaatcactccccatcacccccacctaccaaatctttttttaatgttgctttcagatcatatgccattccataaatctgagaagttcaggaaggctagatagtgagcttttttccaaaaatcaatcagaaacatattcctaaataaaagaaatatactctgatattctgggactgccttatcagagagtgaagtgaaaaatcagaagtgatatagtctcattcaggccaacacagaaattactcctttaatacttattgcccatatttcacattattttctttgcctggtagctgagagagaaaaggagcttgaaactttgagtaaggggagggaaagattttctaaaccccctataaacaaatgatggtaaagcctaggaagaggttagcaggtcagcctctttgcatttaatttccatcttgccacattccaaggaaggaattttagtcttgggaggcaccaaataaccctcaggggaaatgtgaccctttgaagctcctggttgtctatttctgcagctgcccatctactcacaccacccaggttggaggggcccagctcttcagcactcaaatacagtggagctggccacttctttgcacggggatggtttataggctttctatatcaggctgtgtgcagacgagacaggcttgatgagtcagctgaaaaggggaaaggaggggaactccagttggcttgatgctcaagtgagaagtgggaagaaggaccaacagttaagaggactcggtgaaaatactacgggatttggcaaatgtatgtgaaggcttttgtaggtcagccagtttgcccttggagctgtgggcctgcctgagaaggcttttgttggccttgggagctgaaagggagaccctttctttaggctctgcaggctacttggcaatcaatgttgaggcaggttttctgcttctgtggggtgcaaagctttggtcaatgtcatcaagagcatcctcttcttaggaaaccatgaccttgccttgggcaacttttctgtagcctttaagaccagaaaagtgagtagagaagactaacgtaattggacaaaccttgctttgatgggtggtgattgggactctcatatgaattccagaaggaaatatatgaagagtgtctgtaacttgaatgtgcttcctctgttgggtcttgcattaaatcactgatctgcacactttagcctgcagcagaatcacctggcgaggaggtgcctgttgaaaaagataagaagtttcattcagaaaagatgaccctgaagtaagtcttctcactcatttctatttattcacagttcctactttactaagaaagtttttaattattggccattatccgtgactgaaaatacattaagtaaagttgcaggatgagttttaacatttatgagttaacttcatccacatcagtaaatttgacaagtatttttgaagacccatctttgggttttattaaatagaaatttctgaaagttgtatgcccaagggtattttgtttttctcatgtgtgttcaaatttgggaagaatgaattttgcctcctattcactcggtaggagatttagtgtctccttctgaattagccctttctgttcctgaaggaaagtatttatgaaaaatcagactccattctggaaactgaatgatttttgtattttgctgcagttagatggagtcctataaatgagcccaaaacatgctggctaaatctctcataaaaggcaaatatcacaaagaggaatggcccaagtcttattttggcccctggcctgtgtttgtctaaaaagacttttagaagtgtcacaaaacactaaagcactgcctaaatcatcccttcctaactttttgcttatgggggtgcaagggaagttgcacgtggtgggtgggggtgctgagagagagagagagagaacacaaagggccagctcccacttggagctcccctcgtttctctccattttgctcttcaggatgtccccaccccactctgcattctcaccacacccacacatgaacccagcatctgcccaggtgccacgaatcatattacaactttgctccctggcagagagtggccagagagaagtttctggaggtgaggaagtgagcctgcctgactgctttggtggcagaaaccaggggcttaaccagtgactctgtgctcgaggcttgtttgtgaaatcctttagcaactcttcagaagcctctcctctctgacttctcagagatgctggctcttctactttgggaagttcctttgctagtaacacatttgaggtgagttaaatgtcttcctccttcagcctcagcttcctgtgcctaagggtgagttaagcaattagtcctaaatagccccagctgttagggtttctccagaggatgctccttgtgactttgattgcttctaatgaggctattggctttatctgtaatagacaatgttagattacacatctatgtcttttacagcaccttttacccccagggctttacgttttctgagaccactcttgagaaccttggatccagtggcatttttcttcttgtgaataaaaaattattatctttcctgttctccctgtgagatcagccttgttcttgttctgctctggggtactctgtatttagggaaattactcatgactctcgggtactgaaaagacacacacacacacacacacacacacacacacacaccatgcacaggggaatgggagagcaagaacgtgtgagagagagccacttgaagagagacagggagaaagaaagagagtaggagaaagcaataaagaaagcgagatcacagtcaggcctgagaaggtgacagcaagccagtgttttagaggtagggaaagagcccaagatggatggagaaagctcatgcaggagcaagagagcacacatgggagtgccagcaaccttgaaaaaaagcaccagtgacagcaaagggaatctatgaggccaggaggctgggcgagcaaaagcaagagagtgcaagagatcaagaaagggggaaaggaggtgggagagggagagcgagccttcagggcaaaggagtcaatgagagagatcagcacattatttgtgggcagatgaagagaaagtctaaatgaggagctgctttcccctcatcttgttgagttggtggaagaggaagagaagatgcacagggcacagactccagctttcattaatccaaaatggaatttctgggacatacatgctcaggatcaatgtcatctttaaagacccagattccaattagaaccacaagtacacctccccatccttcagtattatttgaaattttagaacaactgccattattctacacaaagtaaaggatgatcattttggagtatgtttttatcaaaccacctccctatccacagacctgtgttagacagcttaccttagtggttgccaaacaccagaagtagatcattgtcatgattttggagggctgggccgaggcctggaattctatggctttaatacgtggctccattgggagattccattgcccaggaagacactggccttaagctacaccctttttcagaaagcagtaacaaattcagttggaccactgacctgaagccagattgctttccaacaaggcccaaactaaagggggtaccaaaaaatcagtaatcaacataaataacattttaatgatatgattttttaaaagagaagtttctacttatgttgcccaggctggagtgcagtgtctattcataggcgcgatcatggaactcttgagctcaagtgatcctcctgccttggtttcctgagtagctgtaatgatatgttttaaagacttaaaattaatgtagacaaatccaaaatgaacaaatatcaaaattttaaatacagtttccaactctgcccttgcacacccctgcctctcttgacccaccctaacaccatccttggttccagttaaactttatatacagaatcaggcagccatcctgtgggccatattttcttgacttaaaaaaaaaaaaccattgccttaaatatcatttattcaagtagaatccaaatcttgtttgttttctaatactgtttttcaataaaagcaaccagggctccttggagaaatgaccgattccaggactgaggcagaaaatacacaagataagcctggaacatcttgtattgccagaaagtaaggaagtgttaacaaatacacaaacaaaaacaaaaagcagaacatcacaggagccaactaaaagagctaccaacagccaaaggtataaaaacttgagaaaatatactagtattattggactataacccaaagtataaaataaacatccaagagtccatactgatataattaaatggttaaataaatggatgatagacacatcttttgtgcagggtaattccaaataatttgtgtagattctctgccctcaaggaggtggagtgtaactcctcactccttaagtatgaactgcgaatagtgacttccttgtaaaagagtatagtatgggccaggcatggtgccgcatgccggaaatcccagcactttaggaggttgaggcaggaggattgcttgagaccaggagtttgagaccagcctgggcaacatagtgagactccctctctacaaaaaaattaaaaattagccaggcatggtggcatgtgcctgtagtcccagctactcttgaggctgacatgggaggatcacttgggcctgggaggttgaggctgcagtgagtcctgatcatgccactgcactccagcctgggcagcagagcaagatcctgtcaaaaaaaaagggtgcaggccgggtgtggtggctcacatctgtaatcccagcactttgggaggccgaggtgggcagatcatgaggtcagagatcaagaccatcctggctaacatggtgaaacccagtctctactaaaaatataaaaaaattagatgggcgtggtggcaggcacctgtagtcccagctactcaggaggctgaggcaggagaatggcgtgaaccaggggggcggaggttgcagtgagtcaagattgctccactgcactccaacctgggcgacagagcaagactccgtttcaaaaaaaaaaaaaaaagtgcagtatggaaagggaaagacaagtatccttaccatggattaacctgacaaatactgcctcagccaggtgatcaatgtgaacatcaccaatcataaatcatgctgattgtatgtgtctttggatatgatgagatgcgaatggcactttatctctgtggtcttcttccctataatccataaccacagcctacttatgagaaaaacatcagaaaaattccaatagaatgggattctacaaaatagttgaccagtactcctcaaaattatcaagtcatcaaaatccagaaaagtctgagaaattgtcacagccaagaggagctcaaggatatgtgacaactagatgtaatgtgggatcctgcaaccgaaaaaagtaaaaactaaggaaatctaaataaagcatagactttagttaataacaaattgatattagctcattaattgtgacaaaggtaccttattaatcaagagatgtttatgtgggaaactgggtgtggggcttatgggaactcattgtactatttcacaatttttctagaaatccaaaactattctaaaatacaaaacattctttgaaaaagtatcttgatggctgaatgttttggtgcccccttaaattttacacacaaggtgagcaccttgcttgcctcaccttcatcctggccctgctgtctgagtgcaaaatacatttgtagcactggatttcctaggagacacctgttgtattagtctgttctcatgctgctaataaagacatacccgaaactgggtaatttataaagtaaagtggtttaatgaactcacagttccacatggctagggaggtctcacagtcgtggcagaaggcaaaggagaagcaaagtcacaccttacatggtggcaggcaagagagcttgtgcaggggaactcccatttataaaaccatcagatctcatgagacttattcactaccacgagaacagtatggggggaacggcccccatgagtcaattatctccacctctccccatgttgacatgggggattattacaatcaaggtgagatttgggtggggacacagccaaaccctatcacctgtacacactgcattctctttatttgtatataaataaatccatagtattctttcctccacaaccttctccttagcataagctgaattacattccttggcttctgacaaggaatgaatttagatgaagctcagtgtgcacttcccaaagttgcagttgtacagccctgtgaagagaagaggcagtggttggaagcctaagccacagaaacagagtatagtccaagaaaggttataatgctgtgcccagcagccagagcttctcctgcagctgctttattcctgccaagcaaagccatgagcttctcctgcagctgatttattcctgccaagcaaagccatcctcgcaaagagcattggcccctctgctgcctgggcctgcctctcagatagagctctggaagcctggacctttgtcctagaaaatgacatgactaaagtgggttttgtctttcctgttgctctctttcctcctttccctcttttcacatcaataccaattagagaggacaagtgttcaatcaagacataatgtcataggcacggacttctcctcactgtcttcctcagggcgaagaagctgccagcctggagcagaaagctgggtagagacactgctttaactttattccctcagggaaaactgcagccatgaaagtacaacattgagctgacttgacttggcagaaagatgtgttttgcgaggaattgggatctgggagaaggtgattctgatactaactcacagagcataccatcccatttctgatcagcgtctgcgtgagaagatcgttcaaagctaggcagtctgagtctcattggaagaagtggctaaatctaaatctggtgtcagttctttttttttttttttttttgagacggagtctcactatgtcacccaggctggagtgcagtgatgcaatcttggctcattgcaacctccgcctcccagattcaagcaattctcctgcttcagtcacccaagtagttgtgaccacagatgtgcgccaccacacccggctaaattttgtgtttttagtagagatggggattcaccatgttggccaggctggtctcgaactcctgacctcaggcgatctgcccacctcggccttccaaagtgctgggattacaggcatgagccaccatgccaggcctggtgtcagttctttaacagttccaccacatgggatttagcaggggaaatgctgcagagtgaatgccagagactttgtccagtttcatgtatatgaccattggctctggtttcagagagacttgggtttgggtcccagaatttcttaattgtgtgacctgggcaagtcatgtagcccccacagagccacagtgtctttatctataaaatgaggatgctggtagagttgctgtgagattaaaggagctaattcaaacactcatcccattgcctggtgcaggaaaggtgcctactggatgatagctctcatcgttgaaactctgaagcttgggactggggtaggggacacttccactagagtacagacccaggaataactctggagacatgttgcaggaggcctgccagctttgttggagtgtgtccttcgtgctggttaatacatgggaaatggctcaggaacaatagcttgctcttgggagaatcccggaagtgacagtgtgaaaaatgatggttttccaaggtggtattccctagggctgagatttcttgtccttccttttccatgctcacaggaagaaggggaggtatttggtcaagaaagggtttccagaagaaagtggctcagagtcttgctcctccttcctcccctgtctgtaaattctttgcatttggaatgtgtgatgacccctgtctgggctttgcactcagatccctgggagctaggagcagccctgagaatgggcagcatcctgcatctgccttcccaggtgcagtcctgagaatgtgctgatggagtttagttttaatgacaatcataactccagaggcctgctctttactgtttttgattgtgcagctgaagactagatgacctcattgaaaagtgggagacagaagcagctgttgccacaggaaataagcccccccgccccgccccacctcaggagacacactgcttctaagagttctttggagtgggggtggatccagaatggcagctgtcctctacccagatctttctttgtgtacccagaggttgggctgagctgtgggtgactagactgtggattaagaaaccatgaatagcgtttccagaacaaattcttggcctgtgaaatctccatttagcttgctctaccaggaccacatgtgtctatgatttgcctcctttctctttttggattagagtctgtgccctgcacctcatcccctggttaagctaccatccctcccactgtcggcttggagctggtttgctatgctgtcaaagatctgagtagcaacagatcacgcagcctggtgtttgtggcttattacatactccccaccttggctgagtaaaacatcaagagagatgtactaagcttccaagcacaggggtgaatactgaagccgaaggcttggtgtactaatggtgtaatttgaggtcccagctacaggttagaggtggtggggatttagagacaggggaatttcctgggtatttgttaaattgcagtatcctgagagctcctttatcttctgtagacaacattatgcctgtttggggaacttcacacatatatatccacgtgattctacccagttcccatacccttggcccatcacaccacaaaataaagtgctggagccaaagaaactctaaacagatgtctttagatgaaaacaaagctagcagcactactgtacagcccacatattgttgtagttttaaaagtagattgttgtggcttttggtttacttgctcactccttaccccatttcctgttggtgtgatactgaccagcaaagtcgcctttgcagcgtttccttggatctcttttttttttttttttttttcttgatgggcatctttcacttctaggaaaaccaaacaaaaatttcctccaaaaattcaagtcagtcaacatttattgagcacctaacaggttcatggtgttgtaccaggcactgcaattggagaagaatgttacaagtacacatgcccaaactcgactgtgtccagtctggagagaaggctggatctggccccacagattgtggtgggagactggctggggatgaggctgttggctcttggtgttttgcaggaaacttcaagaaggaagctggggggtgtgtcctccctaggccccccaccccggttaatttgctttgtttctgaaacacactgaccagtagctaaatgggcctagctcatgttcagggctgcgtgctgaaacttcattagctcttttcaaagccctttcctattggtatagaggttcctcttaacactgccagcttccttgaaaggtttttcagctgctccttatagaatcacttcgaattaaaatgcttcattccaggggagattttatttacagccaagcaactgtaactagtagcactccccccaccaggctgcagtgactatagatctttgatactgctgaatgactctgtcaagggttccaatttgcttttatacaagtgcatcacccaattcaaaataaatgcatccagactcccttgtcctctcccaacccccacacactattccatttcccataagcacgtggcctgcggctcaggggtgtcagtcacttagccagctgtctgttgcctgacacagacatatcaagttggttcaccttaactaagtgattgagcttgattgccaaccatctggtgagtttagttaagggaattgtgatttctagaccagtctaacacggccaaatatgtacctccccaagcccccaaaacaagtgtgtctgtgggaccacattttatttgtacagttacagaattttatggctggggaggactgctttccaacttcattgctgaagtctgaatttaccccttcaattcaagctctgaaaattttatgggctgagcccaaggctaattgttccaatattagatgaagcccctgtcctcaagaagctcacagtcactcagaggtaaaaggcagtcaccacttggctctaatgtaatgtaataagtgccatggtagcggcaagaacaaagtgtgctgtgagaatccgaaggaaggatggattactctgcctgtgaggggagagggtcaggaaaggctgctcagaggaggtgatatttgagctgggtcaggtgggaaggctattccaagcgaggagaactgtgtgagcaatggcatgcatgcatttgccatatttggggaatctcggtttagagatgagaggcctcccatgggcacaggttttccagagaataaatgaaatcaagagtgtctgaggctgggaacagtggcccacgcttgtaaccccagcactttgggaggcttgcctgtgttatatgcctttggcaggtggattgcttgagcccaggagttcaagaccagcctgagtaacactgcaaagccctgtctctacaaataatagtaataataataaatcatctgcatgtggtggcacacacctgtggtcctagattcttgggcagctgaggtaggaggattgtttgagcccaggagatcaaggctgcagtgagccatgattgcaccactgcactccagcctgggtgacagagtgagaccccgtctcaaaaaaagagcatctggctgtagaaaggtttttcccaagtatgatccaagcgttaggactcagctccatcctggtcagcattcgtagatggccaagtgtgtgtcattgtggatggctcctccctgggcaccaaaggttggtatgtagccaccttcctttaaattgtggcaacagtggtggcagccaaggacagctgctttgtgggagagaggagttaaatgtgagaagatttattttggttctattaccagcggtccttttctgagtgaggcttaacaagaggcaaacgcctaatgacctcctgagtatcaccaaagtgttcaagataggcttgaaaagccaaagaagatgaaaagaaagaaagaaatcaaagggtccttcaaaagaaaagaagtagacagtaacggctataggatttgggatcactttttccctgcttggcaggttggaattgcagcttaggtatgttgaagggtagttcccctctaatggtattattgatactagactctctgttcccacagagagagctatgttggggaagaaagaaaatatttgatgtctgattcatgaacacgctaactggcccatgcattgtggcagagaagtaacagctttattttgaaaaatgtcaaccttttaaaaaaaaatcaaagaaaataacataggatttttgtcactcatggcatgccttccacatggctttgttttccaaacctggccagcctgcagtttccttcccatagtggggaggagaatgagcctcccacctggagagtgtggagccccaagaagcagcatcctctggtggtcccaacatctgcaaatagatgagacagctgactcctctctggctggacttttgtttttgccctgtgcctgtctaaccttgggcaagcaaaagatctgagagcattagggctggaaggggccttggagaacattgagcccaacctccctcccccttgtacaaatgggaaaactgaggcccacagagagggagggacttgctcatggtcacacagccatggagatagagccaagatttgaactcagggttctttcttctagtctttgcaactatgggctgcagtctctctcagcagtcccaagcagcagattagtctcctggagaggcaggggcatgctttaattgctgccaatagggaaagttatagaaaagagggacagacctacttgctgctctcctcccttaggtaaacagccttgtctatttctagtcacatttcccttccagcgagctttcctatgttatatgccttgtaagtagagaatcaatgaagttcctcagttacagaggagattcaggtggacaaagccatgttatagacctaagtccccttgtggcacaggttttgtcctcaaaccatcatactgaggcacagttcatgcatcacctcctccagggagcatttcctgatttccaagactgagttgcacaacccctcctcaccttagcctttatcaactgtctgtcatggttgactcatctgtctctttctctgggctttgaacttcttgaggacagggaccttgtcttctccatgtcccaagtggatagcacggggtccagcccaaagtagacaatcagtgttttttaaatgaccgaggactcagattcccatggtaacaaaagtttgactcttgtttcctcggtgaattgaaaaaccaaccactgtaggtagggaaatgggaaatccaaacgagttgtttgttattcactgggcaggatacttcatgggactctgctagctcaagtcctgaagagccctgctctgtggtggtatgtctgccataggcccacctgtgcaatccctggtgggtccatgggattgtttcgcttggatgtctgtgactgtagacttcaggaacaggatacaggttgttcaatagatttcagttagactgaaaggccatggctgaattctgttgtccttcacctaaacattattggagggaggcatcttcctaggcagagggagtgaggtggggattggctgattatgaggaggccagagcttcaggtcagaatgttttttctcatctaaatgtattaggttggtgcaaaagtaattgtggtttttgcccttaccttttttttttgagacggagtctcgctctgttgctggagtgcagtggcgcgattttggctcactgcaagctctgcctcctgggttcacgccattctcctgcctcagcctcccaagtagctgggactacaggcgcccgccaccacgcccggctaatttttttgtatttttagtagagacgggttttcaccgtgttagccaggatggtctcgatctcctgacctcatgatccgcctgcctcagcctcccaaagtgctgggattacaccgtgcccggccgcccttacttttaatggcaaaaaccacattaacttttgcaccaatctatagcttggttttcattctctggccttggagtaagccctacaggtttacatgcaaagatattcccattcctaaaagccgtgtaccgtaggatcctgggtcattggaggcagtatcttttacttagactcatttgctccaggaaagtgagcaaaacatctctttttttgtactgtagccaaggctgttgtaggaagcgttgtctgtcattctcaatgctgactgcacattcaaacctttttatgtaaagttgaaaattcacctaagattttaagtaagaaaaaaacagaaactgataccagagttaataagaaaaacaattgttgctcaggccctactcataccaattgcgtcagaatctcatgggtcagccttggaaacactctctagatgttttttaatatgcagccagaattgagaaccactgatctaagtagaaggtgataatgtgttctcttcttgttctcagttactttctaagggattctaaagccagtgacccttgaaaccagaactctcaggattttccccaactctgtgaaggtttgagacacaacagattttgagagaaatactcattctgctctcacctagagctttgcttcagtctaagttgtgtctgggtccacatcaagcacatgggtaagggtacaaagtatttggggaaggcaattctcttcccactatgctttataaggccccagacactcataattttgacttcgatttcattgcttgggcagagtatctagtcctttctcacagattacagaatttcaggtcttaaaaaaaaaactatcggggctgggcgcggtggctcacgcctgtaatcccagcacttcgggaggctaaggcaggcagatcctttgaggtcagaagttggagacagcctggccaatatggtgaaaccctgtttccaccaaaaatacgaaaattagctgggcacagtgatgtgctcctgtagtcccagctattcaggaggctgaggcaggaggattgcttgaacctgggaggcagaggttacagtgagccaagattgtgccactgcactccagcctgggtgacacagcaagactctgtctcaaaaaaataataataaaaaaacctgtggatattttgctcagtacctgggtgatgggatcattcttaccccaaacctcagcaattacacaatatacccaggtaacaaacctgtacatgtaacgcctgaatctaaactaaaagttaaaacaaacaaacaaaaaaacccaaatcataaaaaagttacctccaaagtacattcataatagtatagccagagcagttctaagtaattttaaacggtgagtgagagaatgtttgatacctggcttccattcattcattttctttggtctgaatgtgtagtgggcacatggtggaaacagatctttgactttggggcttttgaggtttgaggcttacagagagagccctcagtaggaggaggggtgtgtttacataaccctggggcaccctgtcaatgtattctgtgcagccaaacagatcaatagagtgaaaaaaacaattcagctgagtgaactgataggctgataggttatttgattgactgggctggtggagccactcaagaagaaactacagtgctataacttgggaggccagataaacagctgatgccaaaagcatctgcttagcaatcactggagcccagttgacacaagctattggaaccacatttgagtaaaaaagatataaagtgcactggggtaccatgactatgggtgaatcttcttcctcatcatactgtagtccttcagatctcaggggccgtgtagcttattacctccaagtttcttcttaaggagagaagagagcacagctctgtagtgactctaaagcttctcagctgtgtggacttgagcaagtgatttgacctctctgagcctcagttgcttcctccagccataggagtaaatatattatgtacttcatagggttgatgggagagttcagtgaggttagacacagaaaatgcttagaaaaatgcttgatgcatatacataggaagcatctaataaatggtagcattgatgattcttataaaatagaatgctgcaggccaggcatggtggctcatgcctgtaatccaagcactttgggaggccaaggcaggagatcacttgaggccaggagtttgagatcaacctgggcaacatggcaagacccgtttctccacacacacacacacacagacaaaattagccaagcatggcagcacacctttgctcagtacctgggtgtcacagctactcaggagggtgaggtgagagaattctttaagcccaggagattgaggctgcagtaagccatgttcacatcattgcattccagcctgggcaacagagtgagaccttgtctcaaaaaacaaacaaacaaacaaacaaaaaacgctgcaattggtgcagtggataggacacagactttggtgtcagatgatctgggttcaaattctggctctaccacttcctagctgggtgcctagggcaagtcagtataaaatctcttggtaggtcccacttccctcgccctctctcatagctgaagggtgaggtgaggtaagcctttagcaatgggcttggtatgtaagtggtcaataaatgctggtttttatgattatcaatcgccatcaatatgatagttactgggaaattgccctagttcttcagtcactcctcagtaggacgcaatttccttagtgctagtcattgcagtcccctttttttggttgtgttttggtttgccatttactcccatgtggagtgtgggatacaaaatgaaccctagatccatgccctggggcctagccttttcataaccctgccccactcattcctgtttgcttatgcagagcttcccgtcaatgaaagccccaaggtcctattgtaaggcctgctgtgaaaccaggtctcccccagcttctagctaattgatattctaaaaccttggattgcagcttgacctttatccttgtcaaatatctcttgggttttggcccatgattccagccagtcattggctctttgtatcccactttcttgattattttggttgcgttttttaattaggcgttgtgtgttgcagagacacatgatggtgcttaatcatgccaccatctccctcattgctctttgtggttttgtgagtcttgaattgacatgtgtgctcctcatttagccttcctgaaaaccctacctgctgcacctatactttcaaacatgcactgctggtcatctggaggcatttacctgaaatgttaccatggtgcctagacaggactctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaagatttggctggttacaataaggctagatgggctagatgaggatacacaacaatggctcaccccaatttggggaagtcctttttggcctttatgcaatgggctctctaaaggactagccatgtggtagcctgtctaggggtggggtacacagtgggaggagcccttattgatggtcttggggtctggaacccatttcctgctaggcaactgactcatcctgtgacttagggaagcaagccattgcccatctctgggtttcagtttccagagggtgttagattggaaggtttcttccagatttgaactttgactattttagtgacttaagagaaacagctgaatccaagtgcaaacgtctgtcttgcacctttaaaaagaaccaaaaccacattgtaggcaaacgatccccagtttgaaatagcagcttccgtctttggattgtgtcctgctgcccattctttctcagacctgcctggttccacacactggctgaccatacaagaccttttcatctcagcactagatgtgcacgtcttttttcttgactgtgctctcagaatactgggagagattttttacaatactgttactactgccatgaatagcacctaccaatgactgtgtcttgtgtgacaggcactgtgctgtatgctttgtgtacattttctcttttgatccttataatatcctatggagttggcattgttattaatcccttttacagatagagaggagggatgactcatggaagtgacacacagctagtaagttgcagacttagtactgccagatcccagggtcttaatgagtattataagtatgctttttgcatccctgggtggaacttggatgtattaataataacaacagtggcagtatctcttatacgcagtgaggtaggtgctgttatcctccattttatagaggaagacagcaaggctgagagagatgtggtaacttgcccaaaactgcataactataagaatccaagctgaaacgaatctgaggctaattgccctcaaacccatgctgttggccaggcatggtggctcatgcctgtaatcccagcactttgggatactgaggtgggcggatcacttgaggtcaggagttcgagaccagcctgaccaacatggtgaaatccaatctctactaaaaatacacaagttagccaggcatggtggcgtgcttgggatgctgaggcaggagaattgcttggacctgggaggcagaggcttcagtgagccaagatcacaccactgtactccagcttgggcaacagagcaagactctgtctcaaaaaaaaaaaaaaacaaaaccaaaaacaaaacccgtgctgtttcttctacaccatgctgcctttagggctagaacaagtcttaaagaggctgtgggtttgctttctattctctgctcccaggaactgtggcactgcttttctgaatggctttgccggcgcagctggccaggcttgggcaattcagggttcccatagtgcaagagcagcatccacccgactccatctcccagaagcatgcagtacttactgacaattgtatgcccaaagtaggtaattttgccttttcaagcacaaaaaggtaaatcaaattatacccaatatagagcagaggaaaagaaggaacaaatgaagtaggaagaaatgcattcccttctgtgactctcctcagccactgtctgtgtcactgtctataatatatactccttgcttttcatttccttgcatatcagtgatccatgttcccagtggtgtctaaaggccacctgtattcaactgttagctgccttgcatgtgcctatctctcagtttcagcagctgcttcctcagtttccctagtcttggcaggtaggagctttttacctaaccaatagaggattgccatccagtggtacatattgggaactgcatggctgaaaaaaaaaaagtcctgaatttttttccccctttctaaaggcaaacaccacccattcctcaatcctacttaagggattaactatgccctttcttctcttttttcttagtcttttgtcagctttgctgctcattagctcttatacaagaagcagagcaggagaagtaaatgcagggaaatacaaatcactgccggatttcagcacccccacacccccgctattgtgaatggtttgctgggagagaagctctaggaactgatggggttcagctcattcagaaaatcctgttctcctttggtattgatggctgaaaactctgattacatctgcagagcagtgtgaatagtaggttctaaaaggggctgatacaaaggacaattcacaacagattacgtacaagtaggtaataaacaaaaggcaaaaaatcaacttcacttgtaatcaatgaactgtaaattaaaactaacaagagaaattatttttgcatataaaattggctgagaaatgttaaaatcaaaattcccagggttgacgaagatttcgtgaaatggttgtttttctacactactgctgggagtcataaattactcagcctttatggagaacatgttgacaatgtaatcaagagaattaaaaatgtctatgcgctttgaccccatagctttgttactagatttcacataaagaattcatcagacactactgtttatgtctacaaatcttaactttccctattataatagaaaaaaacaagactctgaatgtctaaaaagtgtttcttaaactaaggcataatcataggctagaatattacatagcaatttatccaaaatcatgttcttagcaaatatttaaggatttaaggttttaggaaaacgcttatggcataatattttttaaaaaattctctcagggtacaaaactaatcatatctcctctttgtacgatataccttttttttttttttttgaaatggagtcttgctctgtcacccaggctggagtgcagtgatgtgatcttggctcactgcaacctctgccccctgggttcaagcaattatcgtgcctcagcctcaggagtagctgagattacaggcacccagcaccacacctgactaatttttgtatttttagtagaaacggagtttaaccatgttggccaggctggtctcgatctcctgacctcaagtgatccgtctgcctcggcctcccaaagtgctgcgattacaggcatgagccacaatttatagaataaaaaatgaggctaagggaatgatagtccagcttaaacacacagtcactactaagaaaatgattaaaagcctgtacattctggactcatggagttagaacttaaaaggaccttggagtacatctagtgtcagccccaccaatgccactgaaatcccctcggtgactacctgacacactggttcaggcagtctctctttaaatactgtggttaaggaacttgctcaccgcctctggcaaccgcttcttcaaagtaaatgatagtgataatcccatccctggtgcgcgtctagtgatttatagtctgtgaagcttctaaaggcacattttcctctcacgaaccctgggaggcagggagaacaagtacatttatctgcattttccagatgaggatcctgagttgaagtgactcccagtggtaaagtgacttgtgtagctggtggataagataggactgcagtccaggtttcctgactcccactctgaggcttgttccagccctccacaaaatccagggtctagtttcattcaagtatctccttttattgagtttatgttggtcttgctatagctgtgacccctcccatgatacctcatacatcgtctcttagaccttgaaagatgtgcttggatgtggggccacatgctagctagctaaggtccagagtagggtgaacatggaaagagctcagggggagaatgaagaaaccaatgagtccaccttgctgcaaattctagcagtctccacacaggaatctgcaaccatatttatgaaacgttgttttcataaactgctgcttgttcaataaggcataaaatagccagtataagatagttatttgctctacaatatcgtttctgcaacacagcttcaatgtcatagcagttactgcattttgtttagtttcttaagagatgtgacacagtagattaaccattgacatcaaaatgcagaggttcccttagagctgtcagcaatcttgttccattcttttcccacaactctgcatcccgccttgggaaagcatttgtacacttccactgcaaggtctagtcacagacccactcggatttgtcaatgtcatgggaaagcaacaggcaggaagacaactttctatgaccttgggatgctatctgtgagttaggcaaaggaagctgagattcagtccattactggttatccctgtacacggatggtccacatcccattccagggactatgaagaagggcaaggaagacacagtagagttttccttctcacagaggtggcaagagaaatacacaggaaaggaagaacaagccagaaaagacaggataggctgactcttccaagtgcagtgagagctctaagagggaggtgactcactgagggctgccggttcaggtcaggactaggtcagaaacctgctctggcctagacccaagggttggcagagaacagaaacagctcagtgggtttgagaacaggatgggcactggccacgggagccaacaccatgaggtcctgatcaaaccctgcaggcgtcttctctggtgcagaggcacctacttccaggaactcagtctcagaactcagcaggaagtcacaccagccctcccacgcctaatctgccagctgctgcagcgggcacttgcctgccctggctttggagccttcattcttgccctagtgggggcagggtatgttctaactagagaaatgccaaacacctatgcttgccccttccgctggtttgactgttttcccggaatggacctgagaaattcagtgaaatgattcaaagaaacaattagttgattccattagaaagttagtcaaactggtatttaagctgaatttattctggcagatgggcttgcaggggtagactcctgccatagttcctgaccatctctccccaccgtgttgctaaaggtgggaggaactagaagataaagggagggccccagtgggaacgaatggaaataccaaaagctttgtgcgtgtctgcttccatccagctgctaactgttgtcccactccattagcccaatcttgcccagtaagttctcatgacagcagtgcacatcccttcccaagagcaccagaaactgttgtctagcagatgttaggatacgtaaggggccaagtgagttaccacgaagggactctcaggtccatacattgatatgaagactaggtttgaagccatttttcactatgttcttcagtttgtccaggttcccaaagcccaggttattctcagtctaagatttttttgctcgactccccacagggtcgagctatgtgatctatgtcaagtggtacctcccttctgagcctcagggtctccatgtgtaaaatgagatcgttaagtcagatgagctcagtggtaccttacagctcaagcattcattctgtgaattcaggtttgtcctcttttggtccaaactgaaattgccttcatgggatgacccaagtgtcttgttcctaccaatattcttataaactcaattcttttctatctttttaattccctaccaatgtgggcatatgggtccactttgttcctttcacaaagaaaatggtctgcattgaggtttcttttcaagaggggcaaggaggaatctcgtatttatataagatactcaggcccatcacctgataccacccttccatcttaggtgtgtttgatcattcattcatgtatatatttattcattctctcattcagcaatatcaacggtgtgactacctcatgcatagtatcatggtgggcaatgcatatgcataagaatatacagcatgatcacttttgtaagatgggaggtgattcacaatgaaccctgctgccatcctgagctgtcaccctactggagtcactctgcgctactacataccacccctggcagagaccctgaaacttacaccatatcattagaaagacaagctacctgtgtttaagagtattgcaaatgatcaattcataggctaagcaatctagaatagagagtacttaaaagacgttaaacctaaaagaaaagaggaaaaattgtgcaaactaacagaagctatatgtgtgtgttttcattcctttgatgggacactcaggagactttgagtatcagacctagtgttaagagggctattcttaagacctttgattaaatcagtcaaacttggagtcagatgctttcaatgatactcttgtataattcttacccctttacctgttttacagaaagggaaactgaggccctatgtggccttcactataatgtctggttgcttagaacacagttgcagttgtccgggcacggtagctcacacctgtaatcccagcactttgggaggccgaggcgggtggatcacttgaggtcaggagttcgagaccagcctggacaacatggtgaaaccccgtctctactaaaaatacaaaaattagccgggcctggtggtgcacgcatggcatgtaatcccagctactcaggaggctgaggcaggacaatcacttgaacccaggaggtggagtttgtagtgagccaggatcgcattactgcactccactctgggtaacagagtgaaactccaactcaaaaaaataaataaataaataaataaaagcacacagttgcagtgctgcaaaattcctctttctttaagggagaagatgaatagtgctcaatcctgatatcaggaaaagtcacaaggccctgggtctccagctccaacagttctttctctgtggcgtcctcgggccaaagcccagctatatcccagctccatgtgggcatccagagaaagcagaactggagaaagccttgagaccagccttcctgtttaagctgtagtgattgacaccaggaactttcctcacacacctttatttcagattactggcctactcagacctttgcaaccttcctgaccccacaggcatgattaactgcctgaattttttgtcacgggtcggttttcccacctggtgtcttgcgtgcttttttccttggaatttcttggaatctttacacgtttttgacacctgctttgaccttctagatcctggagcttttgcccaaaaggctctgaaacatgcatcttgcctatggagcccgcatcctagcctgccttacttgggctgccttgataccatcccccatcagtgtgacaatgatgattctgggcacgtacaagcctctttcccaggaagctggagcaccaaatgacagctgtgtttgagggatggctccgttgacaactgattcagaatattgacaagacttcattatgtttttgctcttgtgtttacatctttcaagtgtgtttgaaaaatcaagaaaacaatacaatttggtttcccaaattgaaatgacaatgaaactgcctttttatttatttaatttttgttattctcatatttctctaggcctcttctcacacacaccaccagccaccaccccccatccccatctccccaccaactttctttctggaaaagacacatcccattgtagctgtactgatctctagtcacatactgtatctttgcagatctctctgtcattgctctttctgttctcattcatagatgacacagctaaagacggtatccaggcctatgcaggtttggctgaaagggccaacatggcattttcttttcctaaagatggtgctttggtttgtagctgtttgctcctgcctttctgtttttcgggaagcctgttggctttgcttgtaaagagacagcctgtaaggctatggtgattgaaaccagtcagcccagtgcaattcaattcggtggaagaacactgagtgcctattacaaccaggaatctaaaggaagggggagattcacccttaccttgggagcccatgtggggaaatgcatatcttcagagaggggaaaaggctgtgagagttcacaagtgggagtgacttggctctctcacctagttttcaccaactctgaccactttatttcacctcccattttaaaatgctatcttgtcttggcttgattgatatgttatttctgtgattttttttcctgcttttcttcgttgctaggtcttctttctccctctctctaactgggatttcttagatttcttaaagacctcatggacattcctataagtatgtgttgccaaccttctagacccaccaatcagaaaccaaactcatcatcatgccttcccgttttgttaatgaagtgccacttttttgtccaagatagaaacatcactgtcatcttgagctattccgtcaccatcctttctctgccgtctgcatattaattgcaagttttcttgattctattaagaataaagaaatttgagagctgccagtaacctaagaggtgatctagtatggagttttcattgtctcagggagtcagaggattagtagttaagctgagactagaactcaagtctaagattcctagactgttgcttttttttttacttcacatgaccctaaaatataggtaaagttcatagactttagaaagaaatgactaagttcaagtctccactcatctctaccatttgctagctttgatcgtgggtaagtagcttaatctctgtgcttcatctgtaaaatgaaatgaaaataccttatgtaaaggaatggttgttagaatcacatgagaaaatagcataaaacacttagcatcagatggactctacatgagatcacctcagttccagatctactgctaacactcttctagacctttccatgcttactgttaaatcttatctttctaatatggaacatttagactctaaagctttttgctgttctgaatcctatggtcttaactatgtaaggaattcaaattgaagtagagtttcaacatcttttgaaaaagagagtttctgcaaatgttaatacctcagattagctcaaagaaagataaaacagagagctcattagtaagtacttgtgaggtacttccaaaattctgctttgttaactttgagaggcaagcaaaagagacccgtagctagtctagacttaagccatgtccagaaagagtggctgattggtttacttgtgaggtttgggtagggggaatagtatcatactagatatcctgtttaatagcctgttcttattttcacttaacaatatatcttggtcatgtattgtcaatgagcaaataactccttatgagccctagtgtacatgcacatttagtaggggaaccctaagagattggaaaatgcatgagaggaagagatttctggaactgcagggctgtctaaaggagtgggaatatccttggagccattgagaaagggacagagacagctgacatctttctgagagtagaggacaaagggaggaaaggtagaggaagaaggttgcctaagaactcatggctctaatgtccttggtgattgcttggcctaaaacacttcaagccttacaaactgctttttaagacaaaccagtgtcatttaaaatcactgctagggatagcctttctatgtctagttaccttagattatcagagctgaaagaacttcagagatctctttaaatgtaatatgaggaaactgaggcccagagagcagaggaatagttcaaagccctcccaatggtttgatccttggtagcataatgagcagcatattagctcattttcatgctgctaataaagacatagccgagactgggtaatttataaaggaaagacatttaatggactcacagttccacatggctggggagccctcacaatcatggcagaaggtaaaggagaagcaaagtcacatattacatggcagcaggtaagagagcttgtgcagaggaactcccatttataaaaccatcaaatctagtgagacttaccaccacaacaacagcataggggaaaccagccccatgattcaattatctccacctggcctcgcctttgacaagtggggattattacaattcaaggtgagatttggatgggaacacggccaaacggtatcaagcagtatttaactggttttgtgtgtgtggagagggaacagatgaatcatttgtattattattcctatgcctaacgaaactaagtcatatgtgtacttaagacagagaaccaaaaccttgatttttctcttgtagggggtggctaaactggagttagaagcctactttgcctgacctttttagctttgataaaggcaaccttgattcatgatgcatgagcctgggtctttgaaaccaataagaaatggtttgttcattgaacgtgcaaacaaattactttccaaagactaaaatttaaactgacattaagctccaagagcatctatatttaattatacgtaaaggccagaaaacaatttgtaaccttaacatagtaaaattaaaagagaaatcccacctatgcaaataatttatttcagtgcaacactaccctttaggattgccatcgtttgcctgtattagcagtgctggctttaccaatatttccagggcggccctgaaatatgagtttagattggaaaaaaagcagtcagagtagctcccagggcaggctgatgctatagaaccacggagtgtgctggcttccccaatttccttttttttttccttttcttctgagacggagtctcactctgtcacccaggctggagtgcagtggcgcgatctccactcactgcaagctccgcctcccaggttcacaccattctcctgcctcagcctcccgagtagctgggactacaggtgcccgccaccacactcagctaattttttgtatttttagtagagacggggtttcaccgtgttagccaggatggtctcgatctcctgacctcgtgatccgcccaccttggcttcccaaagtgctgggattataggcgtgagccactgcgcctggcctgagtgtgctggcttctaacaagatttgcctcttggtaggaggaataataatgaaataccgtctatgataatatatttctctcgggatgtatcttaggggtcaaaatgtagtagaaggaacacaggcaagaaagcacagagatctgggtcctaaattggatccagagcaactcccatctccactctggccctcaggctcttcatctataaactatgaggcttggacccagtcagtgattacattggaagaaaagggagagaatgtgaaatgaagaggatgaatcaaataaaagtggcttcgttatttctgaatgctccctcaccttcctccactccttgacatacacacatgcatgcatacactagttttcccctcagttgagcatgagagtcagttcccctcagttgagcatgggagcatgagagtcaggatatctgggttctcatcccagctgtttcttgaactctctgtgtatcctaaagtaaatctcttgccctctatctctgttccccatctgtaggatgaggagagggtgttgggttttcattggtacccaccaggagtgtgtatatatgtacacacacacacagagtccatccccagctaactaaagcagggcttcccctggggcagggctctgcaggtctgtgtgtttcaatggcttcccaggtcactctgatgtgtacttctagcttagttccctggctggccagtctctgtgggccttcccagctctgccattctggaagacgaatgggcaattttaggggccttttcaggaactgtgtgtcctgctgctgtattctggtggcacagggattagctcaactgcattttcagctcaccccttccgagcagagtgatttcacaggatgggagctgtgcagagggcaggaggcacaaagaaacactctgtggagtcacaatgtggcaagccgccatgacgctgctcttaacctcccagttgttgcccacgtgggcttttcttgaactatgcaggaacctgattaaattaattgattcctggcttttcgaaaatccctctctggtgggttgcatgctgcttatcaagatgttctcgggaagctgatgccaggttaaattccttgcactgagaaggccagagccggcttgattcagacatggatatggtagaggagggagggcagcctgttgcctgcttttctttccttgtcgctttagcaaacatggagcattacaggccaaatgtgcttgctgagtggaaaccaggaggcactgagcgggtggctcagtctggaacgcacagggcgtagtgcttcttagcacagcttctgagcacagaggagactgcaacaaatgatagctgctgtgttattgtagtggcagcgcagtgtaagggaagagaagctccctgaagaagacttggatgtaaccccagctcttctgctcttcttgacttgcagatccaaaattctcagcttccttaagtttcttggtctctaaaatgaggaggctggactcaatcaattattttcaaacttggactctcagggttctgaggaggcaccctgagggctgcctcaggggtatggaaggtggaagaggaggctgagcaggcagaacccagaccctctaactgaccacctagagcctcaagaacaaactgccattcacatcatagtctatgtcaccagttctcaaacttttccatctcaggactcctttatactcttaaaaatgactgaggacctcaaagagctttggttcatgtgggatttatctattgatattgactgcattagaatttaaaactgagaaattttcaaaaatatgtattaatccatttaaaagaacaatagtacctattgcatattaacatatttttattaaaaataacctatttccaaagtaaaaaaaaataactgagtggcattgttttatattttgcaaatgtctttgatatctggctccatagatgatacatggattctcatatcagcttctacatttgatctgttgtgatatgttgtttcggttgaagtatatgaagaaaatccagcctcacacagacatatatttggaaaagagaggcccttacggactccctgaatgattctggggaccaccagtgtctttataccacactttgagaactgcttctctacctgaattgcactccctggagatgtacagtgcccatcctgctgggcaatgaatggcagctcttctctcactccctcccccttcactgtatcccctctttatttaaagcagctcagtttttctattttatataatggagatcctggaagattttatttgaaaaaaggagtctgcttctaaaagtgtttgaaattcacccaccttaatcttaggttactgaagatataaggatttggaagctgattgagatcctatcactcggatttttctcccctaaggatgcaaactcttgggctttgaggagggtcctttggcattgtgcctcagctcttcctggacagtgactggcatgtcatcttgacagtgacagtcttagcacatgaaaatgccactgaatgacttgaaagatttaatgccacttcacaatgggactgacctgcccagggagtgatacaggctgaaggtggaggggattcaatatttgttgagctgtctgatcactgaagcagagagatgggccataagggcaagtttcagtgatatacttctatgtcgtcatctttagagctagacattcatcatcattatttatttcctagatttatgtcgaactttcattccaagggacaggagccagtgttgaataccatgggatctaagtgccttcacaacccattgaagcttcctccaatttcttgtttaataaagaaggccgtgctcttctttcccttattgccagagtcattattgatttcatgttattccttttataaaatcacctcctgggttttcctaggcttggctcttatagccgagaatgttctctcctcagccttctgctgggcctgatgctgtgaatcccatctatgtgggtcaggggacaattccacagccatcttgccaacatgcccgcgttaggctgtgagcatgcgcagaagtactctcagagctgtggaggaggggaggctcccacacccgctgccttgtccttatttgttttgtttctcccaccagcctaggcattaattaagaggcccagactcaaaagcccaccgttagggtcaatcatttgggctaattgagtgtttccaatttagtggaactcttctctgaaagtaagaaataaaactgaatccctgggagaaaccggaacccttgtccattgctggtgggaatgtaaaatgttgcagctgctatggaaaacactttggcagtttctcagaaagttagagtattatatgatccggcaattctactcttaggtatatatctaagagaaatgaaaacacatgttcacatagaaacttgtacattaacattcatagcagcattaatcatgatagtgaaaaaatgaaaacaaccccaatgcccatcagtggatgaatggataaacaaaacgtgctgtgttcatacaatggaatattgtttagctgtaaaaaagactgacatgatgattggtacatgctacaacatgcatgaacctcagaaacttgatgccctaagtgaaagaagccagacaaaaaagaccacatactgtatgattccatttatatgaataatccacaatagacaaatccatagagacagaaaacagatgattgccaggagctgaggggagggtggaagggagagtgactactttacttaatgggtacaaggttttcttctagggtgatgaactagatagaggtgacagctgcacaacatgtactaaattccactgaattacacactttaaaatggttcattttgtgttacatgaatttctcctcaataaaaaattcaaaacaaatgaacaacaaaacaaaacaaaacacctgaatccgtggctgctaccctctttcgagctagtttctcttatgaatgtgtgtggaataaggaacccaagcctgggccgtgaactcttccagagtgggaaatgggcttccaataactcgtagacactcaatagttatatactattgagtatataactattatcatgtatggagatatcatatatggtttcccatattgctgtcttcactgtaggctcatggaaagcagggaccatgtcttattcacccttgaattccaagcgcctaagcaccattcccagcacataggagacaatagatgtttgctgaatgaatgaatgaatatgtttgtgactcctctttattcatctctatgcccccccccccaataatgctagtaatagttctaccacagctggtgctcagaacagatctatggatttgtcaagtgagtggggatgagattgttttagttttagtttttttttaaggttatttatttcaaatgaaccttaaagtaaacttaagttccataaagagtcatattggggttttgattagcgtttcattactattcactaaaaacacttttttcaaaaatgagatataaaaattggacaggatgtagaaaaataggagatttggcctatggagattcaaaaagagtaagagagagatctcagctttaataaggggatgagactgattagatgcattttactttaaaaaaaaattgtggatatctataaaatggaacattatccaggccatgaaatggaatgaagtactgataaatgctacaatatggatgaaccttgaaaacattatgtgagtgaaaaaaaagccagatacaaaaggtcactgttatatgattacatttatttgaaatgtccagaataggaaaatccactgagatggaaagtagatgactggtagtaggggctggaaggaatagccagataggccagggacagctaaagggtacagggtttctttggaggtgactgaagatgttcagaaatggactggtggtgatggttgcacatgtctgtgaatatactaaaacccattgtatactttaattggatgaattgcatggtatgtgagttataccttcataaagctgttagaaatttagataaatgtcagaaaagtaaagaatacaatttgaatcaaaaacaagtgtgactgtgttttgggagagatcttcatctaaaatataaaataactgcctggctagattcaaagggtttctctaggaaaagattcctttactttttattttttattattttttcatttttaattttaattttttgtgggtacatagtaggtgtatatatttctggggtacttgagatgttttggcataggcatgcaatgcataataatcacatcatggaaaatggggtatccatcccctcaagtatttatcctttgtgttacaaacagcctgattacacacctagttattttaaagggtacaattaaattattattgactatagtcaccgtgttgttgagatatcaaatactaggtcttattcattctttctatttttgtattcattaaccatccccaccttccccctacccccctccactacccttcccatcctctggtaactatccctccactttctatctttatgagttcaattgttttgatttttagatcccacaaataagtgagaacatgtgatgtttgttcttctatgcctggcttatttcccttagcataatggcccagttccacccatttgttgcaatgacacggtctcattcttttttatggctgaatagtactccattgtatataagtaccacattttctttatccatccatctgttgatggacaccttaggttgcttccagattttagctattgtgaacagtgctgcaacaaacatgggagtgcagatatcttttccatatactgatttcctttctcttgcatatatactcagcagtggaattgctggatcatatggtagctctatttttagtttttgaggaacctccaaactgttctccatggcagtcatactaatttacattcccatcggcagtgtatgagggttctcttttctccacattcttgccagcatttgttattgcctgtcttttagatataagccattttaactggggtgagatgagatcttattgtagtttttatttctctgataatcagtgatgttgagcaccttttcatatacctgtttgccatttgcatgtcttcttttgagaaatgtctgtttaaatcttttgcccattgcttaatcagattattagatttttctgtaaacttgtttgagctccttatgtattatgtttattaatcacttgtaatgtcagtagtttaaaaatattttcccttcactttattatattattatattatattatttctctcttcactttatttattatatcctttgctctgcagaagctttttaacttgatgtgagcccatttgtccattttgctttggttgcctgtgcgtgtagggtattgctcaagaaatctttgcccaaacaaatgtcctggaaactttccctaatgttttcttgtagtagttttagagtttgatgtcttagatttaagtctttaatctattttgatttgattttcatatggcaagaaataggggtctagtttcattcttttgcatatggatattcaggttttccagcaccacttattgaaaggactgtcttttccccagtgtatgttcttggcaattttatcaaaaatcagttcaatgtccatgtatggatttgtgttggggtcctctattctgttccattgacctgtctgtttttatgccagtgccatgctgttttggttgctatagctctgtagtataacttgaaatcaagtagtgtgattcctccagttttgttctttttgcttaggatagttttggctattctgggtcttttgtggttccgtagaaattttaggatgatttttttgctatttctgtgaaggatatcactgttattttgatagggattgcatcaaatctgtagattgctttggtagtatggacgttttaacaatactgattcttccaatccagggacatggaatatctttccattttttggtgtcctcttcaatttccttcatcagtgtttcatagtttttttatagagatctttttctttgactaagttgattcctagatatttgattatatttgtggctattgtaaatgggattactttttaaatttcttttttagattgttcgctgttggcatatagaaatgctactgatttttgtatgttgattttgtaattgcaattttactgaatttgtttaccagttctaatagttttttggtggagtctttaggttttaccaatataagatcatatcatctgcaaacaaggccaatttgatttcttctttttcaatttggatgccatcatttgtttctttcttttcttttcttttcttttcttttcttttctttttgaaatggagtcttgctttgtcaccaggctggagtgcagtggcacgatctcagccgcagccacgcgtgatcccaggttcacgccattctcctgcctcagcctcccaagtagctggggctacaggcgcccgccaccacacctggctaattttttttttgtatttttagtagagatggggtttcactgtgttaaccaggatggtctcaatctcctgaccttgtgatccgcctgcctcggcctcccaaagtgctgggattacaggcatgagccactgtgcttggccaaaactacaagtttcattctcttgtctgattatgctagctaggactttcagtactatattggttaacagtggtgacagcaggcatccttgtcatgttccagatcttaggggaaagactttcaatttttcctcatttagtatgatactagctgtggctctgtcatacatagcttttattatgttgagctatgttccttgtatacccagttttttgagggtttttatcatggagagattgaattttatgagatgtgttttcagcgttaattgaaatgatcatatagtttttgtccttcattctgctgatacgatgtatcacattggttgatttgtgtatgttgaaccattctagcatccacaggatatttctcacttggtcatgatgaatgatctttttaatatattgttgaattcagtttgctagtgttttgttgaggatttctgcatcaatattcattagcgatattggcctgtagttttctttttttgatgtgtctttggttttggtatcagggtaatactggcctggtagaatgagtttggaagtattccctcttcctctatttcccagaatagtttgagtaggattggtattagctcttctttaaatgtttggtagaattcagcagtgaggccatgaggtccagggcttttctttactaggagtcttttattacagctttgatctcatgacttgctattggtctgttcaggtttaggatttcctcatggttcagtcttggtaggttgtatgtgtctaggaatttgtccatttcttctggattttccaattttttggcatatacttgctcatactggccactaatgatcctttgaatttttccactatcagttggaatgtctcctttttcatttctgattttttatttatttggatcttttctcttttcccttagtaagaaaaaccaactttttggtttttttgtttgctttttgtttttttttttttgtttttttatttttaacataattttattttaatacacctatatgtttgaatatttgaaatctcaatcaccttcacagcacaatgattctacaaagcattctttcctttagcctcactgtatattttatcaaatgacatgactgttcctaattcataattgggacctaaacctaatggaaaatactatttcatgtattcaaaaatatttgtggtctttttctactatgtatatctggcattgttctcaggactggactctattagttttattatgaaaatgttaacatttctccatagagttgttttacaaaaacacctgtttttcaaaaacattctggggaacaacctgaaaacttttaaataacatttagagcatggatttattttaaaaattacctgatcccttttttaatgcatattgtgactttctttaatcatgaaaagttttcaacattattttggcatacctgaaagcttttaactgtccttaaaaaccccaactttgcaatagtaaattatttcatgcatcacaaaatagtcttataaaccaactttttgtttcactgatcttttgtattgttttcttcatttacattgcatttatttctgctctgatcttcgttatttcttttcttctactgttttgggtttggtttgctcttgtttctctggttcttttttttttttttttttttttgagacggagtctcgctgtgtctcccaggttggagtgcagtggcgcgatctccactcattgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgtttctctggttctttaagatgcattgttaggttgcttatttgaagtttttcctcttttttgcaagaagggtaataagccatatttattttaaaacataaatttaaaagtacctacatcaattattattaaattgaaccagcaatatataaaataaataatgcattgagtccaatttcagttgggttcacactagaaaacctaattagtataattcaaccacttcagcaaaaggaaagaaataaatatttcaatggatgggggaaatgaatttttattattccaaaataattcatgattttgaagaactcttagcaaataaaaattaaaatgaactttcttaacctgataagcagaatctaatgaaagcttacaacagtcaccccaaatggcaagaagttagatcattccctttgaagacaggtttttcctcttttttgatgtaggcacttatagctataaacttatctcttagtactgcttttactgtatcccataggctttgggatgttgtgcttctactatcatttgtttcaagacgtttttcaattccttcttaatttcttcattatccactcttcattcatgagcatattgtttagtttttatatatttttgtagttccccaaattcttctcattttttatttctagctttattccattgcagacagaaaagatgcttgatactatttcaggcttttaaaatgttttatggctggttttctgacctaacatatggtctatccttgagaatgatccatgtgctgaggaaaataaagtgtattctgcagccattggatgaaatgttctgtaagtatctattagatccatttagtctatagtgcagattaagtctggtgtctctttcttggttttctgtctggaagatagatccaatgctgaaagtgggtgttggaatctctgattattatcgtattgggacctatctctctctttcactctaatggtatttgctttatatatctaggtgctccagtgttgggtgcatatatatttaaaattattatatcctctttctgaattgacccctttatcattatatagtgaccttctttttctcttcttattgtttttgtcttgaaatctattttgtctgatacaagtatagctagtcctactcttttttttttttggtttccattggcatggaatatctttttccatccctttattttcagtctatttgtgtctttataagtgcaatgtgtttcttgtaggcaacaaatcattgggtcattttttttttaaataaactcagccactctatgtcttttgattgaagagtttagtccatttatattcaatgttattattgatgagtaaggacttactccttccattttgttatttattttctggttgttttggaaagatccctttaaattgggctttcctttcagcagcaattcatgtgagtttccagatcattacctacttgatgaggggctaggggcagagtagcttaaaggcagagtatgaagggcaactgccaactgttgggcagttggagattgatcagaatgtatgtcagtgggaaactaggattcgatttacacaaacccagctgcctgatgatttctgcactgcctgtaggatatatggggtgtccacattttcatgaggaggaatgagcaagcagtctaatgatgtgccacttatacaattagcaattcagcaagttcaacttcaaataagcagttctgaattcttcttcctactccaggggccgtccccactacttcagtgtctatcagcttttctgaaagaagagacaccatggctacagggaaaccatggtggggctgtgtgtggaggcaagtactgcctagtgttggatgcagactgcagctgtatcctttgcccttaggcaggaagaaactcccacagcatcatcccagctagagagtagcttggatgtcacagtcagacaggcagccccagcaaccttaggtggtacagcagtttctgtggggagattataaagccctctgtggttacgaaggagttgacaagctattctgatggctttctgcctgttttccttggatcctgaagacaagagcagtccaaagttattcctgggaagtgagaatcaggcatcagccaaggctttgtcagatctgggtttgcagatgagggctcattcaatgttccttacaattgcaaaaaaatggacatgtgaaaactcacttgtaacttgaaggggcatcatttctaattgggagatagccacagagaaacgaaggggccaaaacattgctagtgtgaaaagcacataggctttggagtcagatcaacctgcaagtcccattctttatgtcttagatgcatgaccttgtccaaggccttcacctctgagccttgatttcctcacgtgtaaaaggagataggaaagagcatcctacaggggctattcttctaattaaacaatgtccagtcctcatgcctggatctccgccactggctctcaactcacctttttcctcctatctctctagcatagattgctgcgttcattttattgtagagggaccttggtacttttaagattcctgaactggaattcacaaggtctgagagatggttttgaccctgttatgactgtgtgaccttggttgagtccctttctctctcaggacctataaaatgcagagtttgggcttgatggtctttaagggtaccttccaactttgataggtttctaaacgatgtcaaggtcaaattctgaatggcctggttcactgtgctagaggatggccctgatcatttggcaagcacaactctttcccaaggcgacattgcccttcttaccattgtagttacatgggccctgctggaatgagtcacatactctagcttcttccagtttcttcccccccttggttaacttggcttggacattttggattctgtctatatgtaatttgattgcattttcctatagataagaaatataggtataatagcaaggagcacctcaccccccactgcttcaaagagagagagagagagagagagacctgatctgtctgccaacttctctttccctgtgggtccctggcctatccactgctacctgatttatgtcctaggggagcagcatagctatggtgaagatttataccaggttttcatcttcaaatgagctactacctctgttccttgtgtattcaagtgcttggcactcatagccaagcacttgaattctggaattcaaaatgaaaaatagtcccatgagaggcctaaagagaggcaaacaggaagcacttcagagtgtgctgcagccttgtacagtaagtaggatgcagtccccagctctcagtggaggtgtgatatgcccagagagattatatacagtgatccctctccacattagtgccttgtgtaggcatggtacacaatgcattagaattagacaaggcgtaggatttggagacaggaaatattgaatattcccatctcagcgccttcacttattaactgtatgaccttgagcaaatttctctttgagcctctctgacttccctgtaaagtgagaagaatgccgcctacctcacagggttgctgtgaaggcaaaatgaaatacagttagtacagctgagtggctcatgagcttggtcccagcaccctacaactctggatttgaatccagactctaccacttatcatgcaagtccgtctgagcctcagttttctcatttaggcaatgagtatagacttttgttcaggatgaaatgagataattcctatagtgtgtggcatctggcatatagtaagcactcattaaatgttagctaatggtatgattgttattgtttgtcatttaggtaaaatttccaataattctagaaaagatattttgtgtactgtgccagatggtttggcaaacttggtccatattttatatgcttggggaaaaagcactgggtatttttttggtcctggttttgaaactacaggtaagacatgaaactgagactcttccaataaaaggatacctgtttcctcatggaaagcaagtttgcgctcacaatggtgctacaccttcatgtagacagttgtctgcagcccacaaaactgttgaagtggtcatgatatttcaaaagtagcacctccatcgggagcagcagtgttaatccagttatgaatattacacctgccaaacagaaagaatcctttagccacgggtctcaagcacagccctggatgtgtggatttgccacagtgacaaagactactagcaaggtgcatggggacaagaacagcaatggcttaaagcctttttcatggatttttgacaatgaagttaattatccagatgtttcatgtacttgaccccggacactcagatctttggaaacatctggacaatgtgggggtagttttcatatctttcatcaaaaccgttggttgtattaaattcagcaggtttcattaatcacctggtttgtgccctgttaggtattattgatcacaaggaagtcacagttttattgagaaaaattagactaacaggtttgaagtgaccaatgaaaagtaggagagctgggatatgaacatagttccatcaactcctatgcttgtgctcacttcactctagcacatggcctcttttcatttggggctggctgaaaggaagtttcagaccaaatccagtggttcccaccatgccttgacttcagcagcgacctaagctcctttgctgaaagcaggtgacatatatccaaatggaccatttcatgtgtctccattgtctgatccttttagtgacttggtggaatattccctgagaattatcttgatccttattttagcactagccaaatcattacttgttagggagtttttcgttctctgtgttttaaatgtgtaaaaatgtgaatgaagcagttatatcttgtgttggcagcttgccatccttggtctgtgtcagcataaaatattttggattccatagagtagcagccccttgcgaagctgtgtaaaagatacaatgaaaaccttccttctgatttgaaacagtgctgaaatagcatcatttgtggaccttccagacccaacgatctgaaacatggaaatgaaatgggataaaataactcccagtacacatatatatacttaccttgtaaatgaaacttttcggcctttattaacagaaagcaggccctgttatacccagaaaatttctaagagattccttattcgttctttctttcctttaagtcaaaaatactgtatgtatatgatcaaactgaaatgcatcactggaacctaccatacaaatacaggtgcttgcgtttggagaattccaaaacacatatgaaaatcattgtcaagtttcagttgaagaagtcagcctgtacctatgcacattttttttataactcaactagctcccccacatcatgagtggaaaggcttctcagaagggaaaacaagccaggttttattttatggccttcaattttgttttatttcgttttactttgtttgttcaatggcaaaacatccttttcactgctttctgaaagactaaattgtcaaataggtgctgtggtaatgttttcagaaacaatgtatcctgccatagccaaggacaagttatagacaaacccgttttccacggaaacaagaatccttcagtgtctagattgttaattagatcagcactagagggcactcttatgatgccaaaatgggaaatttttactaaaatctgctgggcaggggtgtgagagaggagatgaggagggggcagtttctgtaaggactgcagaccacagacaaacagcttagacaagacatgtgcaactgagaattgactggatcgccaacagataaaacactatttgaaaagggctgtttggcagtgttccctatcagatccacttggtttccaaaatgcagtcggtgctttggcaatacacgatccaggtataaggcattatttctcaaaatgaaagagatataagaagctctgattgttaccatgtgatgtagtaaaagcacatttaggcagaaaacaaaatgtggagagaagcataggagaatgtgtttacaacttaacagctactgagaaagaagaatttcaaatccttggggtcttttatggttgttttccccatcttttgcagcccttgctctgtgaattgttctgaagggttgtgtgattgagtctgggagagcaggtgcttgcttgtctgctgcccctaggcaggctctgatggacacagggtggatgatgtgctgtcaagtaaagggacaaatggacttggttttgtctctggcattgatgtgctctgtgatctgtggcaagtccctgccctctcaaagtctcagggtcagggaagagttgggtgacactagaggtctctaaaagatcactagaagacatatccccgagtttgtgatttatgattgcggaaataacttttgttttgttttggttttagagacagtgttactctgttgcccaagctggagtgcagtgacatgatcatggctcactgcagccttgaactcctgggctcaagccgctcctcctgcctcagcctccagagtagctgggaccacaggcacatgacaacatgcccagctatttttcgtattttttgtagagatggggtgtcactatgttatccaggttggtcttgaactcctgggctcaagagttcctcccaccttggcttcccaaagtgttgggaatacagacatgagccactgtgttctgccagaacttcccatatcagtcatttatagcagccacttgagttctgaatcgaacaagatatggtaggcaccctggggtagaaggtgactctatgctgtcagtaggatggtaccgaaatgatttgccagcacagaggggcttatttgcctgtattagtcattgctttaggtttatggctcagtccaaatataacctcagagagtgaccacactaagccgtcagtaggtcccctcaaattcgctcattatgtccaagttaagcctgatccctcacttgtgtgctaggcaccagccagaatctcaggcatgcccatgtgtccttccctgaggagccagtgtggggcaggggctctgggcacttgatgggaagagtggcacactgaagacagacttatctactctgactttggccccagtgtttgctagagaaatgcatgagtgtttttgtttaagtctctgcttgtaagaacccaggctatccttcataggaatgttcctgattgagtcaaattcattataaagtcttagaatgttattggccgggcacggtggcttatgcctgtaatcccaacactttgggaggctgaggcaggtggataacttgaggtcaggagtttgagaccagaccagcctggccaatatggcaaaaccttatctctactaaaaatacaaaaaattagccgggtgtggtggcaggcacctgtagtcccagctactcaggaggctgaggcaggagaatcgcttgatcctgggaggcagaggttgcagtgagctgagatcatgccgctgcacagcctgggcaacagagggagactccctctaaaaaaaaaatgttatcatgaacagggacctttgggaaatcagctagtccaacaccatcactgtagagatagggaaacggggagccatcttcatttgggaatggggttgcctagggtttcacagccagttaatggcagagctggcattggggtatcagttttttatttctattccaggcctctttctgttaccttgtgctatatttttctctctcctgcaatgtccattctagggaataagtgaccaatggctctgaacctaagggtttttgacatagctagaatagctccgtgtttatggattgtgtcatttaaggtagtacaagtggaaagatatgaggacacatccctatcaaaaatatgtcctgtttaaatgtcataggactggagatcaaaccaatataggatcattcctctggatctagaaggctctgaagtcttgagatgctcttgcccaaaagcaaggatcaggttggaatccttgtcagctggcagggaacgaaaggatgggagggtaggtctggaaaccaggtttagtatctcgggggagggcagacactgtgaaaagagcagtcaagacaacctcagggaacttcacagttgtgccaaaggctattccttgggaggttaaaacaaatactcaaagaatacatatttgaaagaatattctgggttccagtattctcatgccaaacataaggagctccctctcatgaggtatgcatgatttccagtggacttggcatggaacaaggaggaattaagagcggtcaaacagtagaacacagatgcaggggacaaccctctcccatatcagtgatgtggttactttccgcatggcctttaactgcacgtgtctttgagctctgcttttgaaaagctggttcctttcccagggcaacaagatggctcaggtacagggggctgcgagctgtgtggcaggcctgccgcagactcactatgcctctagacaattctctgattggtcttcctccctaggtgacagtaataatgcctaaaacgtattgtatgatgactgtggacctgacattctgctacatgatttacaggcatgatcacatctaatcctcccaagtactttaggaactacccttctagactgaaacacatgggcctacctacccatgtcgtttgctgttggtttctcctctgatagggctgtcttttcttctgattggtcagttccgataccatatctgttgttaaagatggtgatcatcaccagtgtaggcattatacttgtccccactttgttttttgctgttttttttgttttgttttgctttgttgagacagagtctcaccctgtcacctaggctgcagtgcagtggcataatctcggcttactgcaacctcctcctcccgggttcaagtgattctcctgcctcagcctcctttgtagctgggaatacaggcgcctgccaccacgccaggctaatttttgtatttttagtagagacgaggtttctccatgttggccaggctgatctcgaactcctgacctcaggtgatccatctgctccgcctcccaaagtgctgggattacaggcgtgagctaccatgccccaccttgtccccattttctaggtgaggaaatcagggctgagagattaagttgccttttcagtgtcatgcagttggtaagtgaaagagctttaggaccagattccagtctgtgtgactaatggacttatttcatggtcccacaccacctctcaggactgtgcataagcaaaaggctgaggtcaagcattttaacactttgcaagtaaaaaagaccagcagcttgttttgcatagggccttaagaaacacccaggccctttgcctggctcctccattcacctccaccagtttgagcaacagtccttagcctgggactttgggggcaccacacccctttccatttagggaaataaaatttagcatgtattaacataaggcattttttgctaggatatactactgtatttggccttcagagatcaaatgaggaaggtggcttgagatacaaaaggaagtggtgggtttctgagcagcaatagagtaggtgaagaccagaatgatggtggaagggcattctacatgggagaacgtggaaattctaaaacacgtcagctcttggtgtggcagttaaagggagggtgagcacaccagttcagtgtcagaaagcagagaggttgaatggaccatttgcttggcagctctggaacagtggtaggcagttatttatcatagagtgtactatctgctgcagatttgcaatctgacccaaacagtgttggtgtgggtttcttaacaacttccttctctctagctgttatatggaagtgtgtggctgtggaggtctctgctgttgaacagccatcaccaatatcccaggctcctggcagatgaagaacctgcatgaacagaaagagaaatgtggagggtggtggcggtgcaagagggtcaattgttcatcaattcgatttttcttgtttttctcaattaagtttccttctataatttttccatcataaagaatctgccactctatgtttcaaattaacaaagctgtttctctggacagaatgatgttcagctgcatttaaatttggccattatgattttggacatactctcatttactcataaactcttcgaaggctgtgctctgggctctgtgaactactaatagcatgttgtactgagaaaatgactagggattggtatacttctaagtaacatcaagggaaagctattagagaatgaaagaatattggaactgggggaattttagaaaccatcttgtcaagctcgttcatgtcatacagcccactgggagagtggagaagagaatttgcccaagatcaaatgagtcattggtaaaacctggattaaaaaccagggatcctgattctcagtcaagggctcttggatttttacctcatcctgggttttccaagtcttaatttggatccttcatacaaaagtgaatcgtttcactttcatttctcaagccctaagcacccaccctgagaatgtaaatgccaagcataagtgtcatggtctgaggttcctgattaggatgaatccacatctggagcttttggattcccaagtctcccgctattcccattactccagtgctatatatgtgttctcttcattttcatcttttgccttccctgcttattggatgcttagtcagttgcctaagtaccatttgagtgacatttagtcacatcttctggaacctggctcagaggaaggttattcctatggctttttctccagccagtgtctgggtcatgggcatggtaaccacagctccttttgtccttccagtgctgctgctttcccaggatgtggcttgctgagggctgatgaatcccatcttagagtgtcagccaggccagctgttaaagaacatgacagcaacaaatgagaaagactctgttgggatgtgggactacagtattatgaaactgccacttagaggcttcctgtttttacagtatttcaaggtgcaagcaagtggcattctctgggcagcaaatggcccagctgaaaagaaacctgatttacagcctgttgggagggctttccacaaggagaaattatgaatttgtaacgtcccttccaatccaaaagagaattctttctaatgcaaatgtttaatctgatgccatcgagtatgttctccatacataaacaaaggcataaataaaacagggagaaactctttcctagaattgataatatacagtatatttctgtagaactcttttccaagcagatggcctaaaaatattccacaagattgtaaactctgtagagtcagggatttttgtctgttttattcactactcagtacctctaacctcagtacctctaacaatggctagcacataatagataataaatattttttaataaaacatcatgattaaagggcctttttaaaggatttcattaaacaaccttcccaaagagagtgtgtgtgtgtatgcataaaatgggttcttaaaattaattcattctcttctaattagtatgtatcttttgttttaccttttccctatgaactttggctcacttctgatgactggccacccttttgattgatgcacctgtaacgtcttcatggatcgtcactcaatactccacctcttcccacctgggctcccaggtaaggcaatgagcttccaaaagtcttctcagtgcaatcaccaggcaaattttataaggcagtcaagaagtttacctagaaataaaaaaactcaagagacaataatagtgattaaagttaaatttgatcccgttcccatataaatcaattatttatacacttaacatcatttgagaatttctgttagtacagtgaaataaaaattatggctttggaaactgctgcatacttaactttggaattttctgatcctaggaatcaatatatggctttatgttttccttctaaaaatattttcttgtgtgtgtgtgtgtgtgtgtgtgtgtgttttgtcttttcacccaaagttgtgttgtttttgttcacaaggccaaattttgtggaagggatcatagcctctcttcactgtgtagggactctaaatcatggggtaggtcagtacattgtagattacttatttcttgcggctggagtagaagacgagcacattgggctctggatggtaagtccactaataggagtgtcttgtctaacagatttgatgttaggcctcaccaagtatatcgcttttgtttctcatgacatttgcttccccagcagtcttaacagctcagaaacagggaaagggggcttaaccgcaccagagactgataataaaagagccatgtattgcttctcaaatgatgattcaaaggctctgctgctagccatgctattaaaaaaggctctcttaactcacttctaaggcctgcaaagcgtatttgctgtaaagaaacatttctcccaagaaaatgcacaggctatatagcccacttcgggcataaaagaagtgttgctacattgtaaaattccttgttctggcataataaaaaacaaaaggctaactgagcccatttgaaccctcaaattagcaactgacctgtgtataacttcacagtctccgcctgctaataatatcagtaattcacacagtggaatgagtgttttgtgacccttaagacatacattataaaaacagctgagcatgttttttgaatggggagacattgcttactttgatggatgtcttgtgtttgggtggaagggactagagagatgatttatatatcaccttatgtgtgctttgaattttcatctttttaaagagcatcagtaaagtttaattgttctttattttccttttgttatttgtgtttcgtatattcctgataatatgaaaaatccctgccaattcctcctaggacctttcaatcagtcatttccatttcagtgatgccacagggttgggtttggtttgggttttgttttattggcttttgtttttttacctagattcccattgctctctgtgaaggggaatggaattagcatgagtgagtggtagatccatcattcccagaccacagcactccagggatctggctctcagtgcagccttgccccttttagccttctgattgggaatctccccattacttgagaggagccagtggggaacaaagtggagaagccatctatgagctgtttccctaaggtttgggaagctggagaaatatgctcttaaagcacaatggaaaacttttattattttatctcctctcctaccaagctcttgctagcgactggttttactgttcctttaacaggtggaggatttttcagattctagatgcagcaaggtaagtaacaatgtatttttagtttgactgaacccaagtaagctagaaaaaagagactctgcagttgcctgtccgtttaatttcagtacaacaaatagttaagtttttggcttggacaaattctttccagggctttttttttttttttttttttttttttttagtttaaaacagctgaaactacccaggcttggagtctcagttctgaaggctgacttagttcagaagggggatgaatgttcagggcgaccaccccagacaggtgtgcagtaggtcattagctctttttcctctttttgctgaaataggatgacacagtagagtgtgttgttgagaagaccccaaccgttggcaaagtgttctttacagtgcttcaggcacgtctgcctgtccctaggctggattgtgatttagagaacaagtaggtcagcatttccttgaagggaaatcaattatttgaaaatatcagggcttttaacgtatgtaaatacgtagacttgcatatttacaagtaatcccataggccagaggcctttttgacatgaagcctgcaggagagcaaatctaatcaaatacaagaaagttcctctctgtggggaagacggacgctgagaatgctcccagatgatgcccctgcaggcaacaactgttgctaagagctgtaccatcatattgccaccagaaccggagagtctagcaagaaccataagtcattttggaaatgtgtgctctagtcgcttggcacattgttttctaaggtcatgatgctcaccagtactgtctttggctttttgtaggcttattggctccagaaatatttactagtgcctctgttttttcttaatacccacctacaatccaccctgtgctccctggccaaataggttagcaagagcaaagactgtagctctggcatttctccacaaggacagactcccattaaaatagactacttgagccattttggggatgcccagtttagctttctgtagctgggcttccatactcccattagagcctcaatggatttacttgacagctgagaatagtaaatttagtgtttaattttgtagtcagattataatttattgagctaaatggcacagacacacatagacacctaatcacacagtattagtatgggagaacatttaaatatcatagattgggtgtgtcatggaggcaaagtaccaagttctgttactaatgaggtgacttttgtcaagcactagctccactctgagccttaatttcctcgcctgtaaaataaaatggagcggatgaccattaagacaatggtcaataacataggtaccactatccctataatagcttttatggggaagtcttgagaattttgttttctttttgctttaaaattgctagatgataggaccatctctttaaaacagttttgctgtataacaaagcaaatcctgacacactctttatttttactatggtgttgattagttggaccagattattgccagagcaactaatacctggtcttaatgagagaaaacaagaggagtacagatggtgagatgggaaagaaacggttttggtaaatatcaatggggccctttttgaattttggtgagctgaatgatgtatgaaaactatttgcaaggctagcatatttttcaaccactagtaaagcaataaaacaaataacatttttggtaatccccattgtatatgcagtttcataaatatacaagattatgattatcgctgcctcataattaacaatttgcataagtacttgctattttttagttgtctgaatagatttttgtaatccagagaaagaagggaacaatcagtggaagccatcccaaatgcctagtattattgctacacacttgcacaattaacagcgatactaattgcttcagaccagaacctcatttgtttttctaaggacagcaaaaacattaatagccagagtgcctgtcaatctctctctctttttcctatagccaactgtatcatagggtctgcagttgactgtaagcaaattattttgttggattttcagtgtatcatcttgtaatggagtttccaagtttcagttagcaatcaatgccttgaacagccagacttatttttataatattttaacaatagacctctataaagttaatgaataaaaggatgctgacatgccaatcagttctgctgctgcatttacattctactacatatttcatatctttaaaattattggcattagacctgcatataagaatcatagaaagtccaggctggaggggagctttaagatcatcccgtcacactccctcctttttcagatgagtatgattgtcagtaatttgaatcttgataacaaccaccaaatcaatgatgccacacttttttttttttgtacctttcaaacgttgggaactattatagtaagtttgaatgataactggttgtttgggaatcatatagtttcaacttattttcaaaacaactgaatcagaattttaaaaatatgccctcataaggcttacctaaacatagccataatgttgatggtatatgtgtgaaaggagatgttctatgcaaatcacctggcaatgagacactcaaccaatatcagctctctttccttcatgcatagattacctaattaacattactatagtggaaacattacatcagtgactgacagtctaggcgtttagagtcaaactgacctcgggtccaatcctggcgctgctactttccagctgtgtgacgttgggtaatttagttcatctctgttggcttcaggtagttttcttatatgtgaaatgtagccagtatataggcttgttttgaggattaaaatgagatcgtgcatatcaagtgcttagcactgttcctgtcacatagtaaacagtcgataatggtggttattaccatcgttttttggcatacccagcggcagcctcactcaatagtatatttaatcttacagtgatttggggtacttacacatacacctgtacacatgcatatttgggcacacaagttcataagatttgcatcagaaagactgctttcccaaaggttacctgtgaccaccatgtttcacaattcaatggcctcttccctggcctcagtcttcttgacctctttggagattctggcacttttgcacatattctcttgcttgaaagggttcataatctatcttgatgtcttctctacattccttaggtttcctttgttgggatctcttttccacacgtacacacacacacacacacacacacacacgcgtgcccacatcttctccctcccccactgcccctttaaatagagcaattcccaaggtcctgtcattgatctgcttctcttctgttgctatattttctccctgggtaacttcacctcctcacatagcttcacctttaacctctacactaatgattcccaaattgacctctccaacccttaattcattccggagccccaggctaactccaatttccaattgcctgctgagaatctccagggcaggatgtcctaggagactgaaagcgtagtctggcttttgtcatccttctcaggaatgcagatggaggaatctagcttcagaagtattaagggttgaaaacaaggcacaagtatggagcattagtctgagcagaagtaacagtggtctaagttagcaaagtgcttcaaactgagctttccaggggaggcataacagataaactgtgaatttctgttattatgcactggagatgtcaattggcagttggaactttaaaaggtttatattttctagggataagggaacagcttcctaagatgaaaattgagttcagtttttaggtgctggaagattggcatgtttggaagaagtgttaattaaaatcatctttcttttcttttctttttttttgagacgagtttttttcgctcttgttacccagactggagttcaatggcgcgatctcagttcactgcaacctccgcctcctgggttcaagcaattctcctgcctcagcctcccaagtagctgggatttcaggcatgtgccaccacacctggctaattttgtatttttagtagagacagagtttcactatgttggtcaggctggtcttggactcctgacctcaggtgatccacccaccttggcctcccaaagtactgggattaccggcgtgagccaccatgcctggccaaaatcgtctttctttggacacttattatcattaatcttgtttcagtgttttgtttaagaaacgcacgtgccaaggggaaagatgatgtactgaacttgaatgatgagcaggtgggaattttgtgagagcaaatgtgtgtgtagacacatacacatatgctgggtcaggtgtgcctgagattttgaatgtgtgcaaataattctatcagtgatagatttttttctttcattcattctgcagatatttacagaacatgccaagctctctgtggagcaacacagctgtgaatatagaacatatagggtctctgtccttaagtgtctaatacatttttttttgttatatgcaggtacattgacaatttaatttagtttagaaatatctgcaacatgtcacaaattgttcaatggccataatcttgctgacaatcttaatgaccaaagaggaacttaagggaaataagacagtgttaaagtgggaaaggaatgtacataaatctgaattagaaattgattacttcctttaaatttagtaaatattgaattgctttggggttttacatttcaagttggcttgccagtgttccaggccagggtaagaatgattatgtctaaccctaaaacttaattagagtaaaggaatagacaactcctggttaatgtgtgtactattgtcaggagaattagttgtaaatgagttatttctacagaaactgcaggctcagggctgatatctttagcacagaggacaatatccctttttgcagaagaatggtcccattctctaccttctcaaaatgcagtacagtcactcctgtttgagctactaccatatggcatatttgaagaccattttgtcctccaagtgggaatcatctacttgtgagttccttgacttcatggttgcatgccattctccccttcagaaatttggcatgggcctttgtctgtaagtctcaattccaagtgttcttggtcccagctgtcagtttcaaagtccccttcatggtccctctcaggtcccaaggatccctcattgcatcagtaaacctagagatctacttggatgcccagagctcctgtcagagctatgtagatggcagccaccctctgttccactatgctagcttctccttcagatctctcacggcacaaaacctctcattataatgatgtgcacattggccagtgcttctatttcctttgccttgcgtgagttagagacattctgttattctcactggaggtaagaatgattaaaaacatccttgaatttagagtctcaaatgcctttattctcatggttttcatcaatcataatataacttctctttcctttcttagatttattcattcaatatgtatctattgagcacttattatgatccaggcactgttctagacatgggggacaatacgacagacaaggtcccttctcttgtgtttcttaaagtgtgtgtgtgtgtgtgtgttggagggaaattgaaaacaaagtacacaagtaaatgaacaagattatcatagggagtggtaagtgccatgaagaaatcaaacacattggacagagaatggtcagacagttggagagtgatcagagaaggcctccctaaggaggtgaattttgctctttgcttttgttgattttgtacagacttcagttacactttgggtcctttggtttcctccatttcatgatatcctggactcggtatgcattctcattttgttgcttcttgccactgtactattaggacaacctcccttcagctagtcctgaagagtaaactaatgtagcctcctgtcaaatatgtgttccacacttttcttgtcgtagtcagtattagaattcagcatgttcacgctcttccctgttatagaatataaatggatgctaatcctttaaggatattttacttgattactcagtgcatttttgttactcaaggcaaactacctattgaaagaaaaacgcaagcattaagagttagtaagcatttggctttgcctatttctgtaaagggaaaagctattgttaaaattagtgttcaaagttaaatagatgatcctggaggttctctttagttcgaaagtagtacaattagttgttttcagagacggagccaaaatctcttttcaatatgctgtttaattttgtaaagtggatatgcaggaacattttccagtgtatcagaagtgcttagattaagcatacattttccgacaaaagctagctttacaattcttgtaaatgtcacaggaacttaaaacattgtgtcttgttttaacctctgccagctagagcagcaattcagcacagcagattcaattgtcagtttcttaaatgtgaatatctgaaagttcattgtcttttcagcttgaccacagggaatcttcaaaaaactaaaaagccaaacaccactaaaatgtttggtggtttcaaaatgctatggcataggtgttgcttgctagtgagttaggtgccaagaaaagcatgttaactcttagaaggccattcggattcttccagccatcattttgttgtcttcctcagcacctagttaaagccccaggtaggaactgaggtaggagttagaaagtttgccttccctaactcctctcacacctcccgtcctgtcccattgagctctgtgggagaagatggggaagcaggtggggtgggtttggagaaggtgcaccagaatgttgccaatatcccaagtacccttgcatctcccttctttaaaacttctgtgtcgtcacttactattccacttatcactcagatacttggctgtgttctaaatacaacaatcaactccatgactagattttgggaaagcagttttttaaaaatccagagaaaagctgagcatgattctgtggtaaaggaatcttcaggagaagaggaaccaagagagtttggaaactcctagaaatgcaactctgatttacagtcacagagattcttgacatagaaaaggagtggggtatagagaaagaagtgaggaaggcacacagcacagtgagtccttgtatgattttaattgaaaaggctgttattttctgcaggtgagaaaatagatgcacatcaaggcaatgacttatctaagtacgtgcagctaattagtggcagatgcaagagaagaacacaagtcaactgaatcctatccagtatcttgattggtaattaactaaactcgctgaatttttggcttgcttttgccgtttaattcttagcgctacgtttgttgccagcacttttaattcattatgctcaaaggactttatcaacaaaggtggacaaaatcccttagaaacaggtaaaaggaattttgttttggaggggttggggccagctgacagatagtacaggatcgcatagaggtgagagtggttggattggaaataaagcctaaaactcaagatttagcttaaaataaaatgaagaaagagaggattgcggctatagactggggatccatatttaaaggtacacatcatctctttaatgctcattcttaatgacagctgtagcccattctccatctgaagattgaaatgtcttttgtttagggttctcagtactttgagtctctttccaggcatatttgtggccttctccttgtctttctgtttttctattctgtatggtttttcatctctaatgttttccattagtttggtctcacggtcttgaccagggcactcatggcacaaccatatatatatatatatatatgatcttatgtgcacataaaatggagaacactatttaacaagttagaaactattagattatttctgttcctctttcggaactgaaagatttcctcttgacaaatggctcttctccaaaatcttaaaattgcacctcagaaaaaaatgacggtcactgtgctaccatgaagcttcctgtcccttcactttcattggcttactattcaatgagctccattgattttccagacctccattgattttctcaaccttgcctcatcagccagacactagaattacaagggagcttcatcaatatcttgtgtggtttcaaaacttttccacttttctaatttgggcaatgggtatggtacaaaccatccgtaaacggcatttggtggtgcattggtctttcttctcatggcttctacaattctaacttgatttctgctcaccacagggcacagtttgccttctcttccctgggagctcttgttcatttgtcaggagacctaaaagaaggctactatgtacagtggtggaatgtcagagtcatcctaaactggcataaataggtctttaatggcctttactgattgtttctatattgacatataaatccacatgaggctgtgtgaggagactgtgcatagtctttctcccgttttttcatatgaattgatttgacaatgtcatagatgatgcatgagacaaagtaaagtgtttcttaagctcactgctgcttgtttgcatgaaaaggaataaaagctacagggaagaaatggacattgtgtgatgctttaggcaggagccattttctgactcacaccttttagaccataatccactttctgaacctgtgcaggggaaagtggtcactgtgatattcttttgctggaaaacctcctaattaatagaggttttctgaaattcataagagatgaaatacagagtctcaaaaaacgaattagttgtaattataaatgcttgcatcttatatgagaaaatgaaatgggataagagctttttgaggaagagtctctgaaaataacacaatgttttattgttgaagagccatgtgatttaatactcagtgatcatgaaatcacatgtaaagcaatccaccaggagagtccagaaagcctcatttattcctctctatatgagcagattcagtgtctcctttacaatgctatcaaaatatgtataaataaaacaacactcttggggctgattttaaatttaacccacagtaactgtaatttaacatgagtacctgaatatttccctatttggagtcaaagtgggataactggggtaggggttggggagaggcccctagctttctgtcctacaacaatctcaagcacaggatctctgatttccccttctcatgcaggaggtattttatgtcttggcaatgggtacttttgttcactaattttcatggcctacaatcataggtcaattggctctgggtcattctggggctgagggaaaacaggtagtgtccttcaatagatttggagaaactggagggggcctcttaacttggtgattttccagtaatgtgattgaaaatgtactactacattaattaattcagtcattacagatacacttattgagcacctaccataattcagcacgattcttaatgctagagatatgacaattgaataagacaaatatagttccttctctcagggagcttatattctggtggcagatatagataatttggaggaagcaagtcaacaaaatgtgtccatattgtgatgaatgttatgaaagaattaagtggagtgctagataggggatatgtagcctttggaataacctcattgtggggcaaacttatcctttgtggatggatttgatttttggaaacatcaaaaatgatatggggccaggtcttataaatatataatggaagatcaaattgattgataaaagttttgcccccaaatgagggtatatatgtaattactgtaatatttttgagtgtcagtaaaaatatatactacactaactagtgataagcacgcccatgtttttaaaggcagtgaaagggctccagcaatgggtgttatcctttggcaagcatttaggcatctatagctaccaacagcactgtctccagttctctgcctctcctcaattctggtcaacccttgtcatcattggcaaatgtactttagctgttatattggtacataaaataaacattcagagacattccaaactatgtagtacagcagtaacatgtgaaatttgattctgtcacaattataatttagttctctcatttcattagtccaaataaagtggagtttcatttatgctattttgtatcaaataaatctgtagaatgctaatacaccacttcgatgagatacaatcaatttgagtctaggaaaggcaagaatgttataagctagaatgtcaagatgaagatgaacagacaaaggaagccatgataggagaattgaggaccccttgtgtgctccttcttgtactaacttaagtgatatctaccatgtccgtttagtgatcgttctagacatgtccccattaaaggatatctaatagagatggttttgtaaaatgagaagaagccaatgatagccatttaattacatctttagtgtgacgttagctccctgtcttgagaagcattgatattctccatgggtgtttacttgagcaactactctgccaggcactgggagtacagaggtgaattagagagagatcctgtctttatggagctcacattgaatttgggagatagaactaaccgttgtggtagaatatggttcatactaatatgtataaacgtagatacttggtacttcaaggagtctgctctaggttgagtcgttgggtcagaaactactaagggaactattctatggtttgctaaagctagtgatggggcaggtatgttcatttcttcacctcatataaatatctttggactcttggcatgattcacatgcatacactttcaatctatctgccagttttaaaggcaggtataatggtgaggtctagtttcaaaataagtagcttttataggtaatattctgtggtttcttcttgaatgtagaaccagaccgattcagaataactctcatgtgacctgttgtgaagagccggccttaatttttctttctctttttttctttttgcaacaccagctccatttctagtagcaaatctgagccaaaagcacagattcattgactgtttgcataagacactaaatagacactgaacagaggattaatgtagccctgtcttctgggagcttatagtctaaaacagacaacaaactggaaagaatatccaacacacctgatatgctcatttcccttctcatataaatccaaagaaaacagaaagtggcaagtcacattctacaggattgggaaaatcccctagagagtattttctttttgtgacttttcaagttaaaaggtattttgtatatgacatgtaatagattacagtgttatttgatgaaaatgcaagcaatgttcttcctttcttttttactatcaacaagttacattggaaggtgtggatcaaattaaaagtgaattcttgatttgccatggggaaatatgtgcagtattttaaatactctaaggtaagggtcaacttgtgggaagaagaggtatcataaaaattaatttaagaaactagccttgagatatttcctaataatcccacagggaaagcaacatctgtgtcataataaaggcgcttagtgtgacctttttgcaaaagggaatattaccgaaacatgaccaaagtttggagctgaggtactgcagtaaaataatgggagtctactaaatatttataaggatgtattcatttgtaagaaagtagtgaaacagtagaacatctgccaaaccaaggttaatttcccaaagctcatgtgtttgtgagagacacagagacaggcacaggaatagaaatgcagagataaagagacacagagagagaaagtagcaagaggctgagccagaggtggacagagaccaagaactgaaaatcagccaccctattgattaccttccaactctgtcatgaaatttactgagagaccttggtcaggtcactgctctctgggccttggtttcttcatgtgtaagatgaagggatggactagaatatgactctatagaacttaccaactccctggttctactcttagctgcaaggtaaatgaaaaggcaggcaggtgggtaggtaaagatatacacgggcaggcatggagacagacagactggccacatacatgcatacacaagtttcacaaaaatagaacaaagcccaaatcatggtagaccagtgaactgtgaatcacagagagcagcagccagatccacaaaatcgtctcatcgcttttgatactgccatggtgaaaacttggcagatttccttttacctagcacttgcccagcttcctggaggccagcattcagaccttttctgactggcttggccgaccctttcctccaccgactcagaggattagttatgtcaggatctgcaaatgacctctgatgcccaaatggaagaactcagcctactcttctaactcttaacacttgaggatgaaaaaactcacataacctaccatgcatattcttgtccaactttctgtctggatatctgtctggttgtaatgttctatggataattttaagcacgctgtgttcaccaggctttcaaaggtaaccacttttaaacttttgtgagtcttgtttgcaggggcatggaaatgaagagaataattagtacttgtcgagctcccagccagcgaatgactttagtaaggtgctaacaatgcactcaagtgagtgcagcaaaatgatgaggacttacagatggattttagtatctggtttatttcacttccattggtttttgcaagatgtaatatagtgtgatttttcttactttgactgcttataatttatcagccttccccaaaataatacccccatagtttaatctgagggcacatgagctgatagtaggtacccctttgggaaaatctgattaagcatttgtttctcaagaaactcctttggtatctgggacaccattttgaatacatctagagcttcacattttgatgctagtacattttataagaatctatgaaaagcaactccatcaaaattgtgtttccttagagaaagatagtgcattaggataacaatctgtattgcacccattaccatagtactttcttaagaggtttttgccatcactggaagccttactcttccaggacaagtgagccctgagaacacaggctagggtgggcatgatgtgtgaggatgaagaagccaggctggctgcagtcaagcttgctcttataccaagtggcggatgggtttggttgagtcattgtagctagcgagagaggatgctgaaagacacaagagaggcttggcttccacatatatctccagcgccacctcgtccctggggtccagactcctgcaactctcacaccactcctgtctctactgggaggtttagttgggatctcaaacttcacctgcccccagacaaactcctgacatttccccagaacgtggtcctctcccaatcttccccgcctcagtgagtggcatctctgtccttaccagttgctcaggggaaaatcttcaaggtatcttttgcatatctttttctcccccaggccatgtctaatccactagcaaattctgtctacttcacctgcataatatatctggaatttgaccgcctctcgccaccatcagctctgtcatcctagtccaagccgccatcatttcttacatgggcttctgtaaaagcctactagctggctcccctgcttcctttattggacccctacagtcttgtctaaccacagtgataacccttttaaaatgttaattgagatgttgtcattcctcttttcccagcccagcagtggctctccatctccttcaacaaccaaccctgcaaggttcctgcaagctccatctctgactttatattttattaccctgcctcaggcccatttttctctaatcacactggtctccttgctttaccttaaatataccaggcctcttgctgcctcagggcctttgtatttgctcctctttctacctggaatgctcttcccctagatatctgcagggctgggtccttatgttcattccagtctttcttgaaatgtcataggaataggattgccaaggagtccaattcttaaaaagaggtcactggtcttggccagcaggaagtcactgatgactttttagagggcagctgcagtcaagtggtagaagaggagccacattgtttttgaatcatctgtatcccttaccaggctgtgcaccgctcgagtctggtgctgttgtctcattcatttttgtctgtctagtaccctccacagtgcctggcaccagtaggcactcagtgtttgtgggatgagggcacgagtcttattttcaaacaattggttatgttaaaacacgttaaattgctgaatgtttgtgattgctttctcagtttttctcagggaatatgtttgaaaaacaaaatctgtgcatttattgtagacccattccctgagtattgacgggtgacatggtgctgtacatgtgatttagaggttttcagtgcacacaggttgtgggggaggctgagaccatcctcagtgtcttagggagataagaaagttcaatctctgcttgtgtatttactagctcacttcccttttaaaatcccctttctagactggaagggctatttaaattcaaaagctatccttgggttcaagcaaaatcttaatgactttagggacagatatttaacaggtggtttagatagttaacactcggctggtggtgaaaaaccacattgaaccacattgaacatggggttccctaataattttaactgagctcaaccttcatctcctttatcgcctctcctttatttaactatctactggagttcaaaacaccactgtaggaatggcttttcttcttgtatcttgccccccttccaggctctgccctctgagatctttccctagacaccagttagagaaggttggccttccctgaaactctttattcctagatccttttgacaccactagtaaatcctgctttctttgctgtctgagaattttatgaaggtcacttctgcagcatcggcctctacaccaatggctaggaagccgtggcaggactctgatcccatttctagtattgctcttaaaccagctctgcctgcaaatgtcagagttttagacctcaagccctctatctcctgaaagtaattgtgacttgtagcctatcacctgggtcagtccacagggtctgctctgcctgtcctgatatctaccatattcgtcatatgagacatttacctatgtgggagggaaaatggtatcacgagtgtggccaagaataggtagctatttctaccgggagtggaggaggtcatttcatacccctacaaaagaggatttttctgttaccccctctgctataaatcaaatacacacttaacagttatatgccatccaggctcattcaacaaacatttgccgagaaccacacagcctgggtgtaaaggagttgggggaaatagggacatgagacatggtccatatgccctcaaaaagcctgcaatccacagaaggtggaaatagtgagaaaggtacagacagagcctatgaatcagtgcaatataatcaggtctgagcaaagtggagccaagaggaagcaatttgttgttgcctgaggctgtagagaagactattcaacaggaaaggcagatgtgggttttcaaagagaagcaggattttgtggagaggagaagatggggaagtgctatcctgttagagaaagtggctttgtaaaggcccagaggcaaggaccagcatggaggatctgggaagggttgtggtgtggcatttagaaaatatgtaaggccaggttccatctcggagggtattgaaagccatgctgagacatagacctgattaagtaggcaataaggagctgcgtacggttgtcaagcaggggaaggagaaaacagctgtttcttccaaagataatagtagcttaactgtggagcaaagaagggagcgggttggcgctgtgatggataaataccatactctcaccatcactgcactgaccacactgagcaaacaactctcagtgtgaaagcggggaagtgatagtcctaagggctgtgtcacccgggcggaagaactgcagttgcatcacttgtcctgatcattgttaaactgagcgtgggctgggagctccttgttcctaggcaaaagtcctcagtaggagactgtaatcatgcctaaaattacttcattattggaaccagtgtttgatctgtgattaagagctggatgaagaaatcaagtaatcagccattgaaattgtaaccataaattgttctataaacaactaacttcccctgtctcccggactccaagcaacaaacttgaaaacagatacttttcctgttgtttcttcacccgatgggttttagccagtgcttttgagccttgcagaagtcagagggtaacacctgccagccacagtgcccctttgtccctcacatatggatcactcatgatgttgtaccttgtcagactaagacaagatacccaaggagtgtggagctgttaaaaatatgcaacttattaagatttgtctagtgagggtaaagagatttatttttaacagaactggggagaaactgcctggatttcaagataaagaatagagaaagccctcagcggttgttgccttttcaatgatgtgttagaagtagcttttgtcctgaagggttttattttgcccaaagcattcaaatactacagcccatagagacatttctgtaaaacaacattagggcttattgactttttcttgtttggggttgcgctgtgcttaaccttccagatatgtaataaatagtaacaaattttaagaaagatctaaactttgttttggggaagaccatggcagcaaccaggcaatcttgacacatgaagtaactgactgtggaaccacaacctgctttgctcctataatgcctagggacaaccagacaagagcggttaagggagttatttcatgtgatcatttttctgacgttaagaggtagcacctagtagttgctcagcaaggttcattttcctcctctgttgtcatttacagcccaaacccttagagatcataacatggaagagcccttaagggtctgcccaaacctttccattttgcaagataagtaggaaggctcacagaagttaatgacttaccctttgtcctcgactggtccttagcagaagcagagctagaatcgggtctacaatccagctgctttgccttcttcgatgggagcagtacttcatctgtctcttgggaataactccagtagcccagtgaaaacattgcctctttcacaaaaattcactttcacaagttagcatccttggcacttggcataataatgcgaccaacgataacatagataccactttatagtctgcatagtgcttttcaccataacatcttgtgttgaactcccattgttatccatggctctactggtggcattttaaaggacagtgtgttgtagactgggatcccttacccaaagaggagtttgaactccttttttaaaaagagggctgagaaaggtttcactttatgttcctgtaatttcttaaaggatttatagataaaaacattaaaatattctgggtgtaaaataaaattgtctcagaatgggaatagacttaaggtacagtgaggagatataggagacaaatcaatggaagatttaaagtcaggaataaatgctgataatggatttctagatacttctcttgaattccaaaaacacgaaaaataaactgttgttactggggtggagacaaaacagaagaagataaagagaacaggctaaggagaaaggaagaggttaagggagaaacctctgtatgaggaacaaaccaaagttgactcttttttcaaaattcctacattctctgggataaacagctaatgtttgaacataaaacagctgaatctcccagagcttcaactactttctgttttggaagttagtactttgggaaattgaagactctttccatttcctagggaagttgccaatttagggttttacatcagaggttggcaaattatgtccccaggccaaatccagtccattacatgtttgtttgtttgtttttggtatggccagtaagctaataatagtttttatattctcaaacaggtgaaaaaattaagaacaatgttttgtgacatttgaaaaatatatgcaattcgcatttcaatgtctgtaaataaagttttgttggaacacagccatgcattcatttacatgttgtgtatgactgcttttgtactgtaacagcagagtctgcaactctgaaaagatttactatctggccatttacataaagagtttgtcaaccgttgctttaagccaatcttttggtttccctgggtcacattggaagaaggataattgtcttgggctacacataaaacacacgaacacaaatgattgctgataagcttaaaaaaaaaagcgaaaaaaatctcataatgttttaagaaagcttacgaatttgtgttgggctgcattcaaagccattctgggctgcatgcagcctgcaggctgcggtttgtacaagcttgcttcaaactgaagtatcttcatgatctgaaagtgttaaataactttctctagagcccagctcttaaccagaggggagtttagacattgggataatctggttcaatataacttaattcaatgacttgtacttagaatcaagttacaaaagtggaatattatgcttcctgtctaactataaattgtattccatagaggtacgtcaaatatttcaattttctaaaatgtaatattaagcttcccagtaattcaaaatgagattaaggggaattttttttcatttgctctttgtaacaaccagcttcatataaccagcagcaaacaatggggtccccagactgtttgaggacacttttgtatcgattagctgtagttaaagcctgaatggttaagtcagcaatttgacttaaaaaaatgctgtagattctaatttataatacctctacagcaacagacttcctatcaggcagattgtggagacaagcagttgtttgtaccgatttctggctaattacttatctatttgatatggcatctcccaccaaaatgccataccaagctgtgctttccaagggcatttttgaataatgggattcaaacaggaatttaaatgttcacccgaaccttctctctcgatctgtgcactaggatgaaggagggttgattccagcttgggacagatgaccaggaggtatgggacagatgaccaggaggtaaatgaaggggttgaggatcagtattggaaggtcaggaaggacacattttacaagttgggacattcaacctatgaatcatttcttatgcagtttcaagatatattttgcattgattagctgtctttgaagcccatacagttaaggcagttttctgccttctgcctcttcactgagcacctgtattagctagagcttagatctaagaattctgtgacttgctgaaatttattctgctagctaagaggaccaagggcctttaagcttcagatttgcatcactgtctcttcaaactagattactttaatgagtacttgatatggtttggctgtgtccccacccaaatctcatcttgaattgtagtttccataatccccacttgttgtggaagggacctggtgggaggtaatttaatcatgggggtggttaaccccatgctgttctcatgatagggggtgagttctcaggaggtctgatggtttcataaggggcttttcccccttttgctcagcacttctccttgctgccaccatgcaaagaaggatgtgtttgcttccccttccaccatgcttgtaagtttcctgaggcctccccagtcatgctgaactgtgagtcaattgaacctctttcctttataaattacccagtcttgggtatgtctttattagcagcatgagaatggactaatgcagtactgtacttttgtaattttcataattgtttcttacattttgaatcaatagtttcataccattatgaccatatattttcaattacatgttattttggagaccatgtcatttttcatgggttttcatagctctcttacttttggctctgtggagcctaggagaaaggttcctgtcatccccatcccctggcttttctgctctgctaaaatcattataactagcttaaatttatatttcaggaaccttctgtaaaatcacaacagagttatcttctgatgagtctggttgctagactaaagatttgtatgaggattgtcagaaatgttggctgggcatggtggctcacgcctgtaatcccagtactttgggaggccgaggcgggtggatcacctgatgtcaggagttcgagagcagcctggcgaacatgatgaaaccccgtctctactaaaaatacaaaaattagctgggcgtggtggtgggcacctgtaatcccaactactggggaggctgaggcaggagaatcacttgcacctgggaggcagaggttgcagtgagccgagattgcgccattgcactcagcctgggggacaagagcaagactttgtctcaaaaaaaaaacaaatgttgactagtgtcttctgtttgggctggttatagacaacacagcttttgtcatgatttcttgtagggccactggtttaagttccaaatgttgcacctgaatactctagaaactatcgtttagctgataaccttgaataatttccagtcagcccttttttattccaaaggggtgtcacttaagatcaaattcattcagagaagtattgatccgccagctgccactctccattaactctcccctcccccagcggctgaaagagtgcccttcttggggccaataaatgtttatattgcccctaggtacgattgttcctccagcaagagccttcattaagcccagcaacatgataaggtaatgaggcttctgctttaacatagcagaacatatatatccaaatgagcatggttccctggctctccttttttattatcctgccttctcccaggagaaagtagtgcattgaggggaccatcaaaactcctcctcccttccccttctgctgagttccccaagacacctggtctcaactcctattccaaattgcccagagaaagagagatgataagtggacagaagacatacaggcggcatggcaaagaagctcaagactggcaaagaacgaaaagcgctgaatacaatggtcacaacagaggactcatattggtctagaagggatgcagaaagccagactggtgtggactaattatttctttatttcttctaaacattctatgactgagcttgaagggtcaaggaagatggctcattggagtgtcctagaattccatattacaattcagtagttttctttgaaagtatggaacacataatagatatatctttgtatcactagcattttgcccgtagcaggtggtaagtgggttgttattgcaacaacagtagatctgagctgtgaacttatacaataaggcctatactgccataatgagtatagcaccagaatcatcaccacattttaattataaaaaatattattgtactctgccatttcccacttataagcatcatgactctgtgaagtcaggtggcaagcttggattatttttatcctatttttcatttgtgtgaaccaaggcataccaatcacttggggggactggtgtgatggcttagaataagagctccaggttttcagctctgcatgtggcactcttctcaacaatctggatgaaatcaggagctagcatcacacactgttgctatttacaaaagcctaattaatacctctcattccctaatgagatactttttctgactccacagacaagcagagccaagcaagtgatgtcagaatgccagagtgaattattgggcttgtgtcaacccaagcagagatgaaaaatcacccctgtgaacttgctccaggagcaatcaaagggccaaagttttaattagtgagggttgtgatttacatttgcattcagcatcctaagaatctacattagtcttcaagctcctgcacttccctagttgttgtctgacactggttaggatagttaatatgcttttaaataacattatatttaatggacctttgaaagcactgacatatgaatccattttctcacctgtcagcagaactgttttcattaaagaagtcagtgaaagaccacatgctgagaggagctaaaagttggtggcagggaacatttcagcttggtatcttgtcctttcacctatatctactgtgaaaattaatgaacagttatctaggaatactaatattaggattgatttctaatcaaagggaaaatgatgtcaaagcactatagtgaataaaggaatgcaatggatttatttttaacaaacatagcagaactgacataatggaaaagggtgctgatttcttcaacatattcaacatttgcatgttgctgtattggttagtacatttgacagctgtagcatgttctcttgactctgcttggttgagagatatctttgtcctttgagagtggattgaattttgggaatcagtcaaatgtcctgagaaggtaatgatgatgtactaattggatgatcagactgggtcctatggttgggggccagaagtgaggtgtgactacacagtcatgagtgatatttctcatgtggctcataactgtctatgaagatagttcccagggaacagctctggaaatgtgaacgccagcagtatccttggaatctgtatacagcttctctgggtaacaactttgagaggaccagcatgcattgggtacaacacaggccctcgtgcgcttgctaaagatctgcttcaatactttgtcacaccgcctacactggctccacatttgccaagtaactatgagcatggttctccttccaacaatctggatggagctagcatccttcatgagtgtaaatttacaaaagtttaattaatatatcttgcttgctaatgagttattccttttgactccatagacatgcagggccaaatacatgatgtcagaattccctgagtgaattattgagcttgtgacaacctgggtcagaatgaaaaatcaccttagtatatttaatccagaagcaaataaagggccagagaattaattaatatgggttttaatttgttaaggtcttaagagggagcctctgtttgctctggtacctttttgtgtgtgtcctctttgattacaggtgaacatgcctttgggaaaagatatctacttctttactgtgctcctcggtaacctatagacaagaaagaaaaaagtgggttcttagtcttcagagagcatcaaatcattgaatttattgtttaggtgatgagccaatgccctgttcccaggaataggtttcatgaggaattgctaggaggcatagaaaaagaattgcacatagtggaagtagatgatgataaaagaaaacaagtgctagagctggacaacagagcaacaccccatgagtcctgaacaaagaactagaaagaaacccaaggaaaatcagagtgcttctttgcagcctttggctaagtctccctagctcccaaaaggatgtagacagcagataacactgctgatgagagggcaggatccagacaggtgagctgtgctagggaaggggctgccaaggaaagccccaaatgcaatggtacaaggtgatccagtgggagcaatccttcctattgtcccatgagcaggtgctttagggagccactggtccaaggcctgcattcaaattcatgcctcctggtttttcaccatctttccaggatcaggttagatcacagaaaggccgcccatttgccactttagcttagctgttactggcctaccttccaatgtggtatccccagctgctattaaaagaaatggacatgagtaaattttactgaatggaaagtatatcccaattaacttgactttttaaaatgtctctctatatacatacatatatatgtatatacatatatatacatatatgtgtgtgcgtgtatatatatatgtatatacatatatatacatatatatgtgtgtgtgtatatatatatatatatatgtatatatatgacactgtcctgtggagactgctcctacatatcctgtaaaaatcagtgcttcatagttttggcaccaggaataagtttgattctcctgacaaaatgataccttctctttaatcacaagttgagaatgctattatccagcgtgtttcttttaatgtttattgccttcgttgctgggaaactcagagctaaccccagcattcaatttcagtaatcttgctctttaagattttgagaattagtctcttatcccttctaaaatatttctactgatcttgttcttccccagggtcatattacaggtacgctttaggttaagctttctcaaaattggggtactggatgggttataaactataaaaaatagtgctctgaccctagtctgtgatggtccgaacacaccaacctgtgttcttcctggcccatgctacttgctctgacctggtgctccttgaaataaaatggatttctgttagttacagcccctatttttacactagagttgatgcttttttcctatgttagtcatgaattataatttctgtatgcccccaaatatcagaacaagtggggatggggaggcaaatagcggcatgcatttctctaatatttattcttatctctggagctggttgtataaagctgtcaagaagaaaatttccacttaaaccagaaccttccagcactaggagtgctgacctgtagcaattacgggtgctaggattgttttacttggtgtcttacttgactttcagtttgtgaccatcacttgacaggattaaaaattgcctctgttctatctgctaatttcttgaaggggacagcctattccagaagagacagtctgagcaggaaacaaaggctctgtactgtgctcagaaactaaaactagataggtcagggcccatgcctgaaagcagttggttctccacagcccattgttatccataggtcatggatacatcctggcaagcaggctgtaaaggacatgaccccttaattgaaataaaatgcccacctaggcatacaaaggatgagtagagaaagagtccttaagggaaatttttaattgtttacctcgattgattgattgattgattgattgagacagggtctcaccctgtcgcccaggctggagtgcagtggtgtggtcatagctcactgcagccttgacctacctggctcaagtgatcctctcatctcagcctctggagtagctgggcctacaggcaagtgccaccatgcccggatcattttaattattattattattatttagagacgagccctcactatgttgtccagacttgtcttgaacacctgagctcaagcgatcatcctgcatcagccacccaaagtgttgggattacaggtgtgagccaccgtgcctggcctgggaaatttttaaaaagaaacagcagaactttttgagagtaagaggggcatactccccttctggggttttatttcccccttgggcttctgaaactttaatgctgaactggcctctcacaagccacagacaaagctgagaatgtcaaaggtaactaataaactgctctgaaaaaaaaaaaaaaaagtaaacgtcattagagtggatggagtctaaaaatccataattctaagaatcccaggagaagcactgaacagctttttaaagccatttcttttgcccccaagccacaaaggattgtttatatccttttgaggcagctagctggatgcccctcttcccaattctgggattccctgagataaatactatcttgttcccttatatgccaactctactttctgctgttggaaacttctttgctacttgcagggccttctcctttcagatctgaaggtctggtctacttccccaaggcatgatgatagactgacgttcttgagccccagtgaaggttctagcctttcacagcttacattatcttcccatctcacatagaatcattctgtaaaatgtatatttctgaggtgtctggactcatacatcctccattgagagggggtctgaaaattgtttaatatagtttaacatttatggcatctcttccttgacagtgtcagtaacagagtgaagactgccattttctcaccaacgttaagggaagtcagggatagggcaggttcttcctacagtagcatctggtccaccagtactgagaacattctctgcaaggagtttgctctttatgtcatttagacattagacattttaaataataagcatgatttctacctttcatgtttttatcactggagttttctacctctccactcctccatctgctctaagccaagaagtgcctccagacagtgacatcttgcactgtgattaaagtgcttagtatagagaaatgagtggacaccaggtttgtataggtttaaagactttattaagtaagaagttgattgttttgtggctggagagaaccagaggaccattgtttgaaagctgacaacctatattacaaagaggtgacggagatgatatcatgactttcaggaagcacaggcttttggaagtgttcatcaagtgggtcgtggcataaggctgacttaaatttttttttaatgttttaatttgttgtagagacaggggtctccccatgttgctcaggctggtctcaaactcctggcctcaattgatcctcctgccttggcctcccgaattgctgggataataggcatgagccaccatgcccagcccttaaattctgattatatcagagccaagactttcttgacgttttgaagccaagttgagagcaaaacgacccatttctgattttctacataataaaggaaacaaaccaggaacaataatcaaaggtggattttttgtttctttgggaagttataaccatatttgcataaactttaaaacagttatgacatctagttgaggtactaaaacagtttctttttttaattaacttttgttgcaataaataaggccagactaacaaaaatatatccaaagccaataattctatatttgtttggcacatgttgcttccttcagcatacttcaggtcatctttgccaggaattgagaacaggttgcatgtaattacaaaggctccttggtgggatgaaggacaggatgactgacgaaataccacagctaatcagataagtgcaccagggaaaaagcaacatgtaatggctggaaacccaaaacacaagactttttttttttttttaagacagagttttgctcttgttgcccaggctggaatgcaatggcgcgatctgatcttggctcactgcaacctctgcctcccaggtttaagtgattatcctgcctcagccttcccaagtagctgggaatacaggcacccaccaccatgcccagctaatttttttatatttttagtagagacagggttttcaccatgttggccaggctggtcttgaactcctgacctcaggtgatccaccgactcagcctcccaaagtgctaggattacaggtgtgagccaccatgcccagccatcagcaaatgagtctattatgatgggaatactcatgcccccagactagatctagtttctcctttgatcccaagccttctggtgttgttctcctttgagcccactgtcccttctctggcctgtcctccttaatcttcttccaaggctattctcttctcatgctacacactctcctcatgtaatctcttctaaaggtttgaactaccatagactcccaaatctctaaagaccattcttcagctgagatctctatatccagctaagttctgcatccgtctatccaattgccaactaaacatcttacctagaggtaccaacaggcacacaaaactcaacatagctcaaaactgaacatgtcatcttcttccacatactctccccaacaaaaaaagaaggctgtgttgcgggaagtcagggaccccaaacagagggaccggctgaagccatggcagaagaacgtggattgtgaagatttcttggacatttattagttccccaaattaatacttttataatttcttatgcctgtctttactgcaatctctaaacataaattgtgaagatttcatggacacttatcacttccccaatcaatacacttgtgatttcctatgcctgtctttactttaatctcttaatcgtcatctcgtaagccgaggaggatgtatgtcacctcaggaccctgtgataattgcgttaactgcacaaattgtagagcatgtgtgtttgaacaatatgaaatctggccaccttgaaaaaagaacaggataacagcaatgtttaggaaacaagagagataaccttaaactctgaccgctggtgagccaggtggaacagagccatatttctcgtctttcaaaagcaaatgggagaaatatcgctgaattctttttctcagtaaggaacatccctgggaaagagaatacgcgcctgggggtgggtctctgaactggcccccccccaggcgtggttgtcttctatggtcgaggctgtaggggtgaaatagaccccagtctcccatagcgctcccaggcttaataggaagaggaaattcccacctaataaattttggtcagactggttgctctcaaaaccctgtctcctgataagatgttatcaatgacaatggtgcctgaaacttcattagcaattttaatttcgccccagtcctgtggtcctgtgatctcgccctgcctccatttgtcttgtgatattctattaccttgtgaagtatgtgatctttgtgaccaacaccctattcgtacactgcctccccttttgaaactccctaataaaaacttgctggttttgcggcttgtggggcatcacggaacctactgacatgtgatgtctcccccagatgcccagccttaaaatgtctctcttttgtactctgtccctttatttctcaaactggctgacgcttagggaaaatagaaaagaacctacgtgactataggggcaggttccctgataagactgccaacccttcttgtatggctgatattggcaaatggagccacaattaattcatgttacagcatctttgatcccacaccttctggccttgttctgtactccgtggtggctatggccctgtctgctatatgctagctaagttctgtcaagtcagtactgcatccttggatacttaccttgaatacatcccttctctctggaccttacttttctatttctaaggattcctctaactctatatttctaggcgtctttcccttgtctggggaggggtcaataaagagcctcactctttggctcagttaagcatcttgggtttaaccagactgtgattaaaaactcatgtgcatgaagcgaagtagattggtttaagttatacaaggtttagcgtttaacagtgattagtggatgatataaaaaagatgtgctttgtttccataaattgtcagaattttagtcttctgttttcatgcacactaaaataatgctcaattttccaaattgtaacacaatacaaagaggctgacaattgggtttcacttggaaaggaaaattaaaagtggtcaatacagatcacagaatagataatatttgcaaaggagaccctacttagaaataacacgcattcaaacaaaggtatgatgcctgaatgtgtgataactaagtagtttaaaaattgaaatagtttcatctgtccctgtaaataaacgtgaagagaaaagtacaaagtcctttggtttaaagggtcagtgtttttaacagacacatgaacgcatagtttaggggaactttcctttctaccccagaaggcattttcaatatcttgttggcatggcccttctacttgatttctaaggagccagatgcactgtttgcttttaagacaaggtctcgctctgttgcccagcctggagtgcagtggtgcaatcacagctcactgcagccttgacttcccaggctccagccattttcccaactcagcctctcaagtagctaggatgacaggcatgtgccaccacactcagctaattttgtttttgtttttgtagagacagggtattgctatgttgcccaagctggtcttggactcctgagcgcaaacaatcctcctgcctcagccacccaaagtgctgggattacaaacatgagccaccacacctagcccagatgcacttttaggtatagatgcatttggccccctagaaagtactcaagatgccaagttcagcaacaaggaaatatttgaatactcttggctttgggcacaacatggagctagagaatgggtaccccatgccccaatgtcaaaatcagcagtcttggttaagtaggaccaaccctgcctcaatgacccaacttgttcaagttctagctataaagacagaatatgacctcagctcttcctaatttcagtgcccaagctttttccacaacaccagggctgcttccagttagtatggcaacaccattctccagagttgctaattttcactggttttactctacttgagtttcctatctgtgggcactagagctaagaaatacttctgcaataggctgtcactttttagtcataaagtgtgagttaacatataatttgaacaaaaagccaaagccacatgactcctttagtaaacctctaacctagtttgcgtcagtcagtcaattcaattcagtaaacatgttagaagcccaatttaccaggtatggttttcagtcagcaggtgctgaaaaccttgtatatggcaagtgtgatcagagatattgtgaacagatgtgaatacaatttgcccttgtccttaaagaagttaatatgtaatgtgcaggcagagtggacattcttgaaaatcccataagaacatattaagtagaaagtgaaacaaagtggtaattcaccagggaggaggaaatgagcctctccaccaacacttagttcgtatcattctgtagtgtaaaatcagaatctcacctccaaatgaataggctgactgacttctctttgttctccgtgtgctaattcttgccattgcagttggctcctttggcttttcctaaaaagttcactgagaattttctggcctactctggggactccctaatgtgtaatgttcaccaactaggctccagttgtgaatttttaattatgccggatcattttcagtaaatagaacttcgggctcaactaatgctgtcagatctaatctttgtctcacctgctatggagctccactctgtggtgtttgcagtaattgccacttccccaggaaagaggagcttttgcagagatggatgtcagcagccctttgcattctcatctgccctcctcagaagccctacagcggggcactttatccagcagatttgaattttgatgtttggaaagtagagacaatggatacagctgattgttctctttcaattttcaccaagtgtgattgtctcatgcttcctgtgaggcagtagttctcaaagtgtgggccatagacaggaaacattaccgtcatctgggaacctgatagaattgtaaattctcaggtcccatcttagacctgctgaatcagaaactctgggggtccctgccacctgcatttaaaaaatactctaggttatctgatgtatgattaagtctatgagcccactattgagagagaactgtttcaaactaaggataagcataatttcgttctattttgtgaaaattctcataactcatttttctgatttacaattcttcaaaaacaaaaatcctaattttcataatggaaactcacatttacctttgctttccctaactttcccaagcataggcagttgtttcctgttttatttccctagcattttttcacacttgtttattccacttggtacattacattgttatgtagctgttaacatgcttgccttctccactagccttggggccacctgccggcgggaaccttgtcacactcatcatagtatccccaaggctacatagtaaacacacattaaagggcacagagtaaacacattcaatattttctgagtggataaattggttaacattgtataattttcaaaactaggtaatggccttaagaagtacgactggcagaataggaaactgagacccagagacattaaaggattcagttggtaagaagttgcagaggcagggctaacaacaaaagcttacctcagtatgggaaaggtgatggccacaggtccctcaaaactggcctaatacactaaactccactcaggaagcttgggatactttggctcttcaagggcaaagcccttgatttactcccagacaggttgctttctgccccaaaaccaaggatgctaagagagggtagctgaggttgccagttagtgagacacgtgcagagactgagaatcaagagggaagggaatcatgtaaaaaaaaaaaaggagattttagtactattggaggtataaattctagtactcggttaggccgtggtaaagagaaaagatgtgaactgcaagtgaagccaaggtagaaagctcaattttgctcatttgccagagtgtccttcttacaccaaggtgaaaacagcataggatgtactctgtgaggtatttgttataggaatgggctgccaatgattgccaccaatctcttggtacccagcttgccttgtcatctgtaagcaatctgggtgggctgggagaatggggagaagcagactatgggcatgggatgaagaaagccactggcctgcaccaggaacgaggccttcactttccctcattaaccttagcattaatctctacataactaagttacctgatttagatgcttttacttggacctctggcatacaagtctttgtaacgcagttgtaaatcctcatagagtggggtgggagtaaacagattctggcataggatgcttcttgaaacactccttaatcatagtggatcactgtctcatcaggcctcactgtttatctcatggctttgagtcccactttggagcaatgaccgcacatctgccttgtctttcttcttgagctccagttccatttctctaattgcctactgggacactgtccatcaataccccaactcgataggccccaaactgaatccgtcatcttctcctctagtccagatctccctcccaactactctctctttcactggcagagtaaatttgttctcagtcatccaacttgcaaaccttctcagtgactttcatttagggtttattctcattccccaaacatagtcaatccccaagttctgtcatattttcttttgccatgccaggcatagttattttccacccctataactgccattccagcccagcctctcattatatttcagatctcaattaccccaaaccatccaattccataactatggtttctgctcctcaatccctgatgtgatggagaagcccagagttagatgcgaacgcaacagttttataataccacttacaattgttagataccgttctattggcctctgatagtttgtaactacggtccatactgttggtaaagacacatgggattagtcagcttaaatgagaaaataatataatttagaaactgactcatgttctttcttgatcccaatgaggcattcagggacgtgactgtcactctctgggcaaaaacaacatgtaccaagaggtgaagagagcaaaatagcaacaaaaataaatgagcccattgctgcagtccctgatgccctgtggtgagctgctagagtgaaaagttaatggaatgggagagggcaagataatgtgagcgccctggttgccttttccaagagcttttcaattccagagtaactgtgagcttcattgtgaatggtttacctgatcagtataattccctctcctttgtagataagaagactaagacagcaagaagttaaatgccttgctggcagccaggattagaacctgggattcctgaataaatgctttgaacttatgaggctgcttctgagagatcatagttacactgggcttcatagcaataaaaatgagcttttcccttccctcagaaatcctgttattatccatagttaggcaaagggaaactagaagaggatgctaaataaaagcacatctcaatgaactgaactatctttgccaggtgattatcagaaatatagataatgagcgtaagatacttaaaggggcaaggactctaatttagacacctcgggcaaaagaagtgaaaaagtttggaacaaagaaaaccactcaggacataacctaacaagatagaaaaaaatgaaatgcgaaagtattatcagctttaattaaaggaaatcaatatttgaagaggtgtcttgctcaacaatagaacaagggcaaacatacttcagaaatgtgagtctcttagaaaagagaaaagcaagttttcatggggaaacaaccacgattgaaaaacctttcaaaagatgacgacttggtgtatctgttggagaggggcctgaagcacctgttggggaggccgactagatgagcttttatccctgggagagtctgttttaagtgcattttttcagtcagggagtgttcaggagcctagaggcatctctagggagtaaagaatagccagtatttccctcagagagacttgaaacaaaccctcaacaataaagtgggtttcatctcagttatcacttacaagaacacacattggaaaacattaaggactatacaaatgcaacagatgtgttatttcagaggcactctgcaaccatccaagcaagcttgcttgagaatcctttctaagctcacgttttttgtgatgcacatgatgaccaaccttcagtgactggagtccaattctcccagaccattcctcttcagggatggaagatatgtgacatgtgtcaccacttccttctctcaaactggtgcaagacattaatactcaatcatgacacttctttccattgagcccaaatgcagctttttcatttatttgttcaatgaatacctcttgactgcccatttaaaagtgagttggagagacagataaataataaaatataagcaacactacgagcaccacatgctaagtgcctagtaaaagatatgtagacaataaatatcatagccaaacctgttctcttgaaatacaatttcaatttcctgggaccctgaaaattaattcttaaaatttcagtactattgtagttgtatcagcacaactatttttcagggatctgagatgaattaattccgaaaagagcttacaaaggagatgcagaagtttctatatgccacccatcaaaaaagtgagtcaggtgtgttttaagccacagggttcttctcccacaattagctttgaccaaacagcaaaactcagattggagtgggtctgattgccattttggtttaagtacactggataccatttcagcatcaaatcattcaatcagaaacactgaaaatgctgaagagttgggttagttgcaattttcccacctgaatagaatgtgcataatactgcaaattgttttttcacttttgtagtgctggagacatttatggaacctgtgggaaagggttttcttgacagatggagatggacagccaaccagacagaaggagagctagcactcattaacttttcccaacagaaactcacctgtaattgttttcacaggcctttaatgaggcttggttgtgaggcactagagagaggaaagcagcttatccatagaaaaggatagctactcaggtgaggtagaggaagcctggatccatagccttggaaattgtaggacataaggtttgagattacaattcaaagacaagatgaaagtgatgagggctgacaagtagtctagagatgggcaaatcaaaagaataactactggggtagatctgtttcggttatgtaagttaggaactctaaatcaaggagcacccacccccccccaccaatctcatatatccaaaattatatctatgtgtctttgaaacaggttggatttattcttgtaaatccctgggattgcgggatgtttcagtgaccagagttcttggcaggatcttaatctttaggtctttgccccaaagatctttgaagttcccagacagtctgcagctgcagtattttctctttatttttcatgggacccttctagaaactgcagtgtccttgatatcactgctttagatctccttctctctcaaagtttcagaattatggcatcttgcccaggcttatctaactgacctggattttggtggaggaatgaagactttttctgtcaatgttaggtaaacttttctataccacagtcattagtacatctacaaaattaagctccgaggatccaagccagccacaagttcttcttgatccccctttcagatacatttcatcactgttaatggatctgttatttgcacagaacaaacatttccagttacttgattaattttacccctattcttggtgcaatgccttccctgtgtgatttattcctgagaatgtttttgttttcatttccccaatatctgtacttgggggatttggcagtaggttagaggggcccttattcctatcttttaaaggattactgctccaggaccacctcccgctagagcaccagttgacaataatgaggctgccgctgccagctgatagctttccctgatgtcctactgtgtcctgcattgagcttaaacagggtcaattataatgtaaactatagaggaccctagtgcccaaggcgcagacatgggaatttagcagtgggggattttgctttatcaaaaaaaaaaaaaaaaaaagtgaatgaatgaacttagtgactcagcacttagtgatttagtgatgacttaaatgaccacctactctgagcccagtagtgtgcatgagacacatcaaaaacatcccttgtatctgaatgcttccagccaagtttcccactgcctactgcttaagtgaggggctaggaggaggaaggctcagtggccagtgaccagggtgcaagagtgacacagagcatattagcatattgcattctttgcatcaggctatgccaaacttctggaagagacaattttgaatttgtgaggaggatagccaggatggtccctggtctcaggtccctaaggaatcctttgccaggaagtcatcgaggacggatagaggcagcaccaaatgaattcttcagtccccactcagaatgtggccacattctggtgagtctgtgagtggtacggggtaatggtccctgcactgtgcaggaatcccagcacttcattccagtggatttctgccccctcctctgggatagaatgtgtgtccactctctccagagccatccactccagcagcagagccagagctcacatgggtatctcccacttctaagagctgcttttcataccccctagacgttttttgttttgttttattcttgagacggagtctcgcactgttgcccgggctggagtgcaatcgcacaattttggctcactgcaacctccacctcccgggttcaagctattctcctgcctcagcctcccaagtagctgggattacagacgcccgccaccatgccctgggtaattttttattttttatttttgtatttttagtagagatggggttttgctatgttggccaggctggtctcgaactcctgacctcgtgatccgcctgacttggcctcccaaagtgctgggattacaggcatgagccaccgcgcccagcctagacactgactcttaagtgcttggacagttgctatctctctgacttttcctgatcagcctttttccatgcccacacacatctttattacctttgcaatcaccaggaacccatcattatctcttgttccaatcatatccatgaagtcatttgaagctgatgggtgcatggcagaatatcttttgtgacccccagcccaccccacatataaatacagctacttgcagacatctattttggagatacttaaaaggttcataaatatctgaaaagatgtttgacattttctgagacaatattctttgccactggaaggttctattatacacattaaaagcaaagatacatatttttctttcttaccttcactttttataaaaggttatgctgacgtagaacttactaacaaaaaaaaaaaaatcttcctgatgaaatcaggataaataattccacacatcttcaagtggagagaaaggctttgaattggtttccatggaaatctgaagatgaagtaaaggaataatttcaaggcagagcagctgaactgaagataatggtaaaatagtttgataaaggaaatagaataaagtaatcaagaagactccaatcaattattcctttttgtttacctttaggtgattaattcgtctgcgtttattaacctgatgagattaagcaggccttccttgtgatttatttcgtaattgtttccaaggtttgacataagctgtggagttattgaaggtggagatttaaattcaattactatgaagcaggtggtgattctcctgaaagaatatctgaattcacggacttcccatgtaacattatgagtgaaaattattaattcatctgatagtatctcccaaagacttttagaagtcatttggcatccacatacttcaccaaaagtcagcagcttcagaactgaacatgtaatgaagagaattcagtgcctggaaagaaaggattttattttaaagactagttatttttatacttttttttttaaaactagaggcccccttggggcctgggctgtggtgctatcattgatggaatccatgagctcaagctttgaatgccaaaaggatagctttctttgaacttgaccagtggttcccactctctacctttaaagggcacaactggataagatcatactttgacaggagagagagagagagagagagattggccagggggtggtggggggatatgcaggctggccttgagagtctttaaatgaagtgactaattgctttttgtctctgtggtccttgttgtgtatatgttttctattctttctgtgggtatagtaaggataaacggggttctccaaacactaacgcaggcgccaactctccgtcatccacaaagacccggaacacatctaagagtgggaagtaagtgaaaaagtgctcctgtacatctgacatagctgtcaaaaagtcaagtgctgtcctccttttgtcatttattcatattcattcaacaaagatttgtggaatgtcttctgtgtgcctcccactgggctcgtcactggggaattgaaacgagcaaggcatgtgtcagtaatattgggtgcatgaagaactagggaagagggaggagagggatggaaaagtcaggagatgactctggaaagatagcttagggctgactgtgaagggcaaggacataagtccataagggcaatgtaagagttggattacaagttttaagaattaaagcagcagcagcagcagcactgatttatgacttacaaagtccatgaaaacctgtcctgatccatacactgagtttaggcttgagttagaagaatctggtaagcttttccataaatttcctggtttaagtacatttatgttttaaccatatcactgatttatatgatatgtatattcttttcctagtaactaatatgcaccaagtcctacatgaagctgtttttttggtattaccaaaacttgtatgggctgaatatttgcgatattagattgaccttttctgggcttattccagaagacaacaccagccgatctctccctttggcttcagcaaagtgtggcaaactcaggcagtgtgatcccacgcagatgacatacctctaattagacacttccccttggaagttgcttcaaccctgtggtgaatggctcgagttctccgtaagctctctctccagggtgtggggcattgtgacacgcagaaactcagtccagaaagagcacccagcctgcatctaggagaaaatgaaagataccttcatcatgctaaaagctctaatctagcaataagatatgtcactacaagagcacagctttgcaatgaaaggtgaatttgtaatggtcatatattttatgtattcagcattggaccgtaaatgctgcactttgaatatgatcttatattcaattcccaaagtgaaagatctactggctgcctttttttccttcttttcctctgaataccatttcaggtttgcatataaagttgaatgcgggttatcttgcaaaatataaaaaacggtgttaaagacataaaactaaatctccaagcagttagaactcatttcagttatttattgctgagcaccataatcaaaatgctgtataaattatgaaggaagggaattgatgcacacattcccaggcagctgaatgttttcaaattagtcccaattcattgttaacacgcactcttagttaacagggatggcattgcagaacttcttttaactccatgcttacaacaatggcagaccctacctgggcaccctgtacctacctgtcacaccaaaaaccacagggcacaatctccatttattagtccctgatgtataattatggatgtttgtgatttgctgttgcctttccaaaggggccttcccttgtttcttttggctttgcaggagttcactgtcttactttttgagtgaagaatctccatttgagctacaaaaggagcaattggtagaatctgagttaagatgacatagagaatgcatacctaataccatacccaggttttcaacagtgggagggctgaataaatacattcttaaggagataaaaaatgatctatatctcacttgccatacttggtcacatcccaagcttctgccatggtgaagggtctctctctttgcacattttgagataggtaacttttacttgacatgtatagtgactcatagactgagctagttctgaattcttcattgtttttattggttgttagtgaaaaattacaagttctccgacatcctcttcctagatatgtgtgccagggtttcttgcactgttctcctcctcttagtcctctcccatcagttttcaggagatttttctttttttccattagtgtacattttctccttcttgggatatcattttcaacaggagcagtactgaccttctgtgcatatggtgagactatgaagggcatttttcacactttatagaacagtgcctatggatgtttaggcactgtgttctagttcagagagagttgtgattgccagttcctgctgcactgtctatgcatttccttagctttggtgtgtgtggtggtgaggaggggataggtagatgtctccaccccaaggcttttccccatggtgtattttctttcacaacaaccagcccagaggatgccatgttctgatgttatttgacctaatgacaataggatatagagcagtttttaagaatttccctatgttattttgaggccagacacaggctgggagatagaaggagggttctttccttctctgaaaagaaattcagtcttctctgtttttgaagaaaacaaaaaagcaaaagtcaagctgccccaaatatgcatcatggctaaaaataaggaatatgtgttgactgagtgttacgggccaacctgtgtcccaagcacttggtacattttgtctcattaatccttgcctaccaaaagctcatgaaacaggcactattatttctattgcacacatgaggaaattgaggctccaagaggataatgatatgcccacctgaggtatccaaatgaacaattttggtaaaaaaccttctttggcaccaatgataataatagtagtagtaattaaaatatattaagcatttactttgtgccattgcactagactctggggccatataaatataaaatactataggtgcccccaagcagttcacagtcttagtagggaggacagaggatgacaacgtggtatttaagtgctacaatccctagctgatgccagggttggggtgggaaataggtcatatggggatatcaataaaggctcctgagaagcaatccctgagctctttaattttatccatttacccttcatgtagcaaggttaggtcagagaaagaaaatgcaagtcggtcactccagaggggcagaatcctctgtgtcttggtcagaacacgttggagttgtggattaggtcaaagctaaaatgaaatgtctaattccacctttttccaactttcaatccatttggagcctactgagattcagtgtagcatgctgagtcgcttaggaaacctacagcttgaatgttgcgtcagttctggttgctctatttcattgcctggatgtgaagctgggtagccagccctctgtttcagggaggaacagatggaatgggatatgtctgagcagcagagccagactaccctggaaatgactttcagggaggtgcaagcagtttcttctatgccaacagtgagccaaattgacaagacagaaaaaaaaaaaacttcagtgcagaactgtgtcactgagatcaggaagcataggttttgcagaggttgacccatgaccaatcaggccagaccactgcatttagcctcacatatggttccctttggtaatgtgaacctgttattctggccaacacagcagaacacagtcaatccatttgctgacccattggattatccccagaaagcaagtaactgtcaaagctgggcatgtgtagtagccaccaagagcctttataatgttcatttggtattggaacattttcatactttacatgagaccaattattttgctgaacacaaggacactgagactcaagaaaggtaagtcactttccatgaggcacacacctagctactagcagagggcagcctagacacctggtcttctcatacttgtcccatgatctttccactgcaatgtatgctacagttcttctcccagagagcaagatacttcagctaattgcaccaagggaggccaggagccagatctcaggatgtccagccaggtgctcttccctctttttgtgtgggctctgccagctactgtgaaaatggagactttttggaaaaattagaatcatcctacttttaaaaaaatgtagcagtagcggtgatgaaaggaaaaagcatgtacttctcaactgcttcattttttcttctaaaataatggtatctctggttctatttggacagctacctttcctcaacagtattgttgagccatctcaagcctctaatctactccatcaatgaagcaatagagaactcatatatcactatagctattctctctcgaatcagccaaccaaagctaaggagatgtagattagataggtagatagacaaacagacacacatatatctacatctacgtatgacattcagaggcatccacttaaaaattaaattgcccaaagttgagatgatgatggaactcgatcactcctctcagtctgagatgtttttcacataggctcaggctagggaataacaaggaccaagtccagttttcaagtactagtgaaggccacaaatatggggccagggcagagcaaccaagcacagtgcctggcaaacaatactataaatgttgaattaagcactataagtgatgggttaaatgaattaagctaggggaaggagggatattaaaatggagaaaaagaaggtgtacagaaggggaatatgagatgatcaagtcaaaccctgcttactccacaaatctacttggagctgactctggtaagaccggctctaacctgcctttgccggaagtaccttatagtgaacaaacctgtttatctattcagtagtatccagataagagtagtcaagagcacatagcttcataaataaacataccagcacccctttgcttttggctggcaggagtcaaatgaaaaacttttcagctttagaaaaataaagtgaaggctgggcgtggtggctcacacctgtaatcccagcactttgggaggccgaggtgggcggaccatgaggtcaggagatcaagaccaccctgtctaacacagtgaaaccccatctctacaaaaatacaaaaaattagctgggcatggtggcacacgcctgtagtcccagctactcgggaggctgaggcaggtgaatcatttgaacccaggaggcagaggttgcagtgagctgagattgcaccactgcattctagcctgggtgacagagtgagactccgtctcaaaaaaaagaaaagaaaaaaatgaaagataaaatgaagtcttgcttgctctgtttggactcagcatggtgcattttcatgtttgacttcagctgtttctatgtccattgctggcaccagagtcctgcatattatatcgtgattatgttttttcctctaattgagacccatgtattttttctaagacattgggttgtgactgttgctaacccccactaattttgccactgtgtgtgtatgaaagtatgtgtgtgtatgaaagtatgtgtgtgtgagtgttctcttcaaaatggttgtatgttgcatgaagatagcaatccactggccaagtatttgactttgccagtaattgctgtagttttatgtgatgataatgtcaatagttccttagtttagctactagactaagtctaatatcacaaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggttgtctgcttttgccagttactgaaatgtggaagcaaaagccccagcaccataataacaatataacataataacataacataaacagtgcccatagattagatgctacaagaaatgagtaacagatccaggaagaaagagtccagccatggaaatgtttcttagcaagttcacctgcatctctgtgatggttaggatatacagtacacttcgtgacataataaatccacccccccaacccaacatatatgactttccatgctggtcatgcttctatagcttagtcaagaagagtgttctgttaatcaagccttgaaaagcaggaaccatttttctctcccttcaactgccatacaaaaatcagggaggcaatgtgctgctgctctctagaacaggggtcctcagtgactctttttctacctctgtgtcatacatggttgagaattctcacttatattgctctagcagagctcagggttctgtccagttcccaggcactgtctggaattccactcttctctctccctattgggaaagactaggaatgcaaggaagagtgatgttaaacagtatgctatttttttccacgtaataaaaagcaaatctctctctctctctctccttctctttcacttttccctccttccttccctcatctgtttgttcattgatctattaattcttccaccccatttttctggctctcaactgagctttctttgaactaccttggcaactttcttgaagatcatttgtccatatgtatttgggtctatatctggactcagtgttattccattgattgatatgtttatcgttatgccagcaccacactgtcttgattactatagctttatactagtattgcaattagatgttgtgagctctccaacttcattcttttttctttcttttttttgagataagactgtcaacccaggctggagtacagtggtgcaatcatggcccacttcaacctcccaagtaactgatacgactggcacatgccaccatgcctggctaatttttttgtagagatggggtctcactatgttgcccaggctggtctcaaacaatcctcctgccttggcctcctaaagtggtgggattacaggtgtgagccaatgcacccaaccattcttcctttataacttgttttggatgttgtacgtcctttccatttccatatgaattttagaatcggtctataaatttttgcaaaaagaaaaaagaagcctgctgggattttggcaaggattgccttgaatctgtatatcaaatttggagaaaactgacatcttaacaatattgagttaccatgaactcagggtatctatccatttatttgggttttttaaatttcactcatcagtgttttatagttttcaggatacacgcttttcctattttttttgtcagatatatccctaaatatttcacacttttggtgctatggtaaatagtattgttttatttcaatttctgattatttctaatagataacagaagtataattgatttttgtagattaatcttgtattctgcaaaacttactaagttttaggagcttttttttttttggtagattccactggatattcattggatattcaacatagatgattgttatctgtgactaaagacagatttattcttccttttcaatatggatgtctttttcttcttgccttattgcactggttaaagcctttagtacagtgttgaatagtgatatggttaggctatgtgtccccacccaaatctcatcttgaattataatccccataatccccatgtgtcaagggagagaaaaggtggaagtaattgaatcatgggggcggtttcctcgtgctgttcttgtgatagtgagttctcacaacaactgatggttttataaggggctcttacctcttcgatcagcacttcttcctccagccacgttgtgaataaggtgccttgcttccccttcaccttagaccatgattgtaagtttcctgagtcctctccagccatacagaactgtgagtagtcaattaaacctctttcctttctaaattactcagtctttggaagttctttatggcagtgtgagaacggactaatacaaatagctatgagttttttggtgtgtaaataatttctacccacttaagtctggaaaaagacacatacaataatggagagatagttgaacaatggaagcgtcctccgaagatgctattttgggaacaaatggttgatccctgcctttattgcatgtccaaagctagattcccatagcactgcacagatatatttcatcagagaaaagtagatcctattcatggggaggagggggaggtggaggagaaaaagtgaaaaacaagaagaaaaataaaccctaaagttcatagaatcatatatacttttctcattattctcattctttcattcatgttctctctctctctctcttctttgaaagaggtagtatagtataatggttaagacagcaaatgctggagcctaattactgccttaaaagcctagcattgccctcggaaggttaccggctctccctctgcatcagtttcttcacttataagaagaaactattagtagtgcatgcttcatagggttttcttgaggattaaattctttattcattcaaaaattttactgagtgcatagtaggtacaagatgctactctaggctctggggatacagcagagaacaaaacaggcaaaattccctgtccttatgcccattataatagagggatacagtcattaaacaagtaaaagacgtattattttaaaagggaataagtcataatttggaaaaagcaggggagaggtataaggaatcgtggaggcaagaaacttgtaaatttaaagtagttgagggaaacatcactaaaggtgacatttgaggaagggtttgatttatattaagtcagttaatgcatgtaaagaaatgggaatagttctttacatacagcaaaaatatagtacttttatgaattataatttattgagtactttctgtgtgtccaacactgtgcgagatgctttacatattatcttgtttaattattataataggcctataaagtaagggttattagccctttctactgaggaggaatctcaagacattggcttgtccaaagtcacatagtaggtgatagggccaatactcagatcacatctgagcttgtctcacgaggctaagttcatctaccccttctgaagacatcctgcatgcttagggactatattagactagactttgattcacaaatattagaagactggtcctgctgctggaggcctcagatgggataggattatgtagctaaaagcttctacaagggctgtggggagtggtgaaatatcaccttatctttagtatttcaacttgagaataagggcaatattgcctggcactccaataccagcacctggctctgacactttcactactatgtatgttgtgggcaagcaacctaagaatgggaagtggggaggacagaaataaaacaacgttactgggcaatagctattactccattacaaaagatgatttgggttttcaggatggtcgcttgctgaagtttaaacgaaaaaagaaaaatgaggctggactcagctcactgatgactgaactataaattttgcttggaaaatgctggcaatgctataaaattcaggccaccatctgttagtgcttgcttaaagtagcatttgcactggataattaagatgtcacatgcatttgaagcacaaatcatcagtgcatgggtgcctagcatccctggaaagattgtggatggtgaagatgttctgagaggaatatcatgttgcttgaaggatacatttatatgaaatcacaggagctagtgttttggatcacctgagtggggttgagtagaggaggagatgaggacactgagaaaactgctttcttgagttgactggatcatttaatcaaaatgatcaactggctaggcccatgcagtatggcaggcgtaataatatgtttggccatcactgtctgcaaagctcatagtgaattcagggatataaggaagaagggaggcaagtctggctaagcctaaaattcctaattaaaaaagaatttgcttgtaaagcactttataatttgcaaacagccttctcttttgttatttcatttaattaattttacccaccatcctaggaagcaggaattatatctacatcttacagactggaaaactaaggctgagggaaatagcatatttttgcccaaagccacatagatagtaagtggtagaaccatgattcaaaacagggcccttttaactctaaatcctaaagtattttttggccaaagcacaacgtgctctgatattagagtcaaataattttacatacctgaccaaaaaaaaagaaaaagaaaaaaaccatattttacaactttacaggcaggtagagaaacttacagacttcaattccaacaaagatgccagagactgccaaatatagcaagggcctggaatttttaaataataagaaataacatttattgagtgcttcctatgcaccaggccctgttcggagtgctttaaatgcatgcattatttcatttaatcctgagaactactccatgacgttgattcagggagagttcatcagtagcttagatggtgttgcccatacccaaatattgaaggttctctttggggtgatgtctgggtactttcagcagacacagcatggctggattgtggagctgagccaaggtaatgattctcccagctttggagtctaaagagtttcgctgttttggcatcaaagaccataattaatggaattaagaaggctgggcttgcttccaagtggctcttcaagagtgtccttctttctcatcatggttggggaggagatttgtgctccacgggctttaatgagatgttctgtacccaacgtctgcatgtttatcttcacttccccaatacgtgcctatggacccttcaaggatgatcaagctattttgtgccttcaccctaggcaccagggtatgttgttcagttgtgatatttgtcagaaaaatcttaggttggtgcaaaagtaattgcagtttttgccattacttttaatggcaaacaccacaattacttttgcaccaacctaatagtatgctgccactgcccactctcctagtactgctcccccttcttctgtgaaatgcaggtaatcattctcatcactcctcctggcatcaccaggaggatatgaaaacaagcaatataatgtctccaaagaccttacaaaaaataaataattacaaaaacatacttcatggtggttttcagtaactttggggggaaaaaatgcatctccatataagtaaagttgacagactcttacccctttccctgagaatgtcttcttgccatctatgtgccaggtttgcagaggttgccccttttctcccacagatcgttatgtcctttcccaaccacatgcctagtgtctcaccgactattcatttctcacttgccctccattggcagccatattttcaggggctaactacacatacccagctttgtcctaaaaacacacaccaagtctggaggccacgagtttccttacctgattatctgggtttctattcccccacttggtggtgaggaaacacatgcataatgttgttatttttttctgcttgcttgtaatttgggaggcagtgcgaccattcattactgaatgcctacaatggacaaggcatttgtgttagtcaacaggaataccaaggaaaaggcatattgtccctctcccctgcaaatgcctcctggtggggaatctctgcctgctgtagccattcttcattccaattctggcttctagcagatgaaaaaggacgaaaagaggtataaagaagccacccaggccattgagcctgagttcatagagccattgtgatgcacttaccatgtccttcctctgtgtagaccagtggttttcagtctatgttctgtacagcccttgggttctgagggaggacctcaaagcctgccatgagtgaaagtgatggggtagtctggagtggtaaatagatggggctccaggccctcactctacctcttcctgagtgactccattttaatctgttttacatattgggatctgcctagatttcattttttaaagccctgctgctgctagaatggaaaaccaaaaaccatatgttcacacttatacatgggagctaaactatgagtttgcaaaggcatacagagcaatataatggaccttgagactcaagaggccagggataaaaatctacacattagatacaatgtacactgcttgggtgatgggtgcactaaaatctcagaattcaccactgtgtaattcatccatataacacaaaactacttgtactccaaaagctattgaaataaaaataaataaataaaaataaaaaatacaaaagccccgttgctaagaaggaactgataactaccagtgtagacccagccagagaatactcagggagcaaggtttttattggaaaaccgcctttatccaccatgcctcagctccccagtgacaggcaaagcagttctggctattggacaatctcacagtcccctttctcaattctgcaagcttttttaaaaaaagaagaaaaaaagaaatgcttcctttcatatggccaaattgctctgaacagatgaaagggaccagactgacaggtgattgttccctaagattacagcctacacccaggctgaatctgaaacacttggaggaaaaaaaaatgctacaggttttgagtaatgctccccgactggcatctgctctcaagactaaatgaacacacactatttccactccatttccttaaactggcctctgtgctaggctgtaatgaaacctgtaggggaagaaagaccatttgcttggggaaaggattattttagttgcttaagccatcctctcccaaaaaataggcggatggttaggctggagtctttgtttttaatttaaatgtcattaggaggtccatgagttttcctcatatttattgtatgctatacatacacattgtagctattttatataaccctataaacaatttttaaaataaattttaaattgtctctttatattatattcactaacaaattcaaccttatcaccaacaatataatgttatcatcaggcccaaccttcatccccttcgttatactggtcttcttcttgtctataaaatgtctgcttttccataccattgcacctatcttgaataacctgtgtccttcaactacccatgtccaaacactagttcattgaaaagagctcattctttcaaaatagataagatatgtatttctatcccagctctagtaccttggacaagttaatctctttgagcctcagttttctcatttgtaaaatggggagaataactggaccttcctctctgctagaaattccttgaatgttcactgagatgacttaggcagatcttctggtacatactggtactcattaaatggaatcgttgttattacttatatttcaagacaattactgtgccccttactccatcatgtctcccttgatgcaacctgagggcatctctccctcctctgaacagcatctatttagcattgaaccagacactaagatgtgccattcatttgtttattaattcaatgagcaactatttattgtgcatttagaatgtgataggcacattaccagatgctggggcagggtgggcatagagaggtggatgtgaaagaaggaggagagaaggtggagacagcagggctgaaacagatactgctcttaagcacctaattttctagtaaagaagatattcatatacaaaaataactagaatacaaggaacaaagctatgtgctttgtaagaaaggtgcagctggagactcggctggaggactgtctccactggaagaaaaagttctggaaatgtcaactgtcttctttcttgttaactttccctttgtttgcttatctctccagcaaagttctggctgtggctccttgaggaagagtgggagtacttctttatcttccacagagcctaccaaagtacaaaatgagctctcagtgtatgcgctgatgtgagtaaagtatctgcagtatctgtagtaaagtacctgcaaagtatctgcagtaaacagaataggtatacaacacatgccagaaaagaccacctattctcttattccatcttatagcatctcataaaaagtgcatgcactgcaactcgatatgtgaaaaagttctaaaaaaaatggatacataaagaagtattcttcctccttgaactttaaagattcttgagcttattttaaacaaagagcattttgttgaggattttggtattgagccaactatagtacacattgcatttccctgaacctcatgatgttacagagaggggctaggagcacttctggggtacacttaccctacaggcacttctatttgaacctactgcttgtccctgcctttctgaatctgagaaattatacctgagagtactttttaaaaaccagttgattgaagtatgattgacatataaaaagctgcatacatttaatatttatttatatttaatgtatatatctcattgagttttggaggtaaatatacatctatgaaatcatcaccatcattaaggacataaatatatctatcatgccctaaaggtttcctcctgccccatgattattattgttttgttttttgataagaacacttacaacataagatctaccctgttagcaaattttacatataaaatcaagtattgttagccataggcactatgctgtgtagtagattcccagaacttatttatcttgtgtaattgaaagtttgtaccctttaaccatcaccacccccttgcccagcccctggtagctaccattctcctttctgcttctatgagtttgacctgattgtgcttttgatggatgttagaactatcttccttgacctggcttcagccatataagactgctgcagtgtctgttgaaagttgcatcccctaccccatctcagcacaacattctcctcctcctgttcatcttcatccctctttcaacccacagtagtcctttcattaacagagttgcttattcagtagtgcacagttcttttaaggcagattccaatgacttagggtttgtcctaattgactaagctggatgcaaaaaaccctgagagtcaaatgactgtggacatctgtccccatacctaaccctaagcaactctgacaccttgagaaagtcacctagcctctctgaatctgttttctctgctgttaaatgatggggctggctttgctgactaaagtacaaacaaatcgtgagacaagcccccgtcaccactatcaacacaaataatggagctagaaacacgagatcctttccaggtaatttaatactgctgcattttaaaagtcgtgggccgagaagatgagttttaaaaggagggaaaaagtaattcacatctcccaagatagtgtttataatggtctattaagaacacattgaaaagaaatggactaattctgtagtgttttacccaggacagcaggccagttcagtcaaagtgttttttgaatagggctataagcaaatctctttcggtgaaacctagagctgctttgcagaaagcagaaaagtggagttttcccctaatactttaaaaaatggtcacttcaccattgccaaacttcattaccactcccaggagctaaagcttcgagattaatgatcctcatcttaaagagaaggcagtgaccgctaaaagaaaaaaagaaattacaagcacatggtatttactgttctgcattctttgagaattaatgtcagtaatactgttgcaacatttttcaaaataaaggatggcgttttctaattgtctagttaaaaaaaaaatctaagtctgaatccccagagaagaaacctgagtttaaatcattaacaccacaaatctctgataattgtggcatgtttgcaagtgccttaatcaggatggtatgtcttagtggcctgttttaatttgatcacactgattaagcttctgtaagctaatatacgttgcatttccaattcaattaaatgagaatctcctggccttactagatattaccaaaatgccctgatgggtgaacactagacttggtattttcaattgctaccgactttctgattatataatctttgtattaaatgaaatcgatgaaagctcaaattaaattcagcaaactttaaggagtaaatatgttttccctgtatttttggcatactttcacctcaaggtgtggagcatgttagtcggaactcattgattacctttagtgataaattttatagggctctctcccccgtataccaattcctagaacagtctatcctgttagaaggcactgtaaatgtgggtgatgaataggcactctctctattatatatgtattatagttgtgcctttttcagctgtagataagagctatcttatgtaaatgtgattgctttgtaaatgtaaatgcctattgggtcatcgatcatcttggagatagaagaaacagaacaatagggggaggtgtgagagaaactgtctagggacagaaatgaagaaaattgctaagtgggtaacagattgaatcattagagctggagaactttgtggaggtggctaggatggaaacagcagccgcgaaactactggaagcctggcttgtgcctgcagagccctccaaaaggcttgcttccttgaggttctgaggactgactgctaaatgagaaatgggcctcttcagtgtaggtttgaagcaggaaggaactgaaaagaaaagcccaacttcattgttaggtgagcactgtgggtgcctgtcgtttgcctgcgcataacaggtttggaatctctcaaatccttcccactctcaacaacccacacaagttgtgagagtactacctaaaaacagccccttggtgtgccagtcatatgccaccccctggaggaggagggtactgaataatacctactgctgctgattcccatgccctagcagttctctcaattttttgggtggtatcaggaggcaggcaggcccagcagtgaactcaggaaccatcagggtgaaagtgcctctggaattttctcacaatctgttaggccctttttatggagtctggttttcaaaacctgctataagccaaatgtgtgactcacagagtaataaaggcctctaaatcaatttgtaagacatcttgaagttaaacaagaaggaaaggctgtttttgccccacatatttttttagatcctgcctacttccacaaaggatttgagatgacttccaaagcctttcttactcatgcctaagagtatttaagaactatttctgaaagttgaatccatgtgtaccatataaatagaggagaatgattatatggaaacacaaacagattggggctctctcactttatacaatagatcaactctggggaagtggttaaatgagggaagtatttggggcacttgctccagtcttcccttggttgtccttttacttccttctcccagcatctgcactctccaagtattgcctgcccttccaagcaaaacttccctgtcttgtattccatacctgcaaggaactttatttactttctaataaactctgctaataaatatgaaatagtgagtactagaggcttaatacatatgttagttgttctaatgttcaaaggaattcctacaatggtaggagagaaatttgaggccagaaataatgccattaagcatttatcccagctgggcatggtggctcacgcctgaactccaacactttgggaggccaaggtgggaggataatttgagaccaggagttcaagacaagcctgggcaacatagtgagacccctatctctaaaaaaaattgttttaaattagtcaggtgtggtgacatgtgcctgtagtcatagccacttgggaagctaagatgcaagaatcaggagtttgagtctgcagtgagctatggtcacaccactgcactccagcctgggcgatagagtgagacctcatctcttaaaacaaaacaaaaaagaagagagagagagagagagagagagagagagatccctcctatggatttaataatcatatcctgcattggggcaggggtgggttgaggtggaaaagggggtgtgaaagccatattatagagatgggcaccaagaccgagttttaaggaaagaaaaagaggccaagaaggatcactgaggaccccaaaggcaaacttggctgccttagaattttgctggggctgaggactctctggtttaaaaataaatatgaaagcaaagatattaaaggcaaagcacaaggatttacagagaaaatgagcagactgatttttagttgaaagatgtccacaatttatcactaagttattggtccaagctcatattccatcctatcactgttctcctgcacagtgacctccatactctaagcaaaccaaacttcctgagccgcacattgccaccccataccttggctcatactgttctctccagacacatttcctgctctacctctttgtccaaataggactgacttctcaagacttcattcctcctgatgttcaacagctgaagcagccataccttcctctgaacctccggaatgggttttctggacttctcttaggggacgctgttcatctggctttatcatgtatattcatgtccaagtcttctcttcccttcaaggctgcagacatcttggaaggagggcaagtcctctttatatctttactcctctcttcccatggactgagctggcccagaatcttgaaaaatagccaaccactgataaatgctttctagttaagagttcagactctggagtcaggaagttctggcagcaagcctcagcttgtgtttattacttcacctctctaagtcttggtttcctcatctgtaatcacctacttcggagttgtgttttttttttttttttagatagagtctcgctctgtcacccaggctggagtgcagtggcatgatctaggcttactgcaacctccgcctcctgggttcaagagattctcctgcctcagcctcccaagtagctgggattacaggtggccgccactgcgcccagctaatttttgtatttttagtagacacaaggtttcaccatattggccaggctggtctcgaactcctgacctcaggtgatccacctgcttcagcctctcaaaatactgggattacaggcgtgagccaccatgcccagcctggagttgtgatttttcaatgagataacccatgtagaatgcttagcatggtgcaagacacatggtatacattccacaattatttgttattgataccatttttcccttaaggaaaggtgcagtcttctctggctccctgtggcaataatccaactgagccattattccagaaggaaatcacattagggggcttttgggcaagggtttgctaaatgccctgactcacactatgtctacagtgacatttaccccatcaaaatgcagggaaagacaggaactggtttcaacttgaattcgatatttctgtggcccacatgctgaatgccaccaaagcctccactcccagagcagcagtttgtagagatggaatagtggcagtttttcattttccagagtccactcatccttccaagaatctcaatgcctcattgattcataatacagtgcataaagatttcatttttcctgcccacagtgatacattatggaggcaatctgttttgccactgaaaagtttgcttagtagaaaaatttggagttttgacattcaggaaattacagtcatctgtaaaacacgattgatatgccgaggctaacattttcattgcacttgcagagccagaataactatgataaaatatgtgttaccccacacacatttcaggatcttttagaaacattagctctgagaacctcctcccagggctccaggactagaatagctatccccattagttgtttgtttgccactcacaaggataatatctccattgacccaaccaagaatcagactgtaagacaaagtgatggctttcccgtaccaccaggttaaaggcatgaaagaaagtaaaaagatagagagataaagaattccaccccgttttggaattgttaaccagccacaaaaagcgcaggtataggttaggtagaactagaagctgaaggcttacaaaagagaaattagactgttctacatctgcctacaatttaaacttgttctctgtatttttacacccaaccttttttttttttttttttgtctctttccacatgcaattttcagtgttaaatgacatcaaaagcctagggctccggaactatccacttgttcaaaatttgatttcagaatgataaatacagttgttttagctgagagatgtagttgatttccactggcatactgagaaagtggtccattcagggtcagatttggccaggttgtgagcacttttcacttggtcctcatgcactgggacccacgggaagtgcacaaagtctgtggttccaaggcaaatgacaggtaccactgcttttgactttggaagtggcttagagtgaaccccattcagctctgggacagcttcttcaggcactgagaacacattctgcccaaagtgtgtaagtctgactcatgaatcaagcagtttttagaggtgtcattgaagtcctgcatgcaaccctatgcaaacaattattgccagtgcttactgaccttatattatgtgtcaaacacaattctaagtattaattcatttagttattacagccactctatgaggcaagtgatagaattatcatcttcactttatgaagaaactgaagcacagagtctgagcatctctcccaaagtcacactgctatctcataagaggtagagctggattcaaatcctcaacagaatggctgcagagctcatgctcatgatctatattatattgccttgcataaagaaattttataaaagccctctgttgtcagacatgctgcctggattatctcacaagtgccccatgcccatggtaggaaggctttcttgtcctcctaaaacacttggccaaacttcactctcctcctgtcccatggttaagcctcttgcatccaacaacttggcttcattcatttcctaccagtgtttgcacagatgctagaggagcaagaataaagccaatgggtatagggaggagaggagatggatgccaaagacacacttgggcaaagaccatgcctgcctaggagttttgggactctccagcaggggaataaggggaaaagtgatttcccagaggcatgttgaggattcacttgcttgtccccaggctgaagctttgggggtacccatattcagctttctctcctgctgctcacctctgggccttatttcagctgatctggccactgacaagggaaactaagagacagtggagcaaagaggactcatcagaatacaatgaggggacatagaggctggaggggtggagaagatagagggggagaaaggggagttatggcgtcaggacaggaaaaaaagatgaagagagaatggcaaaacaaccaggaggaggaggaagtcactgaaaaagaagaggggatgcacacagcatgaggtgggatgtggagaagactgagagaggaaggaaactgaggggaaaggctgatggagatgttctctctcctcacttctgtgatctcagtcctgtccatatgggcagtctgatatggtttggctgtgtccccactcaaatctcatcttgaattgtagctcccaaaatccccatacgtcgtgggagggacccagcagcaggtaattgaatcacaggggtgggttttccatgctgttcttgtgatagtgaataaatctcacaagatctgatggttttataaagggcagtccccctgcacacactgtcttgcctgctgccatggaaaacatgcctttgctcctcctttgccttccgccatgactgtgaggcctcctcagacatgtggaactgtgagtccattaaacctcttttctttataaattacccagtctcgggtatgtctttatcagcagcatgggaatggactaatacactctcctcaccaccagtagtcttccttgactgcctgctgggcaccactgaaaggctcttacgttgcacggtgttccaactagatggccttgctcttttccttctgtgagctccaggtacacttagagatgaggcctgtcttcttgtcctgaatttggacacatgacttttttttttttttttttttttaagagacagggtcttgctctgttattcagactagagtgcagagctgctatcatggctcactgcagcctcaacctcctgggctcaagtggtcctcccacttcagcgtcccaagtatcagggactacaggcacatgccaccacacctagcaggagggatatcttagaggtcatttagtccctcccccatgcaaatgaccaataagtcttcattgcttttgaccccgtactccttatctcctatcatcccctacgcacaggaggcagattcttaaaccaaaggaataaactttacattgtggattgctggccaactgtgttggggaggggctgtgcttcccagcactcctgaacttatgccaccccacaaggctggccctggttgcctgtcccattatggtgttgtagaaagctctccgctgtcatgcaaattaccttttaaaataaaatgaacaaagtggcatggggtagaaaaatgagtctggatatctagacttgggtttaaaacatatgtaacttgatgacttactggctgtgtgacctttcacctctctgtgcactaatatcagtgtctatgaaatggactggaactgtctatttctcagtcatggtgtaaggctctatgaagaagaagatgtgttttgttaaaaataaatatatatttgctataaagaactttttagaagtagaagagaaagagggtgctattcctttcaaaagatttggaataatagctctttaatccttgaaaatgaactgagaaatataaatacttatgattatttaaaaacctcaaaggtgacctgctcatcacctgaactgtgcttggtatgctgaaatgcagcaatgccagtctcccaaaaatgtacctgcccatatttcaactgtcagcacattctttccaccacgtagaaggtgaaggtcgacatgttctccctgcgtgcatttctagtaacaccttaactcatgaatgttaaatggaaggaggtgggataggggaacaacaggacttcaaaaatagccttggggaaatcaaatcttgctttaacttagtgtgttcatgaccgattcatggctctgaaaaggaaaaagtgtttgatcaaaactgtcaccaaaagacctcattttaaattcctctactttctttgagcagaaaggaataggtatcctgattatgactattgaagcaggctttacctgtgcataatagctggtctcctatattctgtgatttttggatggcctcctgccccatagaacttgccctactgctgcctgaaattctaccataagagggcatagcattgccccttaggggctgcccctttaaaatggaaatgcttctggtggtgctaagtacatgacactttgacaaaatgagtttttctaatgactttccttctaggtctcagattttgaacagactaagcccagagagagagtccagtgggggaaaggctggaagaagggggaggtgtaggaggaggaatggagaagcttggagggccgaggtctcccagctacaacaaaggaccaaagaaatagtaactaaggatgggatttcaggcctcagtggggtacatttggaggagaaggggcctcctttacccttacaagttgtattgtgggtgcagcagtctctcctgactggggaaatgccaacctggggacctgaggcactgcaccagccagaggtggagtcactttgggactcgtttcagggcctgtgtagtttaggggacaatgccctttgtttctgattggtgggaggaggaactgatgtgcagtgggatgggagaggataaaatggagcatcctgggtgatttcaaggcttcatgctagaaggctcatcaattaacccaccagtctgagttcccataaggtgctgggccctgtgttgagagacaggagagatatcaaatagtttggctcttaaggaatgtctagcctggtttgcaagacaaaataagagaaatggagtatgcagccatttatttgaggcttaatgtgcaacagagaaaacatgggggaaacactgaattgggagttaggaaacctgggttctggtcctagacccactgctgaccaactatatatccttgggaaagttgcctcctttgtttgaggttcagtttccttagctgcaaaatgggaattttatatcttgtcctgtatacttcataggattgagtgagaaactaactttataaaaacagtggaaaccttttcaaatttctcattgtgattaatcagccctccctccctcactcctatcttcccactttccctttttctgtccttccctccttccctccctcccccctttcttcctcccttccttccctctttctgtcctttctctctccctcgctccttcccatcttccttctttccttccttccttctctcaggcactgatatcaatgaattttcttcagatgacttttctgaaaaactattttgagaagggcaatgtcgtttagagtaattatctctggccttaaatccactttgcagtgagtcactatttctgagaattaagctcaattccagacaaaaaagcccaagccaggagggaaagctctgtaggtggctcacgcagcacgcaagcagatctctcttctcattgacatgtcctcacagtaaatgatgacttgaagaatctaagggaggttctgccctctagcatttgccttagttggaaagtcagggtcaggcatctgtcttaatgtgagcattgactttgagtccttttttatgggtttaaagtcttgcagtaaagaataagtgaacgtcaaccaaatagaggggttgcctttgcctaaagccgattcctgttcattggtcatcttaagggtgatattcaggaaagtgaacaaggagtcagagacttggttttgggtcccttctgtgccataaactggccaaatgaccctggatgagtccctatccttcacctctgggctttagcattctcattgctaaagtgattggagcaggtaacctctgagaggtctgccaaaccatctactctatgaaaaatatgagtttgtcactttcatctttcatttgtgagtggctctcattggttccattcacaggaaccttgcccttcatcggttggccagtttccacacatgggacatggctcttactcaacgagagagtaatccagagctcactgtatgcatggagggaggtgtggaacactctcaggctcccccttggttgaactgcccccaaccatgatgagtaaaatggcctcacccactttcagtgaagtaagatcccgttttgcacaagatgaggtttgtaaagtgcccctttaaaaaaaaaaagattctattctgtcaaaaattatggaatgttcatgctttcatcaaagtagagccatggcttatattttacaacacgcatagctgtctaatttcacatactgtttttctattctgtcacattttggacaaaaatgtcttttctctaggattcaggacattgcagtgtgatgtaaaattgcaatctggaggaatatactgtgcgtggagaagggatgatgagggcaactgccccgtgactccccaatactaggccactgatttcagggaaggtctcctttttgccttaaaggggaaacacagttgtccaaagtctctatgccatcaaaaagaaacctctgatgcacgaaacttatagaacgcttgtcagtttcagcattaacataaccttcaaaataattccttctgctcaatcaggatcttcatgtcttcagtcctccttcctgtacttgccccagtgtgacatcacattccttagctagagaggtgggatgggggatggatgagtttttttcaccacccagtattatcattgcaaagaaacaaggctgtgcctgttactgtatagaatgcttatttccccacacatgtagcccagccatgttattcagtaattatgccttttgcagcttgaatatctgaaggaaaaactttcccaggtgaaaggaggcatgaccctgccagcccttgaaattctgaatggcttcaattctttacagttcaaatggttaaaaagttctgttcccccacacccccccagaaaaagccagggtttgcacttcatatctctcagcaccttgaagcaatattagagctcattaaaatcaacccagggctcaagaagggaagccttcatttagggggaaaacttttcccctgtgctgctctggaaaatagcacaatgctgagagcaggcatttttcctgactaggtttcctctaacgatttctccaaagcacagttagggtacctgcctcccagacagcacatgtccagcaggcccaggtgaatgcgtgggactggctatcactagctcaaaattgccttaatatttattgacggcctaccatgtgaaaaaggcctcttacttgatttcttgtctctgtggaggtccctaaagaaatgattctgtgtgtctctggatttctcacaatctagagacatggaaagggagctggctatctggttcgggatccgtagaatacgaagtatggtctaaaatggtgtccagctatacccctgcccccaggcccctcagctctaaaatgctcagatcccagccctgcggttctgtaaggggcccacaaaaaccacagaattggatccctcatttcacatcccagcatatccaactgcctcctactcaaatgtcctgctgcattcaggccagttgtgctcctggcctgtgactcctgaggctgtgctcaggcacaaatgagaatgaacagcccagtgggtgagagcacacacattggaggctcagacacatctgtcagtgaggacacaaagaccaaatataaagaccagattttatcttcataaagactctatggttttcatgcattgtaaatgagaaaagtagaagcacagagaggttatttgcccaagatgacacagctagtaactgccagaactggaatttgaacacaggcagtctggctgtagatcagcattgtcaaatagaaatacaatgcaatggatgcacctggaggcgataaacgtaagcgaattaatgcaggaacagaaaaccaaatattgctgggtgtggtggctcatgcctgtaatcccaacactttgggaggtcgaggcgggcagatcacttgagatggtcaggagtttgagaccagcctggccaacatggtgaaacctcatctccactaaaaatacaaaaatcagctgggcattgtggtgcatgcctgtaatcccagctactcgggaggctaaggcaggagaatcacttaaacctgggaggtggaagttgcagtgagctgagatcgcaccacttcactccagcctaggagacagagcgagactgcatctccaaaaacaaacaaacaaaaacaaaaatccaagtatttcatgttctcgcttataagtgggagctaaacattgagcacacatgaacacaaacagggaaacaatagacaccatggactacttggttgggtgaggaaggggttgtgggttgaaaaactaccaattgggaactgtgctcaccacctgagtgatgggatccataccctaaacctcagcatcgtgcaatatatccatataacaagcctgcacatgtacccctgtatttgaaataaaagttgaaattcaaaaaaagaaatgtgatgcaagtcacctatgtaattttaaattttatagtatccacattaaaaatggggatacagatgaaattaattttaataatacattttatttaacccaatatatccacattattatttcaacatataatcagtataaataataattaattcatgagatattttctctacctctaagtcttggaaatcttagtatgcttgaaaacttaaatcacttcttagttcagactagccacatttcaagagctcagtagtcacatgttgctgatggctaccatattggacagtgcagctctagaacaagcccttttcatgatatacactgtgactaaaatgaaggcattaacacctatttgataggttttctgaaaaagcttctagcctagtgtctgacatactgtaggcacctgttaaatcaaaacatctattagtttcctgtgtgttttgctctttgctgatgtcagaatgccgtccacccaccccaccaccatacacgcacctagtcaaatcctttttgtccttcagaatccatcatattcctcctcttctatgaagccttccttgatgaccataatacagtcaactctcttctccccactcatttctcacttaatctctgtatgacacaattagcactgaaatatactgtgcctctatctgcccccgccccctccaattctaagcccgttgaaagctggcacccgtatacatgcaacttcctcaccatgcctacagctctaattatggcgacttctaggtcagagttgatacgttgttcatggattgattaaacttctgtcttgcaacccaaggccaagcccctcacctccagggctaaaagggcactatgtaccctctttgcacatgcctgtttctggattgagtttcatgaaagtaccagttttattactttttagttaagacctgaaacatgcagggttttatgtggatgtactaatcaatcaaaaggcaggaccaaagcaatggattcctgggacaagaggcactagggatgtttatctgaagagcaaaccatgatagtcccagtggggacacttagaaatttccccaacctcctcccatccactgtggcatggagcttatgattcttcccctctgtgcactcttgtttcagggttgggagaaggaagagaaccaacccctagctctggcagttccagatgccaatcctcaagggatggcaatttgacagaagatgtcacatagaaacactcagtaagctgagaagttccatatgtggagggaggagttcctagaaggaaagtcaggcaggaagcttgagtgtgttaatcagtggcagatctggtctccatgtgacttgggcagatcatatcccttcatgggaccccagtcccctaatctgcatgctgtagggtattttcataaaagtttcttccacctcaagaatacactgactattaatgaaccaagactcacaaaataattttagaatgcaaaaaattgggagaaaggcagtgtaatctacaaaatttttcatgatgtcaagcaattggatggattctgggtaaaggcctgcaactatgggtcataaagtttggaatttcacatcttgttaaagaactcagctttttcactatttgcaaaagcccttagagttatgtactttgaaacctactgggctttgggaaaaaggagagtgatttcttttaaaaagaagtaaatatcaccaggactcattgtgtgaagaattccaccttgagtttgaattcaaaggcattagaaatcttctttattttcaacaaaggaaaaaaatttctgctttgttaaagaaaaagaatcgcatagaaaaacatccttctgtttaatgaaagcccatttgtgctcctttgagcactccccacaatacacacagatgggtttacttttagttaatcagaggaaaagaatcaatgaatgaaggtgttactttatatacacagaactggtcctttgggtgaggtatgaagaagagcagaaaactccttcaaggagaactaatagcatgtttggtgggtgcaagaccttcagcctcttcagatttggttttgtgtctggtagatcttttgtctaataagtcttgcttgtctcatggatcactgtgctcccaagagttcaccttgctccccacctcctgtgggtagcccagaaagtctggctaagtcagcagcccacagcatgaacttcaaggggaaaggaagaggttcagcatccagatcatttaggtctttctagtgttgtgaagacaattaaatgaagtcatgtgtcacactgctctatgtaacccactgtctgcaaatgcaacagctcactcttctcactaggtaaagcatgactactaagccataaaacttgtgacaaatgtgccaaaaacaacacatctacaggcacgtctgtctgcttcaaagtagtccccttgtgaagtcccacacttcttttatgagactgctgccactgctgataacagcatttattaaactcctgtttggggactactaatatgagctacacaagaaaagcacttaaaacagcacctccagggcttaaggggtccagctccatcagaagcatgtttgcctttgattcaatttaccatacttttatttagtttgtgctcacatattaatattgtttgatttgaacgccttcctccttgctttgacccagtcatttacatgcaatgggaggatccatgtggttgctttagacttcattagccaaggaaggagaccagaccttcaacattaatgactcagtgtcatatacaaccaccccaactattggcagagttacttaggaccaccaaccacagttctttttctaccactcattgtttctccaagaacaagatgtgcaaaggctgaacttttatatatatatataaaatattttatatatattatatataaaatattatatataatatatatataaaatattatatataatattatatataaaatattatatatatattatatataatatattatatatatattatatataaaatattatatataatattatatatataaaataatatataatattatatatataaaatattatatatataaatatataatattttatatatatattttttatatatatatagcacatatatatgctacaggtataatagaatgttcactcctattgatttgggataagaatttgtttcctttcttaaattaactttttattgatcactcctatgaccttaactgctacgggttttctggccttcttctattaaaaaatgtctttgatatttatttcccctttgagtagtgcagggaaaaccttatcatggcctttcgtgaaccagtagcctcaaaggaaagtaaatgtttacagcatgatcctcagaactttgctcaagtaacattccctggactttcccttgatggaaatgggtgcccccagggtttctccaaggggtagagagaagatagggcttgcatccgggggcacagttggcttgtctacactctagataccacctgggatttctgagagacttctgatctctgaagccacatgcctaggacagtgattctcaaactcaactgtgtgtatatcagaatttctggatgggcttcccaaaatgcagattggcaagccccagcctctgagtttcagattcagtgagtggacctgagagtgtgcatttctaacaagttcctaaatgatgctgatgctgatggttctgggctcacactttaggaaccacttttttagttaactcatagaattagaagtcctgggcttgtgccctagcaccaggatggaaagaataccatttctagagtgagagagacctggattgaagcctgaacacacctacttaacttgaggcgtgacccagagtcacatcatctctgagtctcagtttcttcattctggaaaagggaataataatatatgattcacaggattgttgggagttaacgtataagtgtcaggcacagagcacccccagttcctggctatgtagttggtgtaagaaagtgtcctctttgagcagccaaatgtttacccttcatgggggttagtgagttctttcaggcctggttgagtgtgccatcctaggtaactagcagacacaaagagggtctgctaaaataacaggacttcggcccagaaatagttctctcaggtagattgattctcaagggctactggcaaggtgtgatttggggacaagtccttgcctgtctctctctgggcctcagtatccccacctttaaagtgaagggtttgacctaaatgatttactgtctcaaaggtttcctcctgttctgacgagtgtaggactctgtgacttagaacttgggcacttatttcagaatggtctattaaaaggagaataaaaaataagattcttgtttttaaccatttagttatttttaacgtccttaaactttccagccttcttttaaactgggatactgcacaaaaagtcagggacaacagctaaatataacaatgtccttcacagctacatctccttaaaatgctccattacaggtataaaatggtatatctgttatttcatagtgacatctagtggcttttccttatcaaagaataagatacgcattttcctatttgctcatcataagctctgctgcttctcctgcagaaattcattcaacaatcttttattaattgcttactttatgtcaaacattgtgctaggccctgaggatagatacatggttcttaccctcccagagctcatagtccagcggaagaggcagaaaaatcgcttgacaatcccagcacattgtgatacatgttacaatgggagaacaccagggcgtctggagcagagaagggggtgcttaactccatccagggaggtcaaggaaggtttcgcggaggagacagtctttgagttgagttttgaaagactttgccaggtaacctacaaaggataaatagaagccattcaaaagagtgggcactccatatacagaggcaaagcacctgtggagtcactgcctgggactttgatttggaaaattcagcatatagggtatagagcaaggttcctcaaccttggcattattggcatctgaggcagggtatttctttgttgtagggggactgtgcatgataggatatttagcaacatccctggacttgacttactagatgccagtaccaaccccctccccaagtcattacaaccaaaatatccccagatattgccaagtggcccagagttgggggtttggggagtggagatggaagatcactcacaattgagaaagacttgtatagagggagctcacttgagaaggctggacagaaagaaaggtggttgctggattccacaaggctgtctgtagcatgtggaggagcttggcttcatgtcatagttgatagggagccattgggagggcttaattagggaatgacaggtcaggtatgtgccatctgggggtgtggaagtggcatgggactggagacctgaagagtaggacgggatgctactgcaatgttttagtagagaagtgatgaaggcctgaccccaggcagtggtgcaaaggatggatttcagagctattagaaactggaaaggacttaagcgaatgtttagctcttagtagtgaggggagattagaggagtcaaggatggccctttggtttcttgcttggacaactctttcatttgttgctattatttcgacaattgcttatcagtgacaggaaaaagttggcctaaacttgtagacacaaagcaggttcactgtgcattgtttataaacttctatgggtttggtgagacagaacacactcataagcaacaagttacatgaagtgggtttattacttacagataggcagcaagggacaaaagaagcctaggatccactgtgagatggtttcccaagactcaagaaagctgcctgggtgaatgagtctcgattaagcatgcctcacttgcaccatagctgagagaccccaaaaggcagcctttcctgagttatatacctcaggggccatgtgactcatttagcaaagctttgaaggacatcctgcttctgagagaaaggaacaaaggctgggctgtcccaggcagttcctccctatctcaagatgttagattctccaggaaggactggaacaaggcttttgctgtttcaggcagttcctccctatctcaggatactgcactcccagcacattctacagttattcttaagaatgacaagcaagaatgaggggagtattgtgttggtccaaggccacccagagaactgtcattcagtagaaggtggtaaacctttaactgtgtagtgcctgtaaagtcaccatgggcatacagaagcaccaatcagccattcaattaacccatgtaacccaatggggagtcatggctccaatttaaaaatgtgacaccttgtcattttaattaggtgatacatttggtcacaagaaagtcctgtccaattactactaagtgaaacaggtggcgtatgattttcctggggctgaactggcctcattcagttaaaattcagtcagtccattcagcggcacccttcagtttcatgtcaacctgaagaaagatttccagcaactatcagagacttgctctcacctgcatcttgctctgttttgatcaatgcctgaatccaggcattgccaacaggaacaggaaagtatggtgaagatattgggggatataatcagaatgtagatgtcttttgacaggcttagatttcctccatcaagaagagattaaacagggccacaaatacactgcatcagttcctgacaatatagattgcgttccagcgtggcatatatgtgaaagtatgaaacaattgagcttactgtgtatcagtggtgtggtgtggccgccaaaatggtccatgtgatctgaggccacattaagagaaatggtgtcaagaatgaggaaggtgataggctgtcccttcttgttgcttgtcagatcgtgcttagcaggccatgttccaataaagtggaatgcacttgcaggcagacaacaggatagcggggccttgaagctatatagagaatagttgaaaaccatttttagcataaagaagagaagccctggggtaaatgctgtcttcgaatatctgaagccacacaagtggaattttaaaaaggtccctaaatagaccatgatggtctggaaattaccactttgtgctgaccactccgtaccttatcttcagcccaggttgctctctgagtgccagatctgttcattcaactctactcagatgtcccgcaggcacctcagtccttcctccagagctctaggaggcatccttaagtcctcctcctctttctcccccgaatcccttttgtcacttttacccgctaaatatttctctagtctgctcctccttctcttttgccttgtcttctgcagtggcctcttaactaacttcacgaatttcatcttcatatacataatgatctttctaaaacacagacctcatcatgtcattcccctgcttaaagcccttcaaagcctctctgttgcctgcagaattaactttgaatgctttaatatggcatctgtggcctttcacaaccaggtcctgggctccctctccatcttcaattcctgccactactccttcactccccgggaggttttttgatgcacgtttctcttgcacaataggctggtttatgcctctgtgcctctgctcatgctgatccttctgtctcatactcctttcctctctccttgactcatttttttttttttttttttgagatggagtctcacactctgtcacccaggctggagtgcagtggtgataccatggtgcactgcagcttctacctcctaggctcaagtgatcctctcgcctcagcctccctagtagctgagactacaggtgtgcaccaccacgcccactaatttttctattttttgcagagacagggtttcaccatgttgttcaggctggtcttgaactattgggttcaagtgatctgcccaccttggcctcccaaagtgctggaattacaggtgtgagccaccgtgcccagttgcctcatctaattcttgtttttcaaaataaagctgcagaaacccttgtcttatctttaggctaggttagaaatcagtgtgaggtgtttttttttaatcataccctgcacttgctccaagcattcatggcacacacaattgaaacactttccccgggtttccatgtcttatccctgtctgtatccccagtgcctgccatagtgccaggcacacattaggtgccaagactaagcaagtcttgacctgacctgaccactgagggaaaactggccatgtctctgtttgcccccgaccccagctgcattccccagcgtgcttctctgatattgccctaaaagctcttccttggatataatgagcatcctggattctttttctgacataacctccaaggtgttatctttacctgccttcctacttccaacacaccatgaaattcaggagacccctggaccctggacacctacccttcagcagatctttctttctttctacacatggaatatttctaagcagcatcaagtgctttcagttgaggcattctgggtccccaaggctatttgccctggaagaagggggctgttgacactcactgaatctctgcaggttttgtcatatgagtctaggtggctgttatcaccaaggcagcagtgtgtgtatgtgtgtgcccctctaacttctctgctgcagtgaaaatccctacagtgtagacactgaggctgcctacgttgggctgtccgtatttcttaagggcactaggtgaccttcaagttgaatgcatactggatccacacacccacaacatgagagaccctctctgaaagtctgtctctgtgttgccttctctctatccatgttggggtaggggtggtgcttatgaaacattgattgtgtcattaaccctggtggttgggatgtatttgctctgaaaggctaggaacaatgtttaggaaggagagctgcagacttccactgtggtgcactcttaatatttaccagaagatgtcactgtaggcttaaaccaatacaagaagttagggcaagaagacttccagctaagcatgaaggtgactccattttggggggttagaacaccgagcagcccccattacaatgcatgcctggaaaagctggttgaaaggttaatccaaatgtgtcacagaccttaataaatttctttttttttttttccaaataatcagactaattgccactaaactgttgcctcagggctagcataaaggctcaataagtatgcactgaatggatgagtactaaagctaggagtggaaggagggaacccagggctttagtagtcatctttgttggtaaaggctactggagaacaaaagctgctactctttagcagtggcttctcatagagatgaattttagtggcaccaacaagatcaggtcctagggaaagtagtgagacaagtgaaagtgctcttggccccttttccatcctcactcccagatgcttctcctgtgcccaatgcttgtttcttcctgaaaaaatatataaagtgatttattttaagaaaaaccttcctgtgattttttgcaaggcacttagaagattatccagagtttttatgtcatgaggcatgtccctagctctctccttcctcttccccaggatagttcatcaagtaagcagttaaagaagttactgagattctgctttatgccagggatgaaggccaatgtacaaagctggaatggatgggatgagggctatatagaagaataggacagagcccctgtccttgaaaacatagtttaagtggaaatataaacaattaattgtaattcagtatcacacatttttgggggaggcagtggggtggaggggtagggtctcactctattgctcaggctgaaatgcagtggcacaaccacagctcactgcaacctccgtctcctgggttcaagtgattctcgtgcctcagcctcctgagtagctaggattacgggagcgcacaaccacacctggctaatttttgtatttttaacagatggggtttcaccgtgttgtccaggctggtctcaaactccttacctcaagcaacccacccacctcagcctcccaaactgctgggattacaggcatgagccaccgtgcccagccccagtatcacaaatattttaacaaaggctaagtatagaagtgctatggcaacacagaggaagaaatgataactggcaacacagagtggggtacattttttcacaaaagagatggtacttgaactggtattgaaggatgagtagaattttccagccaaagagggaagatcatggcaggcagagcaagcaccatgtacaggatagaggcataggagatagatttcaggatgcctgaggtgatggaagccccagttgggagaaacgtttcctcaatgaacatcagccaatattcagttaagcaggtggctgagcaggttccctgtggctcctcatgtatgtgtagagaacaaccactccctcagatgggaatgaatatttcagaaaagttgcaagccattctccgggtttcctttaagaagctaaatgctaatattcaatgtttattgttgctttctttccacaatatgcccttctgtggcctcgtccttcatcttctgtacctgagtggtaacccatttctcatgaaaagcacaatgacacggttctctccttaagtatgcctgattgtatcatggacttgatgtttctggggcgtgtgcctaccatgtatggtgtgagtgtgttaacatgtggtttaaatgtttgctagtctgctatttgagcaaagaactttgtttgaagccctaaagagaagacagccatacagcaaagcctccacacttgctgacatccacgtgcccttttagtagataaggaaaagggacattttgaagctgctgatagagttaagtttcctatcctgggaatattatcataggagcaaaggtggaaaccaaggtagtagcttgcatacatgccattggcagctaccatgtctatttcagtcagtgactaaccacagcgtttattgctggaggccctgggctactctgcctatctctacattccacttccataatgtatgagccataatatgacaacagccagaatcaagagtatcatatcatacactcttttaatgagttttttaaaaacaaaaagatatgcagattagactggatattagaaaaaatgctattgcatatttaataagattcgaatttgaacccacttgtcaactccatttcactccaataaagtatgtgcttccaatgagtctccatttcatgatcactaaatggtttagagtggggggcatgaaataaagtggttgcctagttagccaatggtgtcattgggaagattttgtctttggttagagagggagaaaaagaggggaagggggaacgaacgggagtgaagcatgacaaggtcaatgtctggaatctaaccttttcatacctgttttagctgaagtatcagcaaattggttgaaaaaattagctatctctaggctagtgagactcagagaggggactgcagtacagtttacaggacaaatgccatcagatccctgtcatttttgctttgccttcctttttagccagtgaacaccacatatgccatgtacctccatgactccacttatttcgcccatatctctgactgttggtttttgtgcttcatccataggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctg

SEQ ID NO: 5044 - DNA, 333425 bp, human
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccaggtactgaatcccaaatatatgcatacacagcaactccagttggtgttagaattaaggagatggaaaaccgaacacttgacagttcggccagttctcttcccttttttttttttttgcctcctacccccagtctttccccaaaaggccaaaatctagagcatttgagcctttgtcattcactgcctgagaggaactggctcctgggagcagagaccagccgagattacaagaagcctcttcaacatgcagccaaggcccagccttggcctcgggagaacatggctcttgggacacacgtaggaaaaattccctgcttctcagcaaaaagcctcttcaatcctggagggatcttctgaggtttgtgggactccctgctccccacaaagactgttttcttatacttccaggagccctgatatatgaattcctgtatgagagattcatttctttgttcctcacagcatgagggggtggaggaagggcttctaaatgcaaaaatcctagtgacatattatatctcagaaactgaactttacagccccaccttgtccctcttgctctgcaactaccaacctcactggccctttctctgaaggttggactgtgagtgtgtgtgcaggtgtgtggacaccttccttttcacaactcaaatgagtaaaacctgacttttccccccgtactgtttaccacctcccccttccctccacccaaggcactttcttgtgttccaatgccactaatccctcttacagtagaaactccgtagtttagctgctgagggcttgaatttgtgacccacctgtttcagaaatattttcctagggacccaatgaatgccattacatacaaaggtggtgtaatggcagggaatctttatgcgacaccatgaggagagccacctattgggtaggctaaagaggttgactgcagtgagtggccaagcagaaggcaggggcagctggcaagcagagctccggggccacccccatagcttcccactaccctggctcacaccctaagctgccctcagggggagcaggcctaggactaccagcctgggcaccaggggagctcttggggaagctgagaggtcaaccttgtaagttactgcatctggcttcttcgcacaagttcattgggttttcagagtgttcctggaacctcaggacaggagatgcctggagtgctagaaattcaggattcccaaaaaatccactatcccttatgtctgcagctggacaaagggtccctcacggtccccagtaggtttgggggcacgtagaagtctagccagggctgggaattctagggggtggtaaagacagggtgcacagccacagaattgcctgagaacggcctgttccttatttggcctgtgacgcagttggcacattgagcttagagcaacaggtaaacacagcctcacatttggagtggcctaaaggtttctacatttcatccccacggtgactcagttggtcaaaacaggggacataattggtcctatcttacagacaagaaaactgaggctcaggaggggcaagtgattatcccagtgctgcccagggacagatttcccaggacttctggactattcttaggcttgccgcttcatggcatagatagaacaggaaacggatggagcagagctcagcaagggagatactgggagagcctgtctccaggagggacatgcccccaccccaggactcagctcgtggtctgcattctcccactcagtggccccagtgccaacagcactgctcagaaacactgctgccaaccggtgccccttctgtagcagtgggactggagggagttgcacactcagtcacggaaacaccagtgtcctgatgtacagcaagcccctttgatcaatcagatggggacagactgactcctgagttcccagggtccttttcctgaaggaacatccattctttccctgttaaaccctgcattcctggtccagcagcagaaaagagcctttcggacactggagcttgaggaagatctgtgcctatttattagagaaggtggtgttagtatcaggaaataggtggatggtgctgggtttcttgggttcaaaccctggggctctgctgtgtgaccttgggcacatccctacccctctctgggcctcagtttcctcatgtgtcacattaccttggattagacggtctcactctgatggagtttttagttatgtatccattcattcaacaaaccttttatgagtcaagccctcctgcaggcacagggtttggtacacaggattcagcaagaagacagtctgtgctctaaaaaaggtcagattctcattctgtaatgctttttggtcctgctgtctttttatcatgctgacttaccttttcagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccaggtacgttctaggtgaaagcggggttcgcgctcccaggccagggcgcgaaggtgctgtacggggagggaaggcagccgcggggggtagagaagggcgtaaagttccagctggccattggtggcccggctagggtctccggaggggtgcggcgcgcatttgcccacgccgcggctccgtcgctactgttccgcgggcaccggcagcgcagcgtctccgatagcaagtcgggctgccggccggctcattcccccagggtaactctgagcccccggctccgagctccctcgaggccgcctaccgggtgggcaagcgggcgcgggcgccggcaaaaggagggcttcggggcatgcggggagaaacccggacagaggtgtgcgctccaaagaggataggggcagaagagcccggagagtccggcggacgaagcgggatggggatgggagcgggagccaccgagagtggagcgagacacgcgggggcccggactgggggcgtgagttgaggagtggggcgactgggcccggaggggtcccactggggctaaaccccgtggaggggctccggggagctccggagagctctggcggggggagggggcgaacggcccgcgggaaggagtcggggtgggggtgtgtgtgtgccgcagaagccacagcgctgagcctgccgggaaggaaggaagcggggaagggagccgccgccgcagccgccgccgccgtggagtactcggtgcggaggggagggggagaggggcgcagcagcggctccaggggaagggggcggtgcgggggcacgacgagcgcgggctgagctgcgggattgacgtaacgagcttgggtttcccccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcgggacccgggcctaggcgggcggagggctgggaggcgcggctggcccaagccggggacctagcgcgcaccctgacgcccgggcgtttgcaccccggctgggcaggtgctgggcgcccagtagcgcacgttcgccgcgctgtggcggccacagaaaggctttccgctccggccccggactgaccgtctgtctgtccgcagggtggcctgcgtgatggttggcagagcgtgcgggggaggcggccgagcggccggaacggggccgctgggacggggcatcgtactcagtctccgcactggagagccctaaagagccgcgctctccgtgcagcgtctctggatccctgctttcttctactctgcacccgggttccgaagtctcctttcagcgctctcttcctcctttcggcgcccgcattcttccctccccccgctttcccccctatttcgtctatttgccttgttctccctctttctctcttgtgtcctagatgttgtctgctcctgtttgctcgctgtttccttctttccattcccctctctcgcttttattctttttctctcttaccctttctgtttttctcttcttgccggacttttatcacctcgctccttccccgctctggctctggtcttcccgggcgactgggtgtccctctgtcgctattttccgacatccaaggagagctcatggttcccaggcttgcttatcactactggctgcatgagaggcatccgtggctctttgggagtggcggggggcaccccgcggaccgaagggcgggctgggatggtgccctggaccccatgtggggttcagtcaccaggagcctctcctgatttacaaaaaatatttaaaaagcttgagccccagcatggggcgctgccagcccatgttctgtgagcctgggctgatgcggtaaaagctgatttattaatagtctgtagccagaagcaagggtattttcctccctccagacgcgatgtccagttgctagaggtcatgcagtactgtaaagtgggtggtggtggggtgggggaagtgagtgctatggggtgcagttagtccagccagggctactgtttcgcaagtctccttaaaacaaatctgggctgaagcagggagtccagggggtgcacaaggtgagtttcatggcctggaggcctctggatggggtctctgggccggcaaggacatgtctgtgtcccatccccatcccccgggtgcacttggtaccctggacaaggggatgctttgcaggtgactgttagaacgcaacaaccagtgtggatttttctgtccaactgcagcaaatagagccctagagccctctgactttcagattaccattgagatttaaggggaacatcaccccctggctctcctcttcactctctcttctctcagtttacactgtcctttctcaaatgctggaattgtgtcagaatctgccaaacttgtatttcctttccaatactaacaaattttttcttccaccccaagaaaaccttagccccaggacctcaatccattggtacaattgtgtaagtcattgtcacaacaatattctggtgtttaataagttcccaaacaatttggcaatattgaaaagaatttctcatactgacagaccttgtaggtgtattgagaggtggtaatatttaaaaagctcttctgggcaaaagtagaattccacagccatgactatagcagagaagtgaaaacaaggtcttggtcaccatgaaagccatggccttgtctggagttccatggggcacatgtgcctttactgatccttttgaacatgtaggtcagagtatgatgtctataaacacacattattaatgtggtctagattatctgtttggtggctactgtcctctggcagattccttcccgcattctccagaagataaccagaacccctcaaagcctcttggattgtcccaaattgaagcaaaattatttgaaatgacataggattttcttggttattaaaagggtgatactacagtagcatctagtctaatcaaagagcaaccatgttctaaaaagtcacagttactggattttacggtgtttgcaaaaatgaaataaaacttgctagagaaatgcattgctacctcaagggcacctttttatttcattcattcctgcccacctccagaaatattcactttgaagaatagggatagcctaggggttccagaatttctctggatgttgacagatcccctaggaggttgcaggaccagttctgtgagttctgataatctgtaagagctaaggtgtgcatgtgtgtgtgagaatgagagagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctttaaaaaaaatcagaaattggatttcatccatctgtctgccagtatgttgtttgcagtcactcagggtcctgctcattttagaatttctgagaccatttttgaaagtgtatccaaacattgttgctcacaagctgttaaaagtcccaaattctgcaggcttttcttaggccaaatttcctctgtttgtagccaactctagtgtgccatttgttctgtagagggaattcagaactgggcccaaagaaatagcactagcccccttcttcatcactaagtatcatgctggccagcatgcacagaatggggttgagaggtcagggtccatggctatacaagtcaaagaatctgatcatattcatgttgtaccctagacttttagcatctctaaaattttcagtttggatgagtgattgggccgggggtaccacacccattgggagaagaacagatttctacatccctgaggtgttttattcaccaggggtaggtcttgtggctagattgcagaggggcctttcattgccatattgggaatccctgcaaagctgagcaggatgggagcaggctgaggcatctggaagagtaattaattatcatctcaaatccagtagcatatcattgatgggaaaggactaaaaagtgtttgtttagatggagaaaagctttttttggtcattctatttttttttaattgtgggaaaagctttcttttattcccatttgtttttaaaaggtggctctattttgaaagagctgtaactatagagtgtgtgtacctgatcatgcctcacaagcccacgctttccctctttcttctccttgattttgcagtgaggcaaaatgacacaacaggcttgtgatataggctgaggcattaagcagaatggactgttacagccagtggtcagtactggtcgtgtggttcatcaggctctaagctgttgggctcagttttacttagctgaggatacatttcttcagctgtctttgagagctgtggtaccatcttagctatttcatagaagagggggagaaatctaccattacaatatctgtagaattccagtagtattaattagcatctttgcatggatgtcgaacatggtgttggagtccttacaaagctgtaagttctcaggtagtacaaaaggctattcagaattaacatcacttaataataattttagatcagtgctatggggcaattaaaatgctagagcttgtctttcatggatatcagtcatcaactgaggtagtatgtaatgacattaaaagaatagccatccgtttttttctgtcattcattaagcaagattttgtgaaactgttcattatattccagggaagagacatcattctctgtctcacagagcttatggtagaacagaacaatttagtactttagatatttaattaaaaaatggattttgtttgaaaacaatttgaaaatcaataatgtctttaaaatgtcatacatttaccagaatatacaaaaaatagacaaaagtccatctgttatgttgtagtttgggtctaatcggcaaagcagatggagtaactattatgtctctggcatggtgctagcagttgtggggagattagagccaagaagaaaccaaaaaagccaagataaccatcttcagcctcaagtccataaagattagcatgtgaagtgcaggactatgtcatgtagacaggtgctgggagaggaaatttagattttggacaggcccttttccttcccttggtctcagtgtcttatctataaaattggagatttaaatgacatgctttccagggccctttcctttctaaagtatgaggaacaggccagaaaaaggagacatccttttgagaaggcctctgggagtaggagagttgtattaagaagaaaggaggcattgtgggtgggcacggagtcctcatgaccttttgaggtccagcaacctcacctaggcaggtctggccagacccgaaaggttcatgcttggagtaataatggttagggaagtagatggggttaggctccactgtggaggacttgaatggcaatgaggaaccccagtaagtatgagaagctcttggatggaaagagtgcaaaaacaccatgaaagtaaataaaggtcggagtctaggtaaagctatctccctgatatctagtctggaatgtaggtggtaccagccaccaaaacagagaggttgagaaggggatctggttcgggctggagagtactaagaagtcatgactggttcctgttgcctagatttctagtggacaggacttataaggaggtgacaactggggctctggggcaggttagggctccatcgtacattatatgtgggaatctgtggacccagttaatctgaattcacaattggcgttgttatttaagtgatagctgcaattcacatatgggactcttagccaaggaaaaggatgtttgaataaaggaaaaaagatcaatagttatgattacataagaataagatatgcttatctgtcaaaaaaaagccaaaacgaaaaggtttcaaactggtaataatatgcacaattacaacagacacaaagttgaaatctttactgtacaaagaactctcacgagctgattagagaatcaaaggacatgaccagacaatttacaacataggacccccaactagtttgcagacatggaaaaactgttttatttcactggtactaaagaaatgcacatttaaacatagaatactttttttgcctctctaaccctgattaaaacaaacaaacaaacaaagcaaaacccaacatatatcaccaccaaacaaaaaaagtagacagtgctgacaagggcatggtaaatatcaaaattctcatacattgtcagtgggaatgtaacttgaatgatctttttggaaataaatagtgtaaacacagaatataaaaatatttatttctatgacccataatttcttttctgggattttgcagaaaaacatacttttatacatgctttcattcattcactcatttatttattgattcagcaaatatttattgagtatctggtatccctgtgctatgtgctggggttaccgggaagaaccaggtagatgtggtccctgccttcgtaggagtgggaaagatagacagaaaacaaattatcaattacttaaaattatatgaagtgccatgggggaaaagtacaggatgctatgagaacacatactaggagactaactggagttatcataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagagaaaaagagatagaaaattatggacccagtacgactacaattatattaaagaaaaaaagatagcgagcgagcgagcgagagaaatcatctcctacccctcccaaatctaagcataaaagacagagactggaagaaaaaaataatagaatataaatagatctattagtgatttattttcttattctgcttttctgaaggttttgagttttctttgagtctacattacttatataataacaataagcattaacaatttttaaaataatgttttactaagctgtgattaattgcacacaggtctacttttttggttcctggctggttatttcattagcctcttgatatcctgggagcctttaatgaggagagtagcctcagccctaataaaccctcaccctgaaaggcagaggtgatgagtcagacattggctgctgattttcgataactgacttttatcatattcccacacaatgcatggaactctttttataccagtatggtatagagctacttgagtgaattgctattgtttctttctcatttataaattataaattttaatttataaattatatggaacaggaagttaatagtggtacacagttggaaatataaagcttattctgctcagccagagccatccgagatagtctggactttggatctccatgagcttctttcttagtgagttgacaccagggctgatggtctggctggaagagttaaaatcttggggttggtaaagggctatagttctaaacatccataactgggagcttagatcagttagtgtatgtgttgctctcgtccagcagaaaaggagagttcactttgctaagcagcgccccctagagaagtttcactgcataagagtattacccccagttaaccataaataaagttgattagaaatgtcattgtccaactattccaatatctgagggaccactctatgcacatatagtgaggtgcataatcttattgttgaaactccactgaaactacaccgtaggtacaagttgttttgacagtgtaaagaatgtccctcacagttgaaaagctaatattaacattctgtgacacatgaaatgaggtatttagtcactgagtttaaaaagagatgtatggatgggaatttccccctttccattaaaggataatgaataatccacttaatggcgtatgtcctctaaaacagtgtccttgtaagcttagataaatatttgtctaaactttagtaaaatatttattggcaaaagagcttttctcatttactaggtattgaactttgcagattattcagttggtcttattgcatcccatttgttatttctgccattttgcctctaaaaactgtgctgaagactttgacacatttcagagcattacactaaataaatctgtcttgcacattccactgtgctttttctggaatattataaatattcaaatataggcacacacgccgattcaaaatacaatttaatacatgcaaattgtgcataaattccatatttataacttggcaatagtttcgaacttgttatcctatgatataaatgtatcaaataggagctcatgggaattatcaataaatgtatttttctgattaaactgtgggctctttttcagtcacaatttaagcttcaattctgagttatattataagagaataatttgcacttcatttactctgaattgtcaagaatcttgttcttccccaatgtaagtgtctgcaaagaggacttcttattcagtttgattgctttttaaattttactagtggagatgccctagtgagtctgagagaattggtctgtttcttatgaagagtttagttctaatgagttgcttccatgcactgttctgtgcgaatacagagcaattgaaatgtgcggtgtattgatttacctcaaatggattaggcctgtgtgcaccattccttgcattaattgactttctcccataactgtactaataactgcaaatcttcagtatagtattagcttcaatttactcataaagatccttgggtttttgctaacttactacaggagagtcaatgcaagcaagagtatttagaaattgactagggggaccaagttacatcatacaacccagaaatacttttaaagggctctttgatcatggcagccaactcttcagttattacaataaataggagttgactaaactcaccagttaagacctagattatcacaatggatgaaaataaaaaatccagctatatgctgtgtataagagacaaaggtaaaacataagaacataaagcacacaaaaaggattggaataggtacactatgcaaacactagccagaagtaaactgatgtggctatgttgatatcagacaaaacagactttaaggtagaaccattattgggcataaacagatcactgtgtaatgattaacagttcagtttttttttcagataacaattctaaacttgcatatgcttaataccataagtttgaaacgtataaagcaaaagttggcagagctaaaagcagaaattataaaatctgattttttttcagaaattgataggtaaaatgaacaaaaaatgaataaggatacagaggatttgaacaacatgattaacaaactcaatataatgggtatatatatatacacacacacatatacatatacatctaaaatacacacatacacacacatacacgcacacacacacacatatatatatataaaatctgcacccaattggaagaatacacacacaagtgcatatgaaacacttttgaaaatagaccatatactgagccctaaaattactcttgaaaaacttcagtgaatgaattatcttgtagaccatactatctgatcatatgcagtgcttagacattgggtgttgtgttaaacctgagtgcgtgtgaaggaacgttagtagtttgctatatttgtaagtattaccaatccttcaccgaccacataacatttcttaattgacatacaaaagtgaagaactccaagacttaggtagtttgacccaggtaacttggccttattttccaagaagatctattactattttggggtacctattgagacaggtcctgtgcaaggagcatattatatattttctcatttaattctcacgacaaccctctgaggtagattttttaatatatactttaagttctagggtacatgtgcacaacgtgcaggtttattacatatgtatacatgtgccatgttggtgtgctgcacccattaactcatcatttacattaggtacatctcctaatgctatccctcccgcctcccctcaccccatgacaggccccagtgtgtgatgttccccaccctgtgtccaagtgttgtcattgttcaattcccacctatgaatgagaacatgcggtgtttggttttctgtccttgggatagtttgctgagaatgatggtttccagcttcatccatgttcctacaaaggacatgaactcatcctttttatggctgcatagtattccatggcatatatgtgccaaattttcttagtccagtctatcaatgatggacatttgggttggttccaagactttgctattgtgaatagtgtcacaataaatgtgtgcatgtgtctttatagcagcatgatttataatcctttgggtatatacccagtaatgggatggctgggtcaaacggtatttctagttctagatccttgaggaatcaccacactgtcttccacaatggttgaactagtttacagacccaccaacagtgtaaaagtgttcctatttctccacatcctctccaacacctgttgtttcctgaaattttaatgatcgccattctaactggtgtgagatggtatctcattgtggttttgatttgcatttctctgaaggccagtgacgatgagcattttttcatttcttttttaattattacactttaagtgctagggtacatgtgcacaacgtgcaggtttgttacatatgtatacatgtgccatgttggtgtgctgcacccattaactcatcatttacattaggtatatctcctaatgctatccctcccccctccccccaccccacaacaatccccagtgtgtgatgccccccttcctgtgtccaagtgttcttgttgttcaattaccacctatgagtgatgtgatgtttggttttttgtccttgggatactttgctgagaatgatggtttccagcttcatccatgtccctgcaaaggacatgaactcatcattttttatggctgcatagtattccatggtgtatatgtgccacattttcttaatccagtctgtcatcattggacatttgggttggttccaggtctttgctattgtgactaatgccgcaataaatatatgtgtgcatgtgtctttatggcagcatgatttataatcctttgggtatatacccagtaatgggatggctgcgtcaaatggtatttctagttctagatccctgaggaatcgccacactgacttccacaatggttgaaccagtttacagtcccagcaacagtgtaaaagtgttcctgtttctccacatcctctccagcacctgttgtttcttgactttttaatgatcgccattctaactggtgtgagatggtatctcattgtggttttgatttgcatttctctgatggccagtgatgatgagcattttttcatgtgtcttttggctgcataaatgtcttcttttaagaagtgcctgttcatatcctttgcccacttgttgatgggtttgtttgtttttttcttgtaaatctgtttgagttctttgtagattctggatattagccctttgtcagatggctagattgcaaaaattttcccccattctgtaggttgcctgttcactctgatggtagtttcttttgctgtgcagacgctcttgagtttaattagatatcatttgtgaattttggcttttgttgtcattgcttttggtgttttagacatgaagtccttgcccatgcctatgtcctgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggcagcagtaccatgctgttttggttactgtagccttgtagtatagtttgaagtcaggtagcgtgatgcctccagctttgttcttttggcttaggattgacttggcaatgtgagctcttttttggttccatatgaactttaaagtagttttttccaattctgtgaagaaagtcattggtagcttgatggggatggcattgaatctataaattaccttgggcagtacggccgttttcacaatattgattcttcctatccatgagcatggaatgttcttccatttgtttgtgtcctcttgtttcatcgagcagtggtttgtagttctccttgaagaggtccttcacttcccttgtaagttggattcctaggtattttattctctttgaggcagttgtgaatgggagttcactcatgatttggctctctgtatgttattggtgtataagaatgcttgtgatttttgcacattgattttgtatcctgagactttgctgaagttgcttatcagcttaaggaggttttgggctgagacgatggggttttctagatatatagtcatgtcatctgcaaacagggacaatttgacttcctcttttcccaattgaataccctttatttccttctcctgcctgattgccctggccagaacttccaacactatgttgaataggagtggtgagagagggcatccctgtcttgtgccagttttcaaagggaatgcttccagtttttgcccattcagtatgattttggctgtgggtttgtcataaatagctgttattattttgagatacgtcccatcaatacctaatttattgagagtttttagcatgaagggctattgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgaggatttttgcatcaatgttcatcatggatattggtctaaatttcgctttttttgtgtgtctctgccaggctttggtatcaggatgatgctggcctcataaaatgagttagggaggattccctctttttctattgattggaatagtttcagaaggaatggtaccagctcctctttgtacgtctgaggtagatgttttaaaaccccatttaaagatgagaaaacagaactggacaagatacataacctcctaaatcttcacagctacacagtattggagctggcatttaaaatcaactgggatatttggcctgtctggtatattttaatgtctactaaattctcagacaaatctccaaaaacctttttcttttctgtggctaagtctatacaagctaagtggaatggagacctgaagtaactatctggagataccaagatccaacatattagcttgtttttaaaaaaacaccttttaaaaatttaataaaagtcactctttcaaggtgaactctgcagctcttttttcccgtcttaaagatttagatgccgaagttatttcaaatactttttacattgaagatttacacataagtatgatgttttaatggaaatgaaaaaaggcgctagagaaaagattcaggttttcttttttcaaataagaaaaatgaggaccttaactgtattttaatttctacccccttgtagactgcatttttggtacatacactatgcaaaatttgtaagaggccaaagaatcttgctccttttagaatgttggcatttgtctcattagcagttagttgcattgctttgaccaattgtgacctgtttctataaatgaccattgctttttgctgcatttggtaagtgtagacacagcctttggagggtaatataaatgagttcaggcagggcatctcttgtaatctgggaacagaggagccagtgaaataaagatgctttctttcaaaaaccaagggaggagtcctagatgaaatgaatcctgaaggctattcttattttgggggctcatcatgaagataataagaatccattttgttgctgaaataaccaaataagagtggcacattcccataggagtgaccattctcttccttttggaaggggcagctttagaaaagtgccattatgcaaagctgaaggccataaaaaagtgccattaaagagaatgcaaattagcatgggcctaccagcctggcaggcattattaatgttggaggtaaagaaattaggttgaaggtatggaagaaccataaaaaaacaaccagaggccagtgtgacattgggctgatggccacttaagctgatgcctcatggctgagactttgctaagtggaagattaactgacaaaacagcttgaaggttgacgaactatttgagctcattgccagatactctagaggcaaaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcgaccacaaaattcagctcttctgatttgctaggatctgactccaggatgcagtactttctggttaacagagggggctcttgtatgcagtaaacctcccaagatggagagatgtggtatcagctattttcattatagccatcttaggagtgtgaagttgtatctcattgtggtattgatttgcatttttctgatggctaatgatgttaaacattttttcatgtgcctattgcccatttgagtatcttctctggagaaatatctatacaggttgtttgacattcttaattgtgttatttctttttctttttaatattaattggttttttttaaacatattctaggttcaagtctcttataagatatacgctttgcaaacattttacccccattcagtggttgttgcttcactttcttgaaggtacccattgaagcaggaaagttttaaattttggtgaagtccaatttaatttttttctttgtcacttctgaaggctttgcctagtgttcacaaaaatttactcctatatctgcttttaagagttttatagtttaaccttttacagtaaggtcaatgatctatttcaggttaatttttgtgcatattgtgaaaaaggagacacacccataagattggtataactttatccttttttatttaggtaatatttgtcccagaatcctttgttgaagactgtttttctttattcattttccttggtaccattatacaaaaccggttgatcataaatgtttggatttatttctggattctattttacttgtctataaagctatctttaatcaagtgacacacagtcttgactactgttgctttgtagctagttttgaaagcaggaagtgcgaatcttttatttattttttctttctctagattgttttggctattcttggcaccttgaatttcattgtgaattttagcatcagcttatcaatatccacaaagaagccggctgggatttttttagggattgtattaaatctgtagatcaattttggggagtattgccatatggacaatattgtttttcaattcaaaaacatgggctatttttccatttgtttaggtcttctttaaattctttcagtgctaattttgaagcctttagattgtaagttttgaatttattttgttaaatttatttaaaagtattttactcttttgatattattgtaaattgaatttttttcatttttggattgttcattgctactatataaaaagatagttttttttgtttgtttgttttgcaacggagtctctgtcggccaggctggagtgcggtggtgcaatctcggctcactgcaacctctgccccccatgttcaagcaattctcctgcctcagcctcctgagtagctgggattacaggtgcacgccaccatgcccggctaatttttgtatttttagtagagatggggtttcaccatgttggccagtctggtctcaaactcctgacctcaagtcatctgcccgccttggcctcccagagtgctgggattacaggcatgagccactgtgcccggccagttaatttttaaatattgatcttgtatgctgcagccttgctgaattcatttttaagttctaatagtttttcagagtatccctcaagattttctgtatacaaatgatagagtttggatgtgtgttccccacaatctcatgttgaaatgtaatccctaatgttggaggtggggcctggtgggaggtgtttggattatgggagcagatctctcatgaaaggctcagtgccctccctgtgataatgaggtcacatgacatctgtttgcttaaaagagtctagcacttccacctctctctcttgctccctctcttgccatgtgacacactggcttcccttcaccttccaccatgattctaagcttcctgaggcccttgccagaagcagaagccaacactatgctagctgtacagcctgcagaactgtaagccagataaacttcttttttatgttacccagtctcagacattcctttatagcaacacaaatggactaatacaacatgcttatgctatctgtaaatagacactttaatttcttactattcagtgttgatgaattttatttccttttcctgccttacttccttggctaaaatctccagtaaaatgtgaactggaagtggctataatgaacttctttatcttgtttttgatctcaggggaaagcattcagtctttcattattattattattattattatttgagacaaggtctcactgtcattcaggttgggatgcagtggcatgatcacagctcactgcaccctcaacctcctggggcttgaggaaacctcccacctcagccttccaagtaggaagaactataggcaaggatcactatgcctgactaatttttaaattctgtgtagagatggggtcttgctatgttgcccaggctggtcttggactcctgggctcaagtggtgtactgcctcagtctcccaaagtgttgggataacaggtgtgagccactgttctctgcccagtctatcactattaaatatgtgagctctaggtgtcttttatcagattgaggaagttctcttattcctagtttgatgagtgtttctttaaaaaaaaaacaatgaatggatattggattttgtcatgattattctgcatctcttgagataattgtgtttttttctctttattttttatttatttgtttttttttttttgagacagggtttccctttgttgcccagggtggagtgcagtggcatgatcatggctcactgaagcttcaacttcctgggctcaagcaatccccccacctcagcctcttgaatagctgggactacaggtgtgcatcactattcccagataattttattttttattgtagagatggggtctcactatgttgtccaggctggtctcaaactcctgcgctcaggaggtcctcctgccttggcctcctacatgctgggattacaggtgtgagtcaccacaccctacctctttattctattgatatagtgttttacattaatttactcacaggtagtaagccaacctcgcattctcttgacaaatcctacttagtcatggtgcataatctttttttatatattgctggattgcttagattttcttctagtattttcatagtttcaggtcttaggtttaagtctttaatcttgagttgatttttgcacatgatgagggctaagggtccagttttattcttctgcatgtggctatcaaattttcccagcacaagttattgaagagggtgcccttttcccaatatatattcttagtgcctttgttgaaaatcagttagatgtaaatacacagattttttttctgggttctctactctgttccattggtctatgtatctgtttttacagcaatgtcatgttgttgtggttactataactttctagtataatttgaagtcatgtagtgtcttgcctccagcgttgtcctttttgctcagtattgcttcggctgttcagggtcttctgtagtttcatacaaatttcagaatttgttttttctatttctatgaagaatgttattggtattttgacagggattgcattgaatctgtagattgctttgggtagtgtggacattttaacaatattaattctttcaatctatgagcatgtgatgtctttccttttttgtgtcttcttcaatttcttcagagttttattgtttttattttacttccttgattaaatttattccttgttattttatttttttgtagctgctataaatggaattactttcttgatttccttttcagctagtttgttaatggtgtatcaaaacactgttgacttttgtatgttgatttttgtgtcctgcaactttactaaattcattaaatagttctaagatatttttgatggagtttttagggttttctatatataagacaatgtcatctgcaaacagagacaatttgactttctctttttcaatttggatgcattttctttcttttttttttttctttctcaacttttattttaggttcaagtgtacatgcgcaggtttgttagatgggtaaattgcatgtcactggggtttggtgtacaaatgatttcatgacccaggtagtgggcatagtatctgacaagtagtttttcaaccctcatcctcctcccagtctccaccctcaagtaggccctggtttctattgttcctctctttgtatctaagtgtactcagtgtttagctctcacttataagtaaggacatgcaatatttggttttctgttcctgtgttaatttgcttagaataaatggcctccagctgtatctatattcataggagacattggtctatagttttcctgtgatgtctttgtctgaatttggtattagagtaacactagtctcacagaatgtgttgagagatattttctccttttctatttttttaaagagtttgtgaaagcttggtgttaattctttttaaatttttggtgtaattcactagagaaacatatgggcctgggcttttctctgtggtaagttaaaattatttatttgatcactttactttttatagttcaattgagttttttatttctttgtgagttaatttcagtagtttattgtctttctggtaacttgtgtgttctttccaagttatccagtttattggcatgcagctgttcatagcattaccttataattcaatttattgttaaaggatagtattaatgtcccctctttcattcctgattttaataattgagtcttttctctttttgttcagtataagttctgtttatcaattttgttgatctcttcaaagaatccatttttgttttcatggaatttattattctttttcaactctcaattccctagaatctataatatttcttttcttctgcttgctttatgtttagtgtgttcttcccttttcagtatcttatgatataaagttatattagtgatttgaaaattttcaaattatagttgtaaatgcctatattttcaaaaagaaaatatttcaaatcgcttcatcccataagctttgatatgttttgtttcatcccataggttttggtatgtttggtttcattttcatttgtatcaaacaattttctgatttcctttgtgattttttccttgacttattggttattttgcagtgtgatgtttaatttttcacgtttgtcaatttcccaaatttccttctgtaaatgatttataatttcattccactgtgattggagaacatacattgtatgattcaactattttaaatatattgagacttcatgaccagtctgggcaacatggcgaaactctatttctaccaaaaatacaaaaaattagctgactgtggtggtgcacacctgcagtcccagctactctggaggctgaggtgggaggatcacttgagtcctgggaggtggaggttgcagtgagctgagattgtgccactgcactgaagcctaggtgacagagtaagaccctagctggaaaaaaaaatatgttgagacacatcttgtggcctaacatatgctctatcctggagaatgtctgtgtgcatctgagaagactattttgctgttggtggtggagtgttctatagatgttgctaaaacttggtagtttattgtgctgtttagacttctatttctccattgatctttttctagttgttccaccattatttaaattgggataatgaagtctccaattattattattgaattatctgtttttccctttggtcctgtcagtttttacttcatgtgttttagggatctgttgttagctgcatatatatttataattgttttgttttcttgatgcattgtttctttatcattataaaacttctttctttagtaattttgtaatatttattttctctgatattagtatagccattccatatttcttgtggttcttgtttccatgatatcttttctcttctttttcctctccaatgatttctatctttttctatctataatgtgtgtttcttgtagacagcaaatagctggatcttgtttggtttttatttcattctggcagtctgtgccttttgattggattgtttcatccatctacatttaacaatattaatgatatagcttgatccatcttattttgattttccatatatctcatgtcttttttgttcccctattgctcctgtactgctttgtcttatattaagttaatgctttccagtgtaacattttaattcccttaatgattttctactgtattttgttgttattttctcaatgtattctctagggcttaatctatgtatattaaattatcagaatctacttcatatttatagtaacttaattacaataagctctttaagtgttttcctagatagctctgtttcttcttctctctttttgtgctgttattgttataaattttacatctatacatgttacaaactcagcagcacattgttataattattacttaatgaaattttatgtcttctaaagaaggtaagagaagtgagagaacaagtatatttattgagtttcttataaaccaccttatgtaccattactggttctgtttgtttgtttctgtgcatttaagttaccattttgtatttcctcactccagtacagccttgctccaacacatttcttttggtttgttattgtcatatgttaaatgtatatattttatggtcccaacaatacaattatatacctatttttttattgcttttcaaagtttgttatgagaaaaggggagtaaatatgcatttatactgtattttgttattattacattattattttattattacattattatcttcaaatgagctgattttttctttcatgtggacttgaattaccacctggtcccacttgctttcagccggagaatttttctttattatttcttgtaatgcaggactgttagcatgagattgtctcatgctaacatgagatactttgttttctgtgaatgtctttatattgctttcggttttgaaaatacttttgctggatatacaattcttaattattggtttcttttcctaagcatgttgaatgccatcccactgcctttgtcctctattgtgtctgatgagaagttagctgtcagtgttattgaggttcctctgtgtgatgggtcacttttctcttactgcttttaagaatttctctttctctttttaacatttttagtatggtatgtctgtgttaggatctctttttggttatcctacttgcagttcattgagctacttgcacgtgtagattaatttttcttccagcttagagaaagtattagccattaagatttttttttcttttctgtttctttctctttctggtactcttccattaggtgtattctggtgtgctttttggtgtcccatatttctctgaggttctgtccatttttataccttctttctctctctgttttcagattgcgtaatgtctactgaaatatcttcaaggttgctgattatttatcctgccagctcaaattgtctgcggaagccttgtagtaatttttttttaaattgagacagaatctcgctctgtcacccaggctggagtgcactggtgcgatctcggctcactgcaacctccgtctcctgggttcaagcagttctcccacctcagcctcccgaatagctgggattacagacgcatgccaccatgcctggccaatttttgtatttttagtagagagggggtttcaccatgttggccaggctggtctccatactcctggcctcaagtgatctgcctacctaggccccccaaagtactgggattacaggtgtgagccactgcacccagcccttgcagtaaatttgtaatttcaattattcttttcaatttcagagtgttcattagtttcatttttataatgtctatattatataacatagacattatattatagaaaatatatatagaaaaatatattatatataaatatatattatagaatatagaatatatatagaatagaatatatattctattctaaatacagaaatatatagaaaaatattatatattatataatatagacataatatccttttatggatattatatatttaatgagacattgtcattataccttcctttacttctttaagtatggttttcattagtttcaacactatttctaaaggctactttgaattctttgttaagtctgacatctgggctctgtcacagatagatcccattgcttgcctttttctcttgtgtatgggtcacgcctttctacgtcttttcgtgtctcataatattttgttggaaactggaccttttgaaactctggataatgattctcctccaccttcactgggttgtgtatttgttgctgtttgcttatttattctgggacttgtctgaactattttactaaaacctatttctcccctgtgtgaatcctttgatgtcagagggctgtcttgggcatgtgcagagtcacagtgggataacagttttagcagggatttctttgggtctttccctgatatttctgttaaacagtctgtctctgttgttatcatgtctatctgttggactccactaattgttgggtgattgctgtattgtttttgacagtgtcctggggcatcaattgctccacagtctgatcagatttggacacttttgctggggtattttttttttttttttgaggtggagtcttgctctgtcacccaggctgaagtgcagtggcgcaatctcggttcactgcaagctccgcctcccgggttcacgccattctcctgcctcagcctcctgagtagctgggactacaggcgcccaccaccacgcccggctaattttttgtatttttagtagagacggggtttcactgtgttagccaggatggtctcgatctcctgaccttgtgatccgcccaccttcggctcccaaagtgctgggattacaggcgtgagccacctcgcctggccttgctggggtattttttgaggccagtctttgagatttgttctaaccccaaaagggctcttctttgctggttctttttctggttatctaatgttagctttcctatgatttagcttgtcactgttacacatcctcttaaatgcttaccaccaagatttccatttttttctcagaggacctttagggttttactttcccttatgctataataaaaagtcagttcctttggggagagctttggaactctctgttttatggcttgcctttctgttggtgtacagtgtctgagccattgctttggagttggaggcaaggacaggggtcttgtttctctcaaaatgacactgcttcttttctagctgggtattcatggagtcagtatcctctggtcttctcagtttgcctctcctgatatggagcttctttgctgatagcgagctacaccagtggtgactggggggtccagtgttgttgctctgctatgcctgaagtacagtctccatcctataactggagacattgttgaggaagggagcccctgtcttcttggccatgcttgcctggagtttagcctttgcaacaaagagctgatgttgatgagaattctggaggccttggtctcctggggagatacatagctcttgactgggagctaggaattgtgggtatctcctctttttgtccacacccacctgtactggtcctgctgtgtgaaggggagggagtagatcatggctcaagtgctacagactctccctctttctaccaaaggttagtagacttccttgaataaatctttccttatttgctatatgcattaagaacatttccagagacagtaaatggctgctttagaattttcaccggtatggttgttttactggggagaggcctgcagagctaagtcacaattttcttggttttaggtatgatggatgatttttttttattggctccaagacatattatacattatgttcagggatgctgggtcctatttaaatcttttattttagcaagcagtctccctgtttaggtttagcatataggtcttggcctactttttttgtctgtggttccactgtgagtttaattttcacagcatttgtgttgttatttaggtctcctctgtttatttagtattattggacttttcactggtctctcttagtgctgcctaaggaagccaaggactttccccaagccaagcccttgggtgtcttttggtgggggagggttgtattgagatcctcctaatagtattatccagcctggtgtctcaggtttggggaggaaattcttgggtccatggggactaacaggcctcttagacccatatacttgctgcagttgtctcttttggtagctcttccagcctgcctcaatgtctctggtcaggggaggagagtgtcaggccaatagggacaaagagcctttccagtggctgggcgcagtagctcatgcctgtaatcccaacactttgggaggccgaggtgggtggatcaccagaagtcaggagtttgagaccagcctggccagcatgacgaaaccctttctctacaaaattaaaatacaaaattagccaggcttggtggcacatgtctgtaatcccagctactgaggaggctgaagcatgagaatcacttgaacctggaaggtggaggttgcagtgagccgagatcatgccaatgcactctagcctggacgacagagcaaggctccatctaaaacaaaacaaaacaaaacaaaacaacaacaacaacaacgaaaaaagcaaagcgaaaaaaaaaagcttcccagaatgggctacttgccacaattgggtctcttttattggttctgcccacccaccttgatgcctctgggaaagggaagagagtcttaggctcatggggacaaaggagcatcctatatctagctgttaggtataactgagtccctttttcaatctccgtctgcttatcctgatgtctctgggggaagaggggtcttgagtcctcgggggacttcctgaaataagtctcctagctgtggttaggtcctgtttgcttaatttggttttgtggaccttttgcatatccttgttgtttttctctctagtttttctatcagttttccagagaggaggtcgaagtttctaactataactgtggatttgtctatttctccttttagttccatcagttttcactttatatattttgcatttctgttgtttgttacacacacatttagaatggctgtgtgttcttggttgattgacccttttatcattatgtaatgtccccctacattcttggtaattttgtgttccaaagtctactttatctaatattagtatagctacttattgctttattttaattgatgcctacatgatatatctttctatttttcagtgccttcttttgcttgttttatgtattatgtcaggctggagtacagtggctattcataggtctgatcacagctcactgcagcctcaaattactggcctcaagtgatccttccacctcagcctcccaagtaggtaggacggtaggctcacaccatggcacctggcttgtcatgtgtgttttctgtaaaatctagaattagttggaggaatagagagaaatgtgtatactctgtcttgtccagaaccagaaatctagttcacctatttctgttttcttgaatgatctgggttggctttttaagtctttgaggctccgtgttgcactcacctaattttagctcaataagatcatgttactgagtctactactctgtacatcaagggctgtagtggctcaattttttttttcaaagatcaaattttcaaagtccatatatttttatcaaatatgcccttagccttttgttgctttggttgcatctgtccctccactgcctttgtaggcatttggttttggagagttgcaatgatgtatgatctgcaaatctccatctgctgcctgccactgactcagcatgaatagaaacaaaaattgactataaactggttgacaccaagatagacctaataacatggcttatttgtatgaagttggactctgctattaattcattcagtatgaagtgcttactgtgtgccaggatctgtgttaggtcctggggttacagagctagcagtgccataggtactgattttggagagttcatagactactgagaggagacaatcaaatagggtattcggtgctatgataaaggtgagcacaggttgctgtgacaatagagaacaagggtactcaaattagggtaggctctgttgatggaagtgacacctgagttgagtccctgatatagtttggatatttgtctctgcccaaatctcatgttgaaatgtaatccacaataattggaggtggggcccggtgggaggtatttggatcatggaggcagatccctcatgaatgccttgggccatccacttggtgataagggagctctcactctgaattcacatgagatctggtcatttgaaagtgtgtggcagctgggcgaagtggcacatgcctgtaatcccagcattttgggaggctgaggtgggagtttgaggccagaagtttgagaccagcctgaccaacatggtgaaactccatctctactaaaactacaaaaattagccaagcatggtggtgtgtgcctgtaatcccagctacttgagaggctgaggcaggagaatcgcttgaacccaggaggtgcagtgagccaagattgccccactgcactccagcctgggcaacagagtgagactccgtctcaaaaaaaaaaaaaaaaagtgtgtggcaactactcttgaccactgtctctctcctcctcctgcttttgccatgtgacatgcctgctaccctttcaccttccaccatgattggaatcttcctgaggcctccccaaaagccaagcagatgctaacactctgtttcttgtgcagcctacagaaccatgagctaattaaacctcttttctttataaattacccagtctctggcatttctttctctttttcttttttcttttcttttcttttttttttttttttctgagacagggtttcactctatagcccaggctggagtgtaatgttgtgttctcttatcactgcaacccctgtctcccaggcacaagcgatcctcccctctcagcctccagagtagctggaactacaggcacatgcctggctaattttttgtatttttggtagacacggggttttgccatgttgctcgggctggtctcaaactcaagcatttctttatagcaatgcaagtatggtccaatgcagtccccaaggatccataaccagtcaaggattgggggaaaccttaggaagcagcatgagtaaagggagtttcaagaggaagtgttgcttgtacttatgggctagaatgagatctgtgacctcagaatttgatagaaaccaggacacctagagcccagtaggatatgcgacatattttggactttagtctgagagcagtgagaaggcattgggactttttaagtagaggagtcatttaatttgatttgtgtttttactgaattcctctggcttctgtgtgaaggggctggagagtggcaagaacatggcagtgagttagaaggctgcagggagcagcccagggagacagggttgtggcttggcttggggaagtgattgtggggatgcagagaggtgaatggattcaggaggtttaggaggaagaacagaaagaatgctgcgagtaaaagatatagatggtagggatgagagtgaggaagcaaggaagtttctgccaaggattctgccttgagaagactggagaagctgtgataagcagggcagtgggagagagtctttgtttacatgtggaatttggggagactgtggagtcgccatgttgagatgcccacgggcagtggatctgtggatgggggggctcagtactgcagacatagactgggagggttttttgtttgttcgttttgttttgtttttgagacggagtccccctccgtcacccaagctggagtgcattggtgcgatctcagtttactgcaacctccacctcctgggttcaagtgattctcctgcctcggcctcccgagtagctgggattacaggcacacaccaccatgcccagctaatttttctatttttagtagacataggttttctccatgttggccagactggtctagaactcctggcctcaagtgatccacccgccttggcctcccaaagtgctaggattataggtgtgagctactgcgctcagccagactgggagttttgaggtgctttgtctcatttatctcacttaaaataatttcaaaatatgttaaaaggaaatgttatttgcaatgcatagacaggttttcctcgctagttgctgaggataaaatccaaacaactggacctaaacagacaggattggaagaggctgttctggaccaaatgggatgctaaaccttagaatggattgacaagagaaggccatgcagaatggtgagaaggccctacttacctcagcccagcttcaaggccctaagtgagggatacctggaatgcctctgaagactggcatttggatgcccattccttcccattgcagttgccaagcccaagagcagtggagaacaactgtaccttcttgtcatgaagtgtgtacaccggaaaaaagtaaatgcttgtattttctttttcctctctttcttttctatatacagctctccaaaaacgcagatttctctagatcacagttgttcgtggagaagtgagagtgacaattttagagtaaaaaatttaatattgtgggaattatctctaaccagtcaaattactaatgaagatatttattcttgggaatctagaatcagctatttaagctttctaggatctggagtcacacagacttgagttcacatgatggctctttcacttaccaatcatgagactttgggttaatcactgcatctacttctgaccttcagtttcctcatttgtaaaaggagaatgctacctcatgggactgttttgaggcccaaatactgtatgtaagtgagagggctttataacgtataagttgctctttaaatgttatttaatcattatttagcttctggtttcattctattaataacattttaaagtgttattagaaaaattgtaagattcttgctaatattaaaatatgttgctttatttaaaagtaactcctaattcatgcccacctaataataaagaatatcattaggtggctgtaaacaaaaaaatcaaacagttctttctttcctctatacactcacacacttctggtcatcaaaatgtgtgaatttttccgacagagaccaatactccgacactagctgggtgtcttacaattcaattcagttctgaaactaaccagcattagtgcaggccccatagattaagagctcagtcccacaagtctgccccctccccttcagacatctatctcaagtcccaggttgtcacctgtacttctggctgtaaatcaaggtttccacgaccccctccttgggtttgacaatttgctaggacagctcacagaactcaaggaacacttgcttacatttactggtttattatttaagaaaggatacaataaaggatacagatgaacagccagatgccaaggtacataaggaaaggtatgtggggagggatgcagagcctcttgtcacctccatgtgttcaccaatatggaagcattctaaaccctgtctttttggggttttgtggaggcttcattaggcaggactgattaaatcatttgtcattggtaataattcagtctctctttttatcttttgttttgagacagggtctcaccctatcacctaggctggagtgcagtggcgcgatcacagctcactgcaacgtctgcctcctgggttcaagtaatcgtcccacttccacctcctgagtagctgggaccacaggcgcacggtctcactttcttttccaggctggtctcgaactcccaggctcaagcaatcctcccacctcagcctcctgagtcactgggactgctggcacacaccacgacacacggctaatttttgtttttcctagaggcggcatttcgccatgttgcccaggctggtctggagctcctgagctcaagcgatctgcctacctcagcctcccacaaagtcctgggattatggacgtaagccaccatgccccgtcaacaactcaatcttaaacccctctccctttcctagaggtggtggggctggtctggctgaaagtttcaaccctctaatcacatggttggttcccttggcaaccagccttcatcctgaggctatccaggagcccccagccatcagtcattcattagcacacaaaacatctatcacttcagagattccaacagtttttggaggaatgaaaatcaaaatatatatttcttattataaatcacaataccacagtgattattggtatgtatgcttttaattttaggctaagcgaggattgattctattcaatttttccctcaggcttataggaacacatttaagggcatctgttgatgactcattaactgtttcaaacctaaaatgtgtcaaatgctgtgactttgcaactattgttgctcttccctttagcacgaaatactttaatgatctcaagacatttatattatcagatttttgcatatattcactaaaatttggttttattaatggtctcgatgtgtcccataaatattcctggtttccaacttgagctggatttattaggaagaggcaaaatttagcttatgtgccatacctgaaggaagttacgtatcgtagcttgtgatgctgtgggacagctaaagaacaagcctttacctggtgacagattttaactggggaatagttattgtaaaaaatattttcattttttttagactacaagatatgcgggctagcattggatgcttgaaaggaaaattacatttttgctgaaatccaggcaatgcaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaaaataaaatgctgagacctaccccccaaccatctaaatggacttcctcctcgaccaaggcactcttaaaatttaacttgaaagactggttcaagtcatgacaggttgtggcagtgggacatgcctcatgattacctctctggcattaacatcaacacagaccttaagtctgataagaagcatttacaatctgttctcttggaatcttcctacctggagacttcctctgcacaataagaactttggtcttcataatcctttatcttaacccaaacatttcctttctattgatcctaggcctttatttagataaactcaaccagttgtcaaccagaatttttttttttttttttttttttgagacagagtccagctccgtcacccagactggagtgccctactgcaatcttggctcactgcaacctatgcctcccaggctcaagcgattctcatgtctcagcgtcccaactagctgggattaaaggtgtgtgctaccacgcccggctaatttttgtatttttagtagagacagggttttgccatgttgggtagactggtctcaaattcctggcctcaagtgatccacccgccaaggcctcccaaagtgttgggattacaggcgtgagccacagaaaaattttaaacctacctataaagccggaagctctccccttcaagttgttccgcctttctgaaccgaaccaatatatttcttaaatgtatttcattgaaatcccatgcctccctaaaatgtatacaaccaagctgcaccgcgaccaccttgggcacatggtctcaagacctcctgagggttgtgtcatgggccgtggtcactcctatttggctcaaaataaatcacttcaaatatcttacagagtttaactcttttcattgacactctgccaaaaggagccctgaaatgttggtcagatttggataaggaccatggccatgtggcttaaatggcatttgctcgcttgttggtaatgagttgcatttgaagaggtggaataaatggagacaaccggcatcattgggcacctgtggacaaagaaaagcctttttggttgagccaaggtgatactatccacatctgcctaggaagttgtttttttgtttggagtagctgggactacaggtgcccgccaccacacctggctaatttgtttggttttgtatttttagtagagacggggtttcaccatgttagccaggatggtctcgatctcctgacctcgtgatccgcctgcctcggcctcccaaaatgctgggattacaggcgtgagccaccatgcccggccctgcttaggaagttttttgaaagagtgtttatttgtgaaaatgaaggtgcttctttatgtctatagctttctggctttactcctttcagagatttgacttgtaaggcaatagatagaaatgatagctcatcagcatctaatgagccaaattacttactccataaaatattatcctactttctaactccaaccatacaatttgaaggaaagaagcccaggggtcccgattaagccattgacatgtctggctgaaggatgatatgggcttctcattgactgagccaacaacatgacctgcccaggcgggatccgggctgactcctaactccaggatgaaagcaggaaggtaaacagtctttgggtaatttactcaaattgtagccagtgaatacctcaagcatggcactcaccatgctgtagtgtaattgcctggcttttgtttttgttttattttgttttacctgatgggagctctctaatacttcaaacatggcacttaccatgctgtagtgtaattgcctggtttttgtttctgttttcttttgttttaccagatgggagactatgtctttcatgtctgtcttcccagtgtctttgtccgcagtaatcaattattgtatgttgaataagcaaaattataatttttaagcaccataaattcaacctgccaaaagccaaatccaattttttgtctttcaggggatggcacaatagccagcttttcaggaacctgagtgttttccaaaccagcacttttcaaacttaactatgcacatgaatcactaagttttgtgaaaatgaagattctgattcagtaggtcaggggtggggcatgagattctgcatttttaacaatctcccaggtgaggctgatgctgttggtctgcagactacaccttaagtagtaaaggtctagaccctggtctctaccttatctccaaaatttaatccatcaccaagtcatgttgtctccatctcctttgtcccaactcatgtctgtttctgttgccaccactttagctgaagccttcatcatttcactgcagagattattgcaatagctttcatgtagtctacctgctctttattctccactccactgtctatactgcagccaagatgatatctctcaaatacacctttgggcatgtcaatccattgttaaggggctttcaatgtaggataaagtaacagaccttctgtggttagattgcctttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctgtcctgggaatgggatgcagtgccttgggtggtttcaggagattgacacacttccaggaccaggcattttcatttccaccttaaagaaggagcctgctgtgctttctgagacctactgtatctgggatggccagacttcaggagacaagaagaggaaggcatcctatccttttggtgggtggatggacgggccgaatctatctcagaaatttttaatttttacttccatgtcactttccagtcttcagccagccccccaccgtctacctcccactgctggagtgtggcttcattcaggggagaatgctgagctctgttgacatttggtagaatttgttttcttccctctttaatttagcaactaatcacgggggttgttctttgttcatctttccagggttttccgtacgctgactaatgcttacagctggctctctctggagagaagtgctgggaagatcaatcaaatgaaatcttaaagggtaaatcaggttttcaaatgtgttcaggcagctttaaatcgtttcagtgagaagaagtgcttacaagggcagaaatttgcccagcgaaatgcctcccaatggcaacagaacaatcacaccttggatggctgctttgtagcctgagtgtccagttcttctgagatttccaatggccatttacaactcaagagtgagggacaaaatgaagtgcatttgacttgaaggaattcactaatgcaagatcaaagttgtaaaaactgtaccttaatatgctctatcaaagggctgtatgcagatgttaagaaagggaagctgcacaaaatatcccttttcaataatttcacattttctttagtttttcagctcctataaatctcaagaaataattaacatgaaacctatattatgtttcaggaaaaactccagagagtctttcttaggcttttggaagtcagtgatgctgttttctgtcttcttagagaagtcctaaaatggaaaaattttatcatggaaattgacccattcagagcagagagtttatgtgactttatggtacaggaaatttgaaaatcgcatctcatcttttattttctattgtcatgttaaactatggttgtgcctatgggattaagtgaatattctagccacttgcattaaatgattagccagtcttttcatagtgacagttggttgtatgtgctgctagtcctgcagcggtctagtctgctagtggttaactatggagaattggtcagaggagtccctccccctattatacacatctcattaaagactctctgccactgccaaaccagaaaaggcaacttatttcacgattcattaaagaaaacataattgggaaggtaattttgtaaagtcatcatcaaacatagtccaccacccagtaggaattatcctctcattatctctttttctagatagtcattgacattgttcccctctgttagcatgaataattaaggactgagcataaagaagtggtgtggacctatggtcaatctgaaggtgtcatcagaagagttagcagggctttcttgccttcagcaggccatttattctgagctaacctgccaattgtatttagaacagggaccattaacagggtgactgtttggctggctgtcagtaggctgtggggctttttccagagcaaatagagaagccagctgggcttcactaagaccacccaggaagagagatcatgtcccacctgatcacattccaagcaggtagcaaatgggctccagttgaattgtacttctgaaggctttctgaaggggtaggggaaaatacctcccatcttagaaattatggctgctagtgtccagtttaaaaaatttctggccctcagcaccaagtgtcttagctttttgtccatctatagctgtcagaaagacacgctttgtcttcctggcaaaactgcctctcaaggtctatgccatcattatggcttggtttaatcaagctaccagggttgcccctgtgtctctcatctggctcttccagaagggacagtttgggaaactttcagagattctgaagatttcatagggggagaccacacttaaggaataagaccctccacacattgcagtgagagtgacatgttcattgccaccaaaagaagcccctctgttaaaacaaacctgattccaaacagagctaaggttgcttgggggctccgtattgtaaggcctatgggcatgcaatgaaataggagttgatgtggactctgaaccctgaagaagcagtttaaatcactagcactgctgtttattagctgggaaattttgggcaatctatttcagttgtcaggtcttcagtttcatcatctctaaaatggggaggacagtgcctgtctttttacactcctggacttgtgttgaggagatcatggataaagtgtgttgcacacagtaagggtagttatcatggttattaaccacactgcagctaattgggctctagctaccccatttgtccctggtcaggcaggcccaggactttcttaagcttttctcaccttaaagcggaaacacattccctctcctgtggggtcacgtggctctgtttaaatgtggctctaaatgagatgtgtgccttttgacaggtcaccttgtaaagatacacagcatttccaaccatgtaaaggtggctctaacttcttgaaatcctctctttgagaactgcctttagagctggtcattttagtcacaaaagaaacatctttcaacagggtcttttttttttttttgagagggagtctccacccaggctggagtgcagtggtgcagtctttgctcactgcaacttccggttcccgggttcaagcgattctcctgcctcagcctcccaagtagctgggactacaggcacacaccaccatgccccgctaattttttgtgtttttagtagagacatgatttcatcatgttggccaaactggtctcaaactcctggcctcaagtgatccgcccgcctcagccttccaaagtggtgggaatacaggtgtaagccaccatgcccagcctcaacatggtcatgttttgaatatgcttggacagaaccttgccaccatttctcatagtcatgtgtatggtatttaaaccatagaatgtcagatttgtaatgccccctagaaatcttctagtccagtagttttcaaactatgttccccagatctcaactgtttggagaagggacatcaaggtcagggaaaatccaaagcaccatatgttcttgatgctaagatgccattagttgtagtttgcaccatcaattaatactggcatttcaggaatattaaaagaatgtatgcagtcattctaagacccatccttattttagatatgaacttcaattaaatacagtattagggttctctggaggaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtcccagactccaaaagctgaagaatccggagtctgatgttcaggggcaggaagcatccagcacaggagaaagatgaaagctggaagactaggaagtcagctaattccaccttcttcttcctgctttgttctagccacgctggcagccagttggatagtgctcacccagattgagggtgggtctacccataacactctgctgactcaaatgttaatctcctatggcaacaccctcacaaacatatccaggaacaatactttgcatccgtaatccaatcaagttgacacttaatattaaccatcacactgtccatcatcaaattaaagaaatataatgttttctgttaaacagtataattttacacaattgggtaagcactgtttcattgctattttatagattgggctaatgcctatggtttcatgtcacagatttctgctcctacagagtttgaaaattgacctaatctaacccatttcttctgtagaggtccagacaggagaaggtcatacagatagttagcagcagggctggggctagaactcaggcttcttgactgccactccagttctcttcacaatgttacagtaccttttgtctacagccatattgcataccagcccagctttcctttgccatgacttggtttgcatgcaggaattgtaaacccatcttattaaaagttaccaatgataggctgggcccagtggctcacgtctgtaatcccagcactttgggaggccgaggcaggtggatcacgaggtcaggagttcgagaccagcctgaccaatgtggtgaaaccctgtctctactaaaaatacaaaaaaaaaaaatagccgggcgtggtggcacacacctgtaatcccagctactcggggggctgaggcaggagaatagcttgaacctgggaggtggaggttgcagtgagctgagattgcaccattgcactctggcctgggcaacagagagagactctctctcaaaaaaaaaaaaaagttaccaatgataagaacattttatgttactatagcccttaacattttacagaacaattttatattctccttttccttacatctttaccacagcttgttaggtggagcaaggaggatatcatcatcatcattattatcatcattattaagacaatcacctccattttatggatgagaaaactgatacccagggaggataagcaattggctcaagatcatgcagacagttaacagaactgagaagaccatccgtgggtcctgatttactcattcaatgttgttacacattaaagcaaaacataaatctaaagatacgtcttgaggaaagagttattcactagaagcttgcaagaacatcattttattgctgaaagcagctcaccttcaccagggacgttgagtcattgatatcccagaaaccccgtgtcattgggtgatttcaactacaagttggtgccatagcctgagccctgagccctgagccctgaggatggccttatactgagcattgggtgttttatcataacagagacagttaaggtttaacaatgggctaatggccgatggcagtgcttcctgcactgctagtgagagtgccaaaccaaggaggagctgaggaacagtccagtggctaatgtggggattagctgctgctttgggtaatctgtgtccagttcaggctggttacaggagagcctcaaggactcatttcacttggctgcttcttgacctgcaattttgcatgctgcatgctgcaattttccctttgaaaatacatctttccttttaaaaatgtggtgacatgtgacttctctgaagtttaaatgtttgatcatttttaagctggcacaaaaatggttataaatcttaatacttaaaaatgtaaaaggaaagcataaaccctaccaacttgtttggtcccttttgtgtgtttgagagagcaagcccagctcagcaggccctttggatgtccgctgaggttcagaaagcaatgatctagtcgcatcaagatattgaatcttctgaattctggccttgtgccccccaggtcagggctgttgtgttggttagatggctgcccaaaaaatggtcctgccatgcccctgagtttccctcttgtgaatgaatagaaagtttccatctacagagttggcaagctctgtgctgttaatttcacttagttaaaaggaaaaaaataactaaacacacaattattagtaaaccaccctgcagacaagtttaggattctaaagaacatttggtggttaggcttaaatgctgtaggctatgattacccttaattctgcacacagacaggcttcagagccagaagttacatgatttggtcttgtcagatgaggtcccctttttgccttattcacagggagattatggaggtggtaattgtcagtggattccaaaactccctggtcaatttaagcatttatatgtgggtttaataaaatgatgatataatacagaaagcacactgtcagggaaggaagtaactattagcaacatcatgacaccttaatctttttctccctctgggagagcagaatgggttaaacagaaggtttgcttttattattgaagcacaaaaaatcacatttttgtctaagttgtttagtcagtgagttttgtgtaattcaatggaaataattccatagtaacttagtaagtcagtattgaaaaggctgggtgaaaggacagcattttagagcaggcagtgggaagcctgagggagcaggagagggggagaggggctggttaatcagccgtcatatgccaggacaatatataatcctgtttgatttggtggaacaggccctttatgggtaacatattccccaatcccaaatcaggaactgtgaactcattttacttgctataacctcaatcctcataggactggggcttataaattgtggttgactaagtggggagggctgagttgtggaagatgccacctaagggtagtggggacaagcacttcaccaggaaaatcagtgacagaggatttttcagtgtaactttgccagctggagacctctgcagccagcgatggccatgcctggatctcactcaggccctgggcttgccacaggaggcaccctgctcacttggcccagggggctgtgcttggcttgcactcctgcccagatcccacacttgccacaggatccacactcagcctgcagctgggccgggcatgctgcaaccagcttcccccttgtgtgctgacatctggatgaggggaacacagtggcatctgaacagggatgccaacaacctcaaagccccagagggggtgttacagtgtgctaacagttgttttagtcccaccatccacagcctgagcaaacaggggtgtgttaacagctctttcagtcctgttgccctgctccagcccgcagccccagggctaggctggccctgctgctgcttcctggagcatgaagtggctgcctggcactggcggagggcagagggctacagttttacagccttctttgtacccacgtttggcaggttctgagttcttgtcccacatccaagaagaatgagggtacgttgacaactgaagtgtgaggagagttttattgcatggcagctctcagtagagaggggactcgagaggccagccctcgagtggtggtcccaaagtgtggctgagtccggggtttttatggactcggaaggggatgcacgctgattggtttgtgagtattcaaaaaaggctaaaacaagggcaccactcaaaggtgggcacgacagtataaaaagccaattagggaagggtaggtatatgtaaaataggtgaagggtggggatcaattaaaggaaagcatgccagatgggaagagaggttctcaattttgtccatggatttatctaggacttgtagcttggctttcaagctttaaactgtctatggtttgaaggtggggttttatcagggacttgcccctgtctgcctaagacttgtctgccttctgctgctatgagcagtacacagaggcaggagcaaaagcagaatagagccccatctgagccatgagttgggagattttacaatgggtcagtaaaagggacaaaatttatcaaatggaagagcacaaagatgagcatttggatttgtcaggaaagttccaagagaaatgttagcacaatcacagagggttaaattctgtaccatgaactacagatgaccctgactcctttgttggttataaaatacctttctagctccatataaagcaggatgccacagcctacatgtattaaatcatgcattgtattgagttgaattgaatggtatttgggagagggaggggatagcccaagtggtcccaggttaggaccaacactggggcagctgtgatcttgggacagaaatgtgaaaacacagactgtccagatgcagaacaggtgactttcatcaaatccagtccctccaatgaacataagaggaaactgatgccccatgaggggaagcaacttgtttcaggtcacctaccaggttagttgcagaacagacctaaagggtaggctacctaattttcaatttagtgtttgcttctctttaggctttattgttactttgcaatggagatcatacagatatgggtcaggagactcaagaggacaagtgatttgccccaggctacactagtgagcggcagtagccagtgtttgtctgattccagagtctgtggacgtaactacagggatatatgatagagtgttttgtggttggaggaggagagaattccttaagagtgtgtgctcatgaggccaggtgtggtggctgacgcctgtaatcccagcactttgggaggccgagacaggcagatcacgaggtcaggagatcgcaaccatcctggctaacacagtgaaaccctgtctctactaaaaatacaaaaaattagccaggcgtggtggcgggcacctgtagtcccagctactcaggaggctgaggcaggagaatggcgtgaacctgggaggtggagcttgcagtgagccgagatgggccactgcactccagcctggacaacagagcgagactccgtctcaaaaaaaaaaaaaaaaaagagtgtgtgctcacgaaaggcagctctaaagaggtcacatttaaactgaaatctaagggatcatgggaaagaattagccatagcaaagccaggggaagtccaggctgaagtaatcacaattgcaaagaccctgaggttgatttgtccctgggataaatgtccttgcctgatgatgtgcttgcctaagtcctttttttagaggtaattctttgacagacccattgctgtctggaactcccaatggacaattactgctttgttggtgtatctaattcaagagttagcagcagaggctcatgtcatgaaacttcccttcaagcttgtttgtctgctgagtttttggtaggagcaggatgggatcaggatggttagggggccaggagcggtgggaaggaaatgagttaggaatggtcttttatgtgcccatgagaccaggctactggtaaaatactgataaatatttcccctctaagttttttttttttttttgagatagcgtctcgctctgtcacccaggctggagtgcagtgctgcaatctcagctcaatgcaacctctgcctcccgagttcaagtgattctcctgcctcagcctccctggtagctgggattacaggcatgtgccaccacacccggctaatttttgtatttttagtagagacggggtttcaccatgttggccaggctggtctcaaactcctgacctcaagtgaaccacccgcctcggcctcccaaagtgttgggattacaagcgtgagctaccacacccagccccttctaagatttttaacatatgtcatgctgcaggattcctattccattagaggcttgtatttaccgaggcaaatggacgaaaggcaaggaaccagtactagaaatataaaaccatccctgtgttggatacgccctggaacaaaggaatataaggccaggattttactttctgccctggaactgacttccctttgactctgcaagttttactttcctgctttatgtctgataggcataaaatgcctaccattcttctttctaatacaattgtaatttcatcaatgggattagtgaaggcactaacaaaatctaaattctccatagtactgatcatcagggtgttctttagtagtgacttaaagaaaatcatgctctttgaaagaatatatataagttgcctttacattgctcactgagaaaagataatggagcccaaatctaggcttcttgttcctcgcctcccttttttttcctgggtgatcatacttttcaaggttatgttctttcatattcagtgttgaccatgcaaaactggtgaacaagaattggttctgggatgatttgttccagctataaagtagaaagcattttactaaaataggatgcttagatttgtttggatctacagtttattcttaactaaaattccaggaactgttggtaacagtctagattcatggcaaccagtttttacaagaattagaaagaaacgaataaaatgttctcattataaggttcaggaccgaatttgaaggctttcaggattccagatggcaaatggtagagcgaacgtgaaaatattagaaatttatgctcaatgatcatcatcttctgtccagtgaagaatgtagtttaagcaggatgggtgcgggcgtctgatgtcctcatttatttccacctctgtagctatttaagtgatgatcattcttggtggtggttaaattatgatgcacgaaatactatctccctaaggaccttgctacaggacagaggtgattacaagaaattgttgctgctgatgtaatgtttcgtataccaagattaaaccacaagatgaagtaatgtacattttttgcctttgaaatgcagctggagggaaaccagggtaagaactattgccaaatgaaatataatgccccaggaaaaatataagatactgtaaatgtaaaatcattacaaaactgaccatctgggtcatatattaaaccacagctttcaatttgttatggtttgaggaatgacttcacagtgtgtaccccttcctccgtaccttcctcagcctcaggaaagcattctattttcatgagtgtagaaaaaaaagtaatcttaaagttttgtttttaaaaaagagttccaatcaatagctcttaataaaggcacagtgtttgcttacttctttgcatttagtcctactatatagtcttgtgttgctaattccactttagctgtggcaaatataccagtgtgtagccaccgggccatgaggtaaattgaatccgtgtggagctgacagttgaaaaacctctgtctgcctcagttcaggaaacaagagcgtgttcaactcactttgggaaacccccaggcattaaaattttggcattttcatgttttgagagaactgaggagtagccctgttttgataatcatttaaaaatattttacttaattagagcagaatttgctcaggcagaaaatcacatttatatggtagccaggctgtaacacctcatagctacccattgtctctaatcagaaatgacagcctggtgactggctccatgctgggtgaagtccagcaaactgcaggccctgtaagtgcctaatcccaaacctgggcttccagtggagttggtttttttttttttttttttttttcagtggagttcttcaatgggtctggctttgaaatacttctatcctttctagtttaggaaagcaatggcacaagaaacccatatataagtcagctacttttttgatgtgtaattcacataccatacaatttcccatttaaaggctaaaattcagtggtttttagtatatttacgaagttgtacatccaaaaccacaatcaattttagaatattataattccccagaaaagaaacccctcactctttagccttcactcctagtctccccattcctcacacctctaggcaactactaatctactttctgtttctagagatttgtgcattctgataatttcacataaatggacaaatgcagtgtgtggtcctttgtgactgtcttcttggttcaacatgttgtagcatcaagcagcaattcatttcattttattgctgaataacattccattgcatgaatgcacaatttatttattcattcattggttgatggacattcagattgttttcagtttttaactattgtgaataatgctgctatgatttgtgtacaactctttgtgcagacatttgttttcatttctcatggagtagaattgctgggtcatgtgataactctgtgtttaatcatttgaggaattgtcaggctgttttccaatgtacctgcaccattttatatttacaccagcaatgtatgagggtttcagtttctccacatcctttccaacacttgttataatctgtctttttcaaatagctgtcttagcaggtttgtgaagggttacctcactgaagttttgatttgcattttcctaatgattaattatattgatcatctttatctgcttaatttctatttgtatattttatatagagaaatatctattcagattctttgcttatttgaaaattggattacttgtcttaagttattgagttataattgttctttatatagtctaggtacaagtcttttatcagtgacaggatttgcaaaaacttcctcccattctgtgagttttctttcttgatgttctttgaagcatgaaagtttaaaattttgatgatttccagtttatgtgttttttcttttgttgtttgtgtttttggcatcatagctaagaagtcattgcctatccaaggacatgaagatttacaactgtgttttcttctaagagttttattgttttagctcttacatttctgtctccgatcgatttcaagttaatttttgaatatggcataaagtaggggtccatctttgtccatttgcatgtggacgtcgacttgacccagaatcatttgctgaaaaggctattgttaacagttccctccctgccccatagcagccatgcatggggcaacttccagtgaggtgagtatgaggttgtggcaagcaggcctcagtgatggtggcatgatgaccatgctctggggcttcatctgtaatgacccgttcagtttcaacagcattaacttggagacacttacagaaacttacaagattcctttttacttacaatatcttgccagagtattttatcattgcagaggcatctagtggaaagttaatggattgtattgtgggtaaagcagaaggttcagtagctagggaagaatggcaccgttatgccacagctctttctgttgcccaaaatttccatatcttggtttggctgttaaactcatagagttgttggaggaaatttcagaaaggcacaagacaagggtgcctttggttggccctttaataatttactgtacccctagatagcacagggaaacaagtgtcttagtccatttatgttgctataaaggaaactgaagctgggtaatttataaagaaaagaggttttatttggcttatggttctgtaggcagtacaagaaatgtggtgctggcatctgcttctgggatgacctcagaaagcttccactaatggcagaaggcaagggagagcagacatcacattgtgtgagagaggaagagagtagagagggagtgctgggctctgtttctgaatcacttcttggctgggcatggcggctcatgcctgtaatcccagcactttgggaggccgaggtgggcagatcacctgaggtcaggagttcaagatcagcctggccatcatggtaaaaccctgtgtctattaaaaatataaaaattaactgggcgtggtgggtgcctgtaattccagctactcgggaggctgaggcaggagaattgcttgaacccgggaggcagaggttgcagtgagccactccagtctgggcaacagagtgagactccatctcaaaaaacaaaaagaaaaaaaaatcacttcttgagggacctgctagagtgagaactcagtcattatcatgaggatagcaccaagcccattcacgagggatctaccctcatggcccaaacacctcccatcaggccccacctctaacactggggatgaaatttcaacatgagattggaaggggcaaatattcaaactgtatcagtgagaaaaataaaataatatgagaattgagaaagaagcaaaacttttatgttgcatagatatgattgtacaaatagaaaatccacaattattcttatggatttattacaataaatgtttagaattaacaatgtttaagaagttggatataaattcagtacaaaaatcaattgcatttcaatatacaaaaaataacatttagagaaatatgtcatttgcagtgttaccaaaaaacattaagtgtttaggaaaaacctaacaaaagccatgcaagacctctttgaagtttataaagctttattgagaagcattcaacatgagctagctaagtgggcagatagactgcacttgtagattagatgacgtgatattataaaactggtaattctccccaaattgatccacagatccagtgtaattgcaatcaaaacctcaagtatttttgtgggatttgttaatctgattcctttttttttgaaacagtgtcttcctttgtcacccaggctggaatgcagtggcatgatctcggctcactgtagcctcaacctcccagactcaagtgatcctcccacctgagcctcctgagtagctgggactgcaggcctacaccaccacacctggctaattaaaaacattttttcatagacacagtgtcccactatgttgcctaggctgttaagctgattcttaaacttgtgaggtaacggaaatagctaaattaagacaaaatattcttttaattttttttaatatagagatggggtctccctgtgttgcccaggctggtctcaaattccttggctcaagtgatcctcccacctcagctgacaaggtattcttaaacaacaaaatgggcatacttgcccctccaaatgtcaggctataataaataagactttgtgttagcgttgtagtagttgtccagaccagtggaacagaatttgagaaacagatccaggaatacatggaatttgacatttcttagaggagaaattgcagatcagtggtgaaagaattgacttttcaaagtgtggtagaacaatttgacagccatgtgtggaaaaatttttcccagattactaccttatcatatgcacaaaaaataaattccagatttatgaaaaatctaggtgtgaaaagtaaagctaaaatgctctttaaagatagataatataggagagtgtctccatgacctcaggatagaaaataacttcttcaacaagccattgaagcaataactgtaaaggaaaagttcatatattcagtttcattgaagtgaagtcattttgttcttcaaaagatgtcataaggatcataacaagaccaaccacaagttggaagaagatatttgcaaaagcattacaacagtgtttgttggttatctggaatacatagagaagaactatagctgggaaaaataaataaataaataaatatgggaaagaccattaagtactatacaaaaagagaagagtaaatgggcaataaacaaaaactgcatttggccttattagtaatcaaaaatgcatattaaaatcacgatgcggcaccattataccatgagattggcaaaactaaaaatgtccaaagcaccaagccttggtactgtggggatggagttttactcaattctgtgagtgtaagctggtacaagcaggttagaaaacagtttggggccggctgtggttgctcacacctgtaatctcagcactttgggaggccaatgtgggaggattgcttgagaccaggagtttgagaccagcctgggccacatagcgagatctctgtctttacaaaaaaaaaaaaaatagctgggcctggtggtgtgggcctgtagtcccagctgctaaggaggctgaggtgggagggtgccttgagcccaggagttcgaggttgtgccactgcattacggcctgagcgagagtgagaccctgtctctatacacacacacacacacacacacacacaaagagaaaaaaaagaaaataaaaaaggaaagaaggaaacagtttgacactctaataaagtggaagatatgcatactcttttgacccaggaatgacctcataactgttgaccttagatattgcactatgagacgcaaaatgagaatattcatagtttttaatagtaaaagccggaaacttttaacaataggactatgggcaacttatgatatattcatacaatggaatgctaaacaacacacgaggctaagtttcacaatattaactgagaagggcaaatcaaaaaaatttaaaatataactccatttatatgaagttcataaacaggagaaactaaactatattaggtggtaaattagatattacttggcaatgcctaatttctttccatctatattaggtagtaatacctaatttattgctacttaatattgctatattaggtagcaagcagcaagaagataatgatcacaaaagtgaagaagtggagacctcttggtgagggaggggaagttgatgactagagggacctgagggaggctacctttgggccatggccacatgggtgcttactgcagtctttaatttgtacatatggatgagaacattgtatgtatgctatgactaatctataaaatgagcatatcaattactgcaacataacatatagtaatttttaaaaaccaagtaacagaattgtggttaaaaactacttttttgagtttatcttttaagaaactatatattatagattgtgaaatattagcatgaaaacaagaaagtcatgtttttatgctgcaaaataatggtcacaaatcctatgtaataaaaattgatattgtgatgtaaaacaaaggctattattttctcactggatttttccccactgttttagcacccttgttgacaatcattgactaaaaatatgaggatctggactcttaattgtatttatctatacttatgccaacaccatattttattgtcttgattaatgttttgaaattgagaagtgagtcctccaactttgttctggttttcatgattgttttggatattctgggtcttttatagttctatgtgaattttatgatcaactcattgatttctgcaaagaaaagtaagattttgatagggattacattgcatctgtagatcaattaggggagtattgtcatgttaacaatatcaagttttctgattcatgcacatgggatgttttcccatttatttaggtcctctttaatttctttctgcaatgtattttagttttcagagtataaattttaggcttattttattaaatttattcctaagtatttaatttctagcgatgctattgtaaatggaacagtgttcttaatttcatttttggtttgtccattgctactatatagatataaaattattgttggatattggtcatgtatcctgcaaccttattaaaattgtttattagttctaataaatgtttactttattccttaggattttctatatacaagatcatgtcatctgcaaatagttttacatcctcttttccaactggggtgcctgtatttccttatcttgcctaattggcctacctaaaacttccagtacaatgttgaataaaagtggctagaaaaattatccttgtcttgtttctgatctcaaggggaaagtatcattctttcaccatggagtctgatgttagttgtgggttttttctagttattctttatcaggttgaggaagtccattctccttttttctttaagctattgattatcaggatggatttaggtggtcttgctgctttggaaattgtagacttccttcttaaagcctgctccattttatccttctaagatatgcatgattttggaaagactacaagcttcccagttagaggagggccttcttgtttttcaccctacatacaatgagcctccttgttggatgccaaagtaaggtctttacatccttcattccctacagaccaggcttcttaaattatcaggccacaggtaacaaatatatttcatctcctgtaccaattctgatgttttggtagtagctgcccgaaggattgttaagaaggaatctgaggccaggcacagtctcagtgctgtcattaattagtgttatctggcctggtgcactggctcaggcctgtaatcccaacactttgggaagccaaggctggcagattgtttgagctcaggagtttgagacctgcctgggcaacatggtgaaaccccgcctctaccaaaaaatacaaaagctagctgggcatggtggcacacgcctgtggtcccagctactcaggaggctgaggtgggaggattgcttgagcccaggaggtggaggctgtagtgagccgagatcacacaactgcactccagcctgggttaaagagcaagagcctgtctcaaaaaaaaaaaaaaaaatgagtgatatgtgtcactggtctggtagtagggaaggctgcaaattgatacaacttctggattagactgtgcctgtgcctcaaccaattccagtggcctttttctcagtgccctccgtactccttcaacaacattaaatcttatggtccatacccctttgtaccaccctctcttctttagatctctgttacaaagcaatattctgggtctcctgtaaagtctctggccttccctcccccgacttttcccctcaacatatctctctagctttctcaactgagcctttgatcctgtgtactgtttgcttgggatattttgcccttcttttacatctctccttgctgaaaattgtgccattcttcaaggtccatctcaaatctgcttccctggttttccccatacctgagagactgttctgcccttaaactgccaaggcataggatatttgggtaccatacctagaattgttttccttcatgtacttttctgagttcctgcccagtactgaaaatatgaaattttttaagtccaggcagggactttatattcttagcatatgactccctgcttttactatggtggatgctcaataaatgtttggtccttttaaactctttgcttgctgtctattggaatgattatttttaagatttcatgttatttctattataggctcattagtaatgctctttattttgtgtttttcctggtgtttattccaggacatacaatatataacaatttagtattagtacacatatataactaggttatatattgctgcatgacaacctgtcttcgaatttagtggcttaaaacaacaaacatttattatctaatagttttagtgagttaggaatctaggcatggctttgctgggttctctggctcaaggtctctcacaaggctgcaatcaagatgttggctggggctgcagtcatttcttctgaaggcttgattgagggaggatgcaattctaagctcatgcatgtggttgttggaaggattcagttccttgtagtctgttggactgaaggcctcagttcatcactgactgtcagctggaaacccccatcagttccttgccccatggaactctgcatagggcaatttgccacatagcatctattttcatcagagaaagtgaaagataataagagagggtgaacaagagagaaggcagagtctttttttttgtaccataatcttggaagtgacatcttagtacttttgcgctattccatttgttatgagtcattatatccatcacccattcaaagggcaggtattacacaatgacatgaataacagatgttgtggatcattggaagtcatcttagaggctgcctaccataacatccttctaacttttaatattctaccttgaaataataatataccattttagatggtatattattcatgtgaaaacctataacaatatattttaattttcctcttctcagcctttgaactacctttctcatcatttttctacatatgttataccacatatagtacaatatagtattatttaattaatttatttattagagatagggtcttgctatgttgcctaggctgtttttgaactcttggcctcaagcagtcctcccacttcagcctccaaaagtgctaggattataggcatgagccactatatctggcctattatttttgatttaaataattatcttttaaagagattttacaaatgagaaaccaatatttaatatttatgcacatttttatcatttacagtgttcttcattcctttttgtagctccagcatcccatctggtgttattttccttgtgatgaaagaactttattatttcttatagtgttggtctccttgcaatgaattctccctcaaaaaaggaaaaagaaataagaagtgtaagaattgatagggaagatataaaactatcattacttgcagttggtatgatcatctgcagaagaaaaacaagataatggatagaaaaaatgataaaaactaataagaaaatgcagcaacttataaaaatcaatagcgtttctctgtaccgatgataactgatccaaaaacagctggacttctggcagtaattttctcagactgctcccttatttcacctaatttttgaaagacagttttttttttctgtaaatagaatgataaggtgtcagttttttctttcaatacttcaaagatgtcacactattgtttttggtttgcatagcttctgatgagaagtatgccatcatttttatctttgttcctttgaacaactttcacattttttcagtacttagataatgatttgctatggtgtggttttttccttttatttttggcttacagtccattgaaatttttagacttgcgcatttatagttttcataaaatttgcaaaacttttggtcctttttcttcgaatattttggtacttcattgaaccctgtggtgtttcccatagctaactgatgctctgttctgtttgtctcagtcttttttctctatgtatttcattttgaccagtttctattgctgtgtctttaggttcattcatcttttcttccgcagtgtctattgtactagaaatcccagcctatgtatttttcattacagatactgtatgtttcatgtctagatgtttgatttgagtctttcctgtaccctccatgtttctacttaacatgcccagtctttcctctagctcccctattaaatgggagcatatatataatgactatattttaatgtccttatatgttaagtctataatttgtgtcatcttagtttgtttctgttgattgatttttctccatttaagagttgtatctttctaattctttgcatgtctgataatttttgattggatgttggacattatggattttatattgttgggtgctttattttatcatatttctttaaatactattaaactttgaaccagcatgcagttaattggaatcagtttgatccttttgaggcttgatttttatgctttcttagggtagtatcaacgtagcctttagcctgcagctaattttatttcactaccaagacaatacacttttcagggctctaattattgccccatatatcacaaggtctttccattctgctggtaggaacacaaactgttcctgtgtctttgtgagcttctggggactggccctcctactttttctttttttagcaattcttttattggtcttgggtagtttcctcccatacgtatgccaatcagtactcagccaaagacataaagggatccatctgaagacctccagagctctctcctatgtagctctcttctctctggaactttttcccacaagttttaattattttggcctccctcttccctgatttctgtcttctcaatgcaggaaatcactgggctgtttgcactgcatcgtggaaagcctctccagtcagtaagctagggaagatttaggggtgcctcacttgttccccttctctgagggctagcaatcttgtactgactgttgtctagtgtctgaaagccatttttttttcatgtattttgtccagttttttagttgtttaatctgattgcttttactccatcatggttggaagcaaaagttgttaatacgtttttgtgatgccagactgaactttcattgtttggctattcaagggctaactcttcagcttattaaaatgcagagaagcttatatatatatatatatatatatataaccttatgttgataaagagagcatatatgacaggacacctttttttcaaactgagtagttagtagaagcatctagaagagaaaacatttggttttctaaactattaggaagatattaagccatttagggcagtgttccccaatcattttggcaccagggaacagtttcgtagaagacaatttttccacggacagggggaggtgggggatggtttcgggatgaaactgttccacctcagatcatcaagcattagattctcatgaggagcgcaacctagatccgttgcatgcagagttcacaatagggttggcactcctataagaatctaatgacgccactgatctgacaggaggcggagctcaggcagtaatgcttgctggcccgctgctcaccacctgctgtgcagcctggttcctaacaagccatggaccagtacccattcgtggcccagggatggggacttctgatttataactttgagtcactcaggctaacagcatcatggttaaggggatatttagcaacagaaataaagtgacttttctgagagtatgcaatgactccattcgccctaggtccaaaatgatgagaattgaaacacatatgttactaagattgtaaatggaagagggcggagggaggtggtgaacatcagcatagggcagaagttgtcacatccacactttcttgtatgtcccctattcctggagctgccttccctatttttttgcatgtctaaagagcaagtcatatcactgatctctgaataataaaagttaccatttattcagtgcttattatgttccttgcactgtgctaagtttatatattatctttcactgaatcctcacatctgcctatgaggtgggtgctattactattaccattttatagatgaggaaattcagatatagagaggtttaattatgtacttaaaggctatacagattagtgattggctgagctaggactagaacccaggctttttgactccatactctgtacttttgccttcatgtctccacctgagttgggatttcctgttcttccaaatcaatctcggcattatttagcactgaccacgattctttgcatcccttgcccccgctccccccgcccccagcacctccaagtatctattttaggcgactccagctcaggaagagcctcgatgttactcggcaacaggtatctctcaacctctaaaatgttccaccttctgatagaattccaccttatagttttgtcatgttgcttccttcaacactagatggtggacttcctcattgtctcctgattagaccttaatcactgctgcctttaaatgtcatgttccttcaaagctcaagacttagttggctctttcagttagtctttcctgatggatcacatgctgtcgaaatccttctaatgctttgaattatcagcatttaccttggatttggttagatggtctttctgactttctctgagattctctggtactttgaatctctttctagatgtttatgacatagcacccctatattcatattataacctgctcaaaattcccaatcatagaatatttactgagttcctaatatgagcaaaacactgattttaacattgcccttctcttttgagacaatcagtgtttccactgtttaatttttaattttttgtgggtacatagtagatatatgtatttatggggtatgtgagatattttaatacaggcatgtaatacgtaataatcacatcatgtaaaatggggtatccatcccctcaagcatttaccctttgagttacaaacaatccaattacactctttaagttattttataatgtgcatttaagttattattgactctagtcaccttattgtgctatcaaatagtaggtcttactcattcttttttttttttttttgagacggagtctggctctgtagcccaggatggagtgcagtggcacaatcttggctcactacaagctccgcctcctgggtttatgacattctcccacctcagcctcccgagtagctgggactacaggtgttcaccaccacgcctgggtaatttttttgtatttttagtagagacgaggttttaccgtgttagccaggatggtctcgatctcctgacctcgtgatccacccgcctccgcctcccaaagtgctgggattacaggcatgagccaacactcccggctcattctttctaactattgtttttgtacccattaaccatcctcacccatccccagtcccccacttcccttcccagcctctggtaatcatccttctactctctgtctccttgagttcaactgttttgacttttagatcccacaaataagtgagaacatatgatgtttgtctttctatgcttggattaattcacttaacataaagtctttaaactcttcatgtttattattcctccaattatttaatatgaagatctgcctggtgacagtattggagtgacgctcctatagaaccaaaagaggcacctgagttgcagttttcatcaaagtcatgtagtatacaccataggcattcagagtcactgtcagtccattgataagatgtaaggcaacagattagaacccacagcccagtgtcagcaagcagaagtgatgattgataccagtgagaggaaatagatgaactaacaagtatggccagctgccagatagttgtttatatgtcagtatcatcattgagcatcacattatcataacctagtacagtaatagatattcctaaagactgagacaaaatgcatataaagccctcatctaatgcctgacacgcataaagcacagaataaagtgtgtgtctatgtatatacattttatatatacacacaaatatacaaatgaaaaggctaaattataatcattgtattttatatatatcatatatatgtgtatatgtatgtatatcattatatacattgtaccttatagaagagaagtatacatgacattttagaatgatttccgtggaagtagctagaattaaaaaatatttttcgtttattgagaagtactttcagttatcacagtgcaacactgctttctgtaatgaggctagaaaaatgaggagccattgtatttaataaaataagaattttttctgtctccatggtaagattaacgaacacacttcaacataaagtaatacaattgctaccttcttcctggtggcatgctccctgtgttaaatttaagtgacagtaaaacgtaatgagttagaggagaaaaattttaatttattcgtttatttgaatagggaaacccaagagatcagtgatagaatttgaactgcgagacaaaaagaaagaagaggttttagttttgtagctaaaattaaggtggtggcacttgaagtgaaatttaaaaatacacattcacttagttttcttggccatattctgcttctcatgtgaaactggacttcctgccttttagccttgtattctgtccctttggaaactgtatcatcttttaaaaatgaagtacgtgactttcgtaatgatcttttatattataaaaataggccgggctcagtggctcatgcctgtaatcccagcattttgggaggccgaggctggtggatcacttgaggtcaggagctcgagaccagcctggccaacatggtgaaaccctgtctctacaaaaatacaaaaattagtcggacatggtggcacatgcctgtaatcccagctactcaggaggctgaagcaggagaatcacttgaaccccagaggcagaggttgcagtgagctgagattgtgccactgcactccagcctgggcaacagaacaagactccatctcagaaaagaaaataacatcaaaataaataacataacataacataacataacataacataacataacataacataacataacataacaataggaatttcaaaaaatctgaaacccgggcctggcacagtggctcacacctgtaattccagcactttgggaggctgagacgggtggatcacctgacgtcaggagtttgtgactagcctgaccaacatggtgaaaccccatctctactaaaaatacaaaaatcagccgggcgtggtggcgcatgctgtaatcccagctactcaggaggctgaggtacaagaatcgcttgaacccaggaggtagaggttgcagtgagctgagattgcgccattgcaatccagactgggcaacaagaacaaaacttcgtctctctccccacctccccccccacaaaaaaaaaaaaaacctgaaacccatcatgactatatcatgatgctgtagcctcaaaatggacttcacaagttcacctgtgattccctcaaaagcacttgagttttgatttgctgattgccagaagtgtatttgaacagtcccactttatatggagccccaagcatattaaatggagattccagataattagtgagctctggatgaagctcctgggatgcagtggggaaaaaactggatctggagtgttaaggtttgggctctgggcctgactttttcccttatcatttggaaattaggctcaggattgtgtattggggaaacacagcaagctgtatgcctatagtaaatagacaccctgtttagtggcattcaatagacctcaatgccatattcattcttccccaaccctatctgtcttggcttcaggcagatcttggcatagggcaccctcatcctcccccactgccacctagctcctgggtgaatgtctcccagcctgggaagagttctgttgaacttcatgaacaatgctgtctgcctagcattggagctcataccctgagactttgccttagtcctctcctttgtgcccagaggcatacatttgagagacagtcaatagagccttagacccctaactttgcacatataagtcctatgaaccatctgggccactcactctgcttagagcaattgcacactgctccctctcctttccttccatttacatctacagggagatttttagtttactaagccctggtaaatgacagttactaagatgtaatacaaatcttaacagtgggaacagtgactactgtttatcacgtgaatactataagtcaagcacaacaaccctttgtggtgctgctagagttaaggaggcatcctcagaggttgaggaatgtgcccaacctcagatgctagcaaatggtagagctttgttcagagtccaggtcctcattctaccacatctcactgcctctttatgttctgatgtctctactgtgtatatcaatgcttctcaaacgcagtatgtacacagttggccctctatatccgtgggttccacatttatggattcaacctaccacagacagaaaatatttcaaataaaaagcaataaaacataacaatacaacaataaaaataagacaaattttaaaagcaatacagtgtaataactgtttatatagcatttacatttattggatacgagaagcactctagagatgacttaaagcatatgggggatgtgtagaggttatacacaaatactttgccattttatttatttgtgtgtttgggtttctttttaagatggagtctcactctgtcacccaggctggagtgcagtggcacaatctcggctcactgcaacttccacctcccaggttcagatgattctcctgcctcagcttccggggtagctgggattacagacatgcacacccacgcccaactaatttttgtatttttagtagagacggggtttcaccatattggccaggctggtatcgaactcctgacctcaagtgatcaggctgctttggcctcccaaaatgctgggattacaggcgtgagccaccatgcccagcctgtgttgccattttatatcaggctcttgaacatttgtggattttggtaccacagggggtcttggaacattgcaatactctatgaatactgagggacgactgtatacatatcacctgggaatcttgggaaatgcagattctgatcttgtacctctggcatgaggccttgattctgtgtttctatcaagttccaaggtgctgctgctgctactgatccatggaccacattttgagtagcaagagtgtgcactatcagaaatacaaggggagtcaagaatcttataaccggattggacatttttaacaaaaatactgttgaaaatttacaggataaatttttgaacattttgaaagaacaaaatgttttatcaactagaactttgcttcattttcaatatggtcttcaaaaacaaaaacaaaaaatcaaaaccacaatgagataccatctcacaccagttagaatggcgatcatcaaaaagtcaggaaacaacaggtgctgaagaggatgtggagaaataggaacacttttacactgttgctgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttgttgtggcactattcacaataggaaagacttggaaccaacccaaatgtccaacaatgatagactggattaagaaaatgtggcacatatacaccgtggaatactatgcagccataaaaaatgaggagttcatgtcctttgtagggacatggatgaaactggaaatcattattgtcagtaaactatcgcaaggacaaaaaatcaaacaccgcatgttctcactcataggtgggaattgaacaatgagaacacatggacacaggaaggggaacatcacactctggggcctgttgtggggtggggggagtgtggagggatagcattaggagatatacctaatgctaaatgacgagttaatgggtgcagcacaccagcatggcacatgtatacatatgtaactaacctgcacattgtgcacatgtaccctaaaacttaaagtagaataataataaaaaaaaaaataaaaaaaacttttgttctttcagttaacatttttttttttttggtaaacatttggataaggaaacctgcttatccaaatgtttaccaaaacagtatcatccagatgatgacagttttgccccacttgctgaattcagcttcacattgctgacactctaagcaggggtctttgaatgtgcttcgggagattcacacttctcctccccatgatcatatacacagtcattcatatatgtttctttgtacatgttctgaggaagaatcggaactgttcatcacattctccttggacttgcaaaccagtgctccaggagaaaggtgcactccttctaatggttctggaattccccatcaccaaatccttgaccaagaagaatacatagtaatatatgcaatttatttgtatcaggtgctatgagttctcaggctgctgactacataattgaagcccttggaaaatgccagttgaatgctataattaggtaaaaataaatgcactaggccttttagataactttccagatgattgtcagccaaagcccaggcagaagtagtccctaatttccctagagctgaaagtcagtgaccttcagcttcccttttccacccttgtgattgtcattagggctgtgcatgtagcaccctcagccagcaatacggtagaagtgaggctcatcgttacttacctaggtctctgcattttcaatatctatctgcaaaatgagcttgatcaatatttaattattagtcaccaggaggtaattagagttacagaaaccaaaaagaatacatatagatgagctcaaggtgttctgagcacaccaaaccattctgacgattcaacatggaaacagctctgatcccaataatagccatagaagcctacctttaaaacccatccctgctcatttttattaggttggtgcacaagtaattgcgggttttgccattacttttaatggcaaaaactgcaattacttatgcaccaacctaatgcatttccatcattttcatagacctgagcacttatgagccatggccttgtagtcagactgcatggattcaaatcccaattattccacttaatagttgtatgaccttggtacattattgtcctctctagtctcagtttcttcttcctgcaacataagaataatgatgctaataataatagtgatagatagtactgctctcatggggtagttttcagattaaatgaaatgatctatgtcaagcacacagccaaatgactggcacatagcaagtactcactaaatgctaactgttgttattactttctaggccaaaaacaatatgtcctctttaacaggagcattgggtacaaagagttactgttgcctatgaaccttaactctttcagttagtggaggagaaattaaaaatctttgtgttatctattctgttcccttggtctttgtgcctatttttatactagtaccatgttgttttggtgactgtagccttgtagtatagtttgaagtcaggcaatgtgatgcctccagatatgttctttttgcttagtcttgctttggctatgtgggctaattttaggattgttttttctagttctgtaaagaatgatggtggcatttatctatcatcgtctttccttccacccagaacatcagagctagttgctacttacttccacattgcctctctgtttctccaccttcctagctttgatgatctgcatttctgctccattgtacttccctcacatacccactaccaaggtcacatatttaaccttacactttcgtatgtggatccactcctaagacctcaacctctgactacattcatcttggactacatacatctcttcctttctcacctcagaatctgctcttggtattcccaggactcattgatcttcataccgttccctttgacccagtatagaagcttctccctactttcagccacttccccccttctcttgccatggattcacactctcctgtatcctgcacaccattgccagtcatttcaacagatgactcataattccaaaatccctcaacaccataatcttatatcattcttgatttaatccccagcataatctctctgctcttgaagtaccaagtgttggtggaaaaagttgcaaaatgatgctcattgggtacacagatcagtagtactttctgatcttagctgggccctccctactgcttgaatgctctcttggatgctcttgtattcctctcttgccatcttctcagagaggcaggatggcacagcagttaatagcccaagcacaggcaactgatgagacttagacgctgaaatcctgggtctgctacttgctgcctgtatgattgggaaaattgatctaatcttaggctttagttttcttcacctgtaaattgggattgctcctcaccttaggggattgcttgtgaataccaaatgagatcatatatggaaagcacttataacacagtgaatggcacacgaagtacaaacacacacacacacacatgcacacaagcacatacacatcagctctattgaggtatgaattatataccataaaatctaccaattgtggcaggacacgttggctcacacctgtaatcccagcgctttgggaggccaaggagggcagatcacttgagcccaagagttcacgaccagcccaagcaacatggtgaaaccctgtctctacaaaaaatagaaaaattagcaggacatggtggtgcgtgcctgtaatccagctactcgggaggctgaggcatgagaattgcttgagcccaggaggcggaggttgcagtgagctgtgatcatgctgttgcactccagcctgggcaactgtaatgaaactctgatatggtttggctgtgtccccacccaaatttcatcttgaattgtaactctcataattcccacgtgtcgtgggagggacctggtgggagataattgaatcatgggggcgggtatttcttgtgctgttcttgtgacagtgaataagtctcatgagatctgatggttttataaatgggagttcccctgcacaagctctttattgcctgccaccatgtaagatgtccctttgttcttcctttgtcttccaccatgattgtgcggcctccccagccatgtggaactaagagtccattattaatctttataaattacccagtctcgggaatgtctttattaacagcatgagaacagacgaatacaaactctttcttaaaaaaaatctaccaactgtaattgtacaatttaatgattttagaatatttatacagttgtgcaattgtcataatctagttttagaacacttccattaccccacaaaattccaatgtgcctgtttacaaacaggcaattgtagtcaattgccattttcactcttgacctctggcaaccactgagtgaaccactttctataattttgctttttcttgacattcacataaatggagccatataacatgtagtcttttgcatctgacttctttcacacattataatattttgggggtttgtgcatgtggcatcatgtatcagtactttattccttttgatggccaaataatattccattttgtggctataccacattttgtgtgtccattcatcagtagatggatatttgaattgtttcctcagtgtttccaattgtgaataatgttgctatgaatatttgtatacagctctttgtgtggaaatatattttcattcctcttagatctgtacctaggagtggaattgctgggttatatggtaagtgtgtgtttaatttttaagaaactgccaaagaatgttttaaagtgtcagtaccattataccttctcaatagcaatatatgagattccagtttcaccacattctcaacaatacttgttagtgtctatcttttattacagtcactctagtgaatgtacagtggttctccttttgcttttaatttaatttccctgatgtctaatgacaattgatggcatatacttattaaacattcacagatctcctttgatgaaatgcctattcaaatattttgcttataattggtttatgttctcattattgagttgtaagagctctttatatagtatagatacaagtcctttatcagttctgcccataatgaattctctcagactttgtttatctgggaatagccttattttgccttcattttcaaaggacagttttactgcatgtagaattattggttaccttttttcatctttcagcattttttttttttgagacagagtcttgctctgtcaccaaggctggagtgcagtggcctaatctcagctcactgcaacctctgttcccaggttcaagcaattctcctgcctcagcctcctgagtagctgggactacaggtgtgtgccactacgctcagctaatttttgtatttttagtagagacggggtttcatcatgttggtcaggctggtctcaaactcctgacctcaagtgatctgccctccttggcctcccaaagtgctgggattacaggcgtgagccaccatgcctggccctctcagcattttgaatgttactccactacctacagcctccattgtttcagacaaaaagagcattaattgtattgatgctctactgtacataagaggcttttttctgttgtttctttctagatttttctatcctgtcttctcttttttgtttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtggtgaacatatttataagaggtcttttgaagttctcatccagcaagtccaatatatggggacatccagaaactttattgattgctttgtttttcctgagcacatctcacttttctgtttctctctaattttttgttcaaaactcacattttacataatatattgtagcaactatggattctggtgtttttcctctgatggttggtgttgttgctgtttttctttgtttgtttgtttgtttggtagtttctttgtttattaacttgcctgatctaaatatgtgaattatgtctcccacatcgtgtgtagcccccgatgtctgtgctcagtttttaaattcttgttttttatttttaagcatggctttctattggttcttttctctgtctgtgtagtttagtgtacagaggctgtgaccaaacatcttgtgccattaaggctactatcttctgttggtgggtctgtgtttggtagagttgctcattcagggtttaagctattttcaagtctgccctggctattactttctactgggccatcttacatcatatgtgttctctgtaagttttagttgttatgattattatgactgtatattctttcctctcagcagttgtaccaaaggcttttttgctctccagtagctctcctttctagcttcttcaatctcagcaggtgaccctccttcttgctttctgaaaagatgtcggccacacagtatagaacccatgacttccgatttcattttttttattgagatataatttacctaaggtaaaattcaccattcagagtacacagctctgtgtgactgttagtataatcacaaagatgtacaactaccatcactgtctgattccagaatgttttcatcacccagaaataaaccctgtgcccattagcaatctcttctcatttctgtttcccaccaactcctggataccagaagttgtagcatgaatcattgcttcattccttttcattgctgaataatagtccattataagggtagatcatatttggtttatctgtttatcacttgatggacattggattggttccacattttttctgttgtggataatgctgctatgaacttttgcatacaaattttagtgcagacatctttttggttctcttgggtttacacctccccactttatattttatttaatgtaaagtatatattataataatgttgttacttacttctcattgttgaagaattaccttctacgccatgaagaattcttaaattttattcccactctctatcaccacttgcaggaccttgctccaacaatatcactcctcatcagtatctctcttcttgctcccacagtatctctccttaccagtcatttcatcttctcctctgagtccatgctgttagtctacaaacatgatctgatatgtttgatcccaagccttcagttacctttaacacttcccatcattcttcttatctaattggttgccaaatctggccaattttatcttcaaattaattttgaaaattattttgtactcctcttccacattcctaccagtcaaatcactctctatgccccagattagacacagttactcttttctctatagcactttgtactttgtgatggcacttagtgtcttgtggaatagtcatttttgttttagttgtaatttgttaatttcctcctggctgcaagaataatcttttattcttactcattcttgcatccccagagcagcctagcattggatcagagcaaaggagtagcactcaaaacatcataacatctgcagattgtggtttaatttggactttcaaatttattatttctcatggtctctctcctttccatccttcatctctctccctccttctcttactaccattgtatataaaactaatttctatttatatgtatcttgaatggtgtaaggtcagagataaccagtttcacacatgtttgtgtctttccacagtgtcagacttttattgatgctatttcaatcacaaaatccatgagccacatggagttcccaaggaggcaattctccttcgtacttcccattcactcggaagtcagagccatgccacagaggcacaagccactccataagtcagtcaatattgcaaaccacacaaaacagtacatttcatctatatatatatgttacagattgaacattccacaacaaacaaattaacatttaacatcaagagaaagaggataggaaaaggggttaatgaaccagtctaggaagacagatatagacaaaaagaatgtcctggtctggaccagctggtttgtcaattttgcaaggaaaagtctcatgtgggcagagcctttggtggcagatgctgggtgcttatcacgagtgaaagcaagacggtgtcagttaagacagccatttggagctgctgaagtcctgctccttttatggccacagagtcctctggtgaggactgatagtggaaaagtatgcctatgtccttatctggttggttgcagtctttatttattaagcaaaacatcttgaccctcttaaaaaagtgccctatgaaatgtaagatggagtctttttctaagatggagttacttatgttaagggcgctctgtacaatatatgcttgacatatgttaggcactcaataaaaagctgttggttaacgcaataaaaaatggtaaaggagatatcaccaccgattccacagaaatacaaactaccatcagagaatactataaacacctctacacaaataaaccaaaaatctagaagaaatggataaattcttggacacatacaccctcccaagactaaaccaggaagaagttgaatccctgaatagaccaataacaggctctgaaattgaggcaataattaatagcctaccagccaaaaaaagtccaggaccagacagattcacagctgaattctaccagaggtacaaggaggagctggtaccattccttctgaaactattccaatcagtagaaaaagagggaatcctccctaactcattttatgaggccaacatcatcctgataccaaagcctggcagagacacaacaaaaaaaaagagaattttagaccaatatccctgatgaacattgatgcaaaaatcctcaataaaatactggcaaaccgaatccagcagcacatcaaaaagcttatccaccatgatcaactgggcttcatccctggtatgcaaggctggttcaacatatgcaaatcaatgaacgtaatccagcatataaacagtcccaaagacaaaaaccacatgattatctcagtagatgcagaaaaggcctttgacaaaattcaacagcccttcatgctaaaaactctcaataaattaggtattgatgggatgtatctcaaaataataagaactatttatgacaatcccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcgtctcagcccaaaatgtccttaagctcataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcaaggaaataaaagaggacacaaacaaatggaagagcattctatgctcatggataggaagaatcaatattgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaggctggaggcatcacgctacctgacatcaaactatactacaaggctacagtaaccaaaacagcatggtactggtaccaaaacagagatatagaccaatggaacagaacagggccctcagaaataataccacacatctacaaccatctgatctttgacaaacctgacaaaaaccagaaatggggaagggattccctatttaataaatgctgttgggaaaactggctagccatatgtagaaagctgaaactggatcccttccttacaccttatacaaaaattaattcaagatggattaaagacatacatgttagacctaaaaccataaaaaccctagaagaaaacctagacaataccattcaggacataagcatgggcaaggacttcatgactaaaacaccaaaagcaatgacaacaaaagccaaaattgacaaatgggatctaattaaactcaagagcttctgcacagcaaaagaaactaccatcagagtgaacaggcaacctacagaataggagaaaatttttgcaatctacccatctgacaaagggctaatatccagaatctacaaagaactcaacaaatttacaagaaaaacaaacaaccccatcaacaagtaggcaaagtatatgaacagacacttctcaaaagaagacatttatgcagccaaaaaacacatgaaaaaatgctcatcatcactggccatcagagaaatgcaaatgaaaaccacaatgagataccatctcacaccagttagaatggcgatcattaaaaagtcaggaaacaacaggtgctggagaggatgtggagaaataggaatacttttacactgttggtgggactgtaaactagttcaaccattgtggaagacagtgtggcgagtcctcagggatctagaactagaaataccatttgacccagccatcccattactgggtatatacccaaaggattataaatcgtgctgctataaagacacatgcacatgtatgtttattgtggcactattcacaatagcaaagacttggaaccaacccaaatgtccaacaatgatagactggattaagaaaatgtggcacatacacaccatggaatactatgcagccataaaaaatgatgagtgcatgtcctttgtagggacatggatgaagctggaaaccatcattctcagcaaactatcgcaaggacagaaaccaaacactgcatgttctcactcataggtgggaattgaacaatgagtacacttggacacaggaagaggaacatcacacatgagggcctgttgtggggtggggggaggggggagggatagcattaggagatatacctaatgtaaatgatgagttaatgggtgcagcacaccaacatggcacatgtatacatatgtaacaaagctgcacgttgtgcacatgtaccctggaacttaaagtatagtaataaaaaaaaaaagaaaaaaaaagttgttggttaaatagtctctgctaaatttgcgacacatcttcccagataagattcttctctccgaacctttttttttttcctttttttttttacacagagtctcactctgccatccaggctggagtgtagtggctcgctgcaacttctgcctcccaggttcaagtgattctcctgcctcagcctcccaagtagctgggactacaggtgcatgccaccacgcccagctaatttttgtatttttaggagagacagtgtttcaccatgttgaccaggctggtctcgaactcctgacctcagttgatccacccaccttgacctcccaaagtgctaggattacgggcatgagccaccgcacctggcctctctgaacttttttaccagtatttattttaattttggttgggggcagtagagagatgcagaaaaggaaaggaaggcatgaaactgcttgagaaatacatcagtgaataaaagttttttaacatttgtggtgtaatgacaaatcctggagaagttttagttcacacctggagtattccagcagaagttggatgccagccgctaggcattcattctgcagaggggcttctctgttaggtacaaggttgggttcaagtaccttctgaagtctagctcagtgtattttttggagtgtagtatactaacaggcaagaacaagaagtggaggagatgtgccaggggaggaatagtgatgacgttgtaggtgctcagctcccagatgatgggaaaagtgtttcatggcctcacacatcttttgggttttttgttgactgtctcccccattactcaatgagctgctacagcatagggaatgaatcttcaacttgtatttccagtacccagaacagaggcttgtactaagaaggcattcaattggtatgtaatggattagaataagttgaattgaagattgaactgaagtcaaaatctgatttctaaggttccttctggcctgaaaattcagactcctctgatttcaaccataacagcctggctaagcctccttgagagaaaccctgtgcttccttagtttaaccacctctttgtggttgaatagtataggttttcaatcaagtcctaggagggtgtcagtttcttgttgtacttaccaggatgtgataggatttcaaacaaggcccaaaagaatgtattttcaggagttgagatgtagccacactttctacatttacaatggcctgaaatgggttacagtttagaacaagctttcttctttatgatgcacaggatttctatgatgggtggctgttaggcaatgagtgtgatgggggagcattttcaatcttagctcaccttagcacaccttagcacaggactctagttacagggtcataattccccatgaggttagcccctgtagtatcagctactttgtatgtgatttaagccagtactgattattctcctgcttagggagaagcggtagaaggcccttggaactgtgagttttgcattccaacttgctaattcaacatagatcctaattccttaaatgcttgtaattagaaattctcgtgaactgtattggtttttgtcaagcaatctgtttggggaacttgaccaactggggcactgctggctagggtgaaatttatttaatttgtttttatgacattcttcatcttggaaatggggttttcaaatattgctttcccaggcatcattacttatttgctggtttttatttcaggattgggactagctcagggtgccagggaagcgttttgtggtgctctatattagagtcgtaatatccaagaaaattgtctgattgtatgtggtatcttggatgtggtaccttatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaatctctgttcactttagaattcacattgaacatgagctgatccaattgctacagccttggcagtgatagaggcaggagacagccaaatccctaggcagatagggaaaggtccccggagaatctccgacctgccccacaagtgttgacaccagatgttttgtgcagataagggaacctgcacagggggcttgcctgggcatgcccacagcatactggaggcccactgggggaatgggatggagccactaggagttcacaccttatgcaggggtggagcctggcctcatcagttcttgtgtggtggccctggtattcaattgtgagggggaaacctgcttggaggacccctctccttactgagagctttcttttcacttaataaattctgccctcttcaccctttaatgtgtctgcatgcctaattcttcctagtcatgagacgagaacctggatttaactgagccagggagcagaaactcctgcatcagtagcaattttacaactgtttattaaggaatacatcttgcccgaggaggttttatattgtatccctcaaatggctattttcccctcctccgtttaaatatttttactcaagtggtttccttcttttggaatgccagtcaactccatctcctacttgatttccaagaccgtctcctccaagatgcctctcctgtctcccctttccatacaatagaatttatgggtttatcactgttagtaccaagggcttcatcatctgctctcttatgttccctgcttgtcaaggtgtagcttattgtagggttcaatgagctgctagccactgtcccatttgactagcagatgcttgagaaaagcaagtacacagtttggattcgatcctacagtgtcttacatagttcttggcacctgcatgtttgctctaggaacaaccttccttattataccgagctgatccttttgggcagcattcattgagtcaaatggcctgtgtgaaacggggtctgaccctaagtggacagagctgagaggttagagctgaaggactcaagccccagacttgctacagattagtagggtgacttccagttacttcagttttctgagtgtagtttcctcattttaagctttgtaaatattaatatctggcatacataatttgaaaaaatgctgtaaggattagaagaacgaatatacgtgcaaacctttaagaaattataagtgcaaacacacgtagtacatttccatttttagagcttcatttttttcttatctgtaaaatagacatgtaaatgcctacctttcttattgggttattgtgaggattaagtagaataacatatgtggaagtgcttagcaaataggaggtgtttaataaatgttgcctggatatgaattcccctctcgggactgtcctgatgtgaggcttttccagcccttgggggatgtgcatttaaatcaggctgcttgtaccttggattaggcaacttaaaaaaagtgtagccttgttagttccaacttctcagctataaaatgcagagtaattaaatttgctagtaaatgtttccaggcctttgaatggcagccaataaaaaggactaaatattattcttttagaattcatgtccttgatgtagaggaaatatcatatttacttacacatactcctgccttggctttttagaagaaaactaagaaaaatgttttcccctctacatttcccacttgaaggtgttatctgtattgaaacagcaatgacagctgccagcaaaggagtgtgatttttctttgccaaggtaaaccaagggttaacatcaaggagtgttggggcccctgctggtgggctggaaccagagctaattccttagcagtcactcactcttctgcctcttcagctgtctctcacccccctcccaccataaaggagtgggtgttccttcaggactgtgcactcgcctccctccctctatccctctttttcccacccacacatacttcccagaacctctccaccctgtggctgatttatctttcctgggaccaaaggcaataaagcctcaaaactaaaacttgcaaggaaagacaatcctaatggtaaacacctaacccgcaatgctgattacttgaaaataagctgttattctgtctccagatcacaaatagcctcacttaaagctctacccctgaaagaactactgaaagattcaggaaggtcaggagatccagattccaattaacttagcacctgatgcctgtgtaactctggatgggtctcagttctctagtagttgaggactggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacctgcattttggaagagaggtatttcaggatcttctcattactgaagcctctcattgtaggaccatggtcatttttaaatctcccacattgaaatgaccagttggcaaaaaccttcaattacaaaatctcttccaaagaggctgagttttttttttttcttggatcacttcacatccttttgaataccctgaggcagtatttttatgggctaacagcaaacagagtgtcgtgtagaaccaagtgtgtcccttcactttctccaccccctgcaaagtttgtgatcttcaaagcatgctggattttaaaataaaacatctacttctagtccaagcctttggctgtagactttgggcttaagtgtgtttttccacagaggtgttacatccccatttctatcagctaaggaaaatgaattcattcaaggtctcccctgccattcatcgaggctccccaagaggagctttccagaaagatctgtgccaattgtaaacttacaagatcctcagcccataacaaaatgcccagacaccttggctctgctgacacaggctgagagagataaaggaaacagctggctgaggtcctgacttttttttcacatttttttcactttttttttcacaaaggcccgctagcctttgcagactggggactttaagattgttcactacccatccagcagggctgggcatacagataccaaagctccatctccagagacgtgaactctaaccaaggatcctcaaaccacttaaatcatgaacctgaaccttgaaatgaagcaaacattacatttaaactcccatgtttaaaatcagtttgcccttttcgctcactctttactctgggggatgcataaacaccttgggtgcctgctgtgacaatcaagttggcaatacatgccacctgctggaaccatagtctccaatctgaactccttccccagctacctgtttcctgtcacaggccttggcattccctgtagcttcattgcttacctcatagaatcatgcttctcattagagagtattcaacagcttcttgtcactggggggtgcacttcatttcctctactcttggacttctgctctacttggacttcatactcttggctgtctctgaggtagaggcagagagaacatccctgactctctgctgcccattttctgccatgggccgccccccccttccagaggaggaggtgttggggaacctctcccacatggcagaacaaccactcaagtctggggaggtctttggcagtcatcttgggccagatgttgtgctagaccaagactgagctgggatttgggttttctattctcacatagccagttggaaagggtggaaacacatgtgggggtcccaaggaaccatgagagacttctcatcattactgcggagtttgactatgatctggcatcctgggctgttgtgtggaggtctctatcatgaccgacctctttggcttctcttgtgccctaaggaaggtgttttttttgctagttttgttttatgtttttagactgagtcttgctcttttgccaggctggagtgcagtggcatgatctccactcactgcaacctcggcctcccgggttcaagcaattctcctgcctcagcctcctgagtagctgggactacaggtgtgtgccaccacacccagctaattttcgtatttttagtagagacggggtttcaccatgttggccaggatggcctcaatctcttgacctcgtgatccgcctgcctcagcctcccaaagtgctgagattacaggagtgagccaccatgcccagccggaaggtgttttaaaattgaaacaaagttgcatagttggttgtgttaattgattcaaaatctttcttttttgcaggggcagctctaggccaaattcttcttgcaagtttttatggatcacatgtttgtctaaagtacacacagatcattcccaaggccagagcaggaatgctctggaagtgccctctctgatctagggcaagcctgtagtttcagggttatcgatagacctcgcggagggcagtgtacaaggcctctggctgcatgaagagaaatctggtgtgtgggactgctctcagaagcagagaggtgtagaaggctgtcaaatgcataaagacaatgtctcttcacttggaggacaatttgtctgccaaggggacggtgagatttggcttcatctcttaagaacctgcattgagggctgctcacaatttcacccgaggtccagggcaattctctcctctccagatcccatatctagtgcttgttgctgctcattcagtatatggatacttctattcttaacaagttcataagtttgtttaaccgatgactgctcatgtctttaaagccattcattcattcatccattcattctctccctcccttgtcaatcaacaaatgtgttttgaaattaagtctatgctggaatttagtgattaataagacccagatccaccaaactatgagcttcctaagagcagggagtgcatatttcatttatgcatacacagtgctgggcatatgatttccataaatatgaatggatgcttcaggcaaatgcactttaatgaagtttgccacagaggcatctaattctcaaaccaaatgctggtattttaatatcttttcataaccagaggtctgagggcatgggaaaattgctgggaaggagggctctggaataacatgatattaagatagatgcatgagtgatgacccaaagcttcttgttgtcacccatagaataacttagtttcctgtcttccctggaagaaatgtaagaggatgtgtggggctagaaagagcaacaagcttatatcacccatatagtagaaaaggagtgagtggagcatcgagcctgatcctgtgcatttacagtagcagtaatagagtaaaacagagcaattagtgcctcatgtagacttggcattgagcaccccatcgcaaaatagccatgttacatatttcagtgtttaccagtgacaacgttttcctcttctttatgatttttggttcctgagatgtttaactggccttaatgcagttttgagagattgcaggaagtgatgggctgggttgggaatggctgggcattcaagtgatttagccatgggactcagcagtgcattgcttttactcctgaaggactcttggaagaaagctctgggcctctgcagagctttgatcagcttgttcagaaagagagcgttttatcgattttatcatggttacctttttttattgttaaaagtgtctatgttgtaaggcctctttgtgtgataaaattctgaaatgatctcacattgatttattttttcctgctttcaaaacacagcaatcttggtagtttcttagtatcccaaagggataaggagtcagcttctcaataaaccttttctggttatgaacactgtatgtattaaataataagcaagccttacagagtttatatgatcacattaagggatctgttaaattccaagagttattgttatgtgtgcaaaatactacagaagcacttgattttgttccagaagcactctgctgggaatgagtgcatattggttctagtgactctgccagtaattagctgtgacctttggtaagtcacttctcctccattccctcttgcatcctgatctgtaaaacgaggagtctcttagtcccttctaagtccctcaccagctttaacattctgaggcttaaaaaagctcataggagacaggctgttctttgcaatattttccatacaggtagtataaacaagtggagaggtaattgaaagactgactttcaaaatctagtacaaggaccttatttatatgggattttaaactgatatcttgagtcggactatgaatgactacgactatcaatcagttatctgcaccaataaaggacaaccgatgtgaatcatttggagatcttcctactcccagtagatgcaggtttcgtgccccagaataatactggaatgtgctcatgtctttagcacataccaactaatcttggtgagaagtgaccccctaaaaaggtgttggaaggcaagggaacacagtggctagagcttaacacatttgttggaaagaagagcatttttacactgctgacaatatgaggactatttgttttcttattttattattatacttttaagtattaagatacatgtgcggaacgttcaggtttgttacatatgtatacacatgccatggtggtttgctgcacttatcaacccgtcatctacattagatatttctcctaataatatccctcccctagcccctcactcccccaacaggcccccgtgagttatgttcccctccctgagtccatgagttctcattgttcacctcccatttatgagtgagaatatgtggtgtttggttttctgttcctgtgttagttcgctgagaatgatggtttccaacttcatccatgtccctgcaaagaacatgaaatcatcctttttctggctgcatagtattccatggtgtatatgtgccacattttctttatccagtctgtcattgatgggcatttgggttggttccaaaactttgctattgtgaacagtgctgcaataaacatacgtgtgcatgtgtctttatagtagaatgatttattaccctttgggtatatacccagtaatgggattgctgggtcaaatggtatttctggttctagatccttgaggaattgccacactgtcttccacaatggttgaactaatttacactcccaccaacagtgcagtgtaaaagcattcctatttctccacatcctctccagcatctgttgtttcctgacgttttaatgatcaccattctaactgggcatgagatagtatctcgttgtggttttgatttgcatttctctaatgaccactgatgatgagctttttttcatatgtttgttggccacataaatgtcttctttggagaagtgtttgttcatatccttcacccactttttgatggggttgtttgtttttttcttgtaaatttaagttccttgtagattctggatattggccctttgtcagatgggtagattgcaaaaattttctcccaatctgtaggttgcctgtaggttgcctgttcactctgatgatagttttttttttgctgtgcacagctgtttagtttaattagattccgtttgtccattttggcttttgttgcagttgctttcggtcttttagtcatgaagtctttgcccatgccaatgcctgaatggtattgcctaggttttcttctagggattttatggttttaggtcttatgtttaagtctttaatccatcttgagttaatttttgtataaggtgtaaggaaggggcccagtttcagttttctgcatgtggctagctgttttcccaataccatttattaaataggaaatcctttccccattgcttgtttttgatagttttgtcaaaatcagatggctgtagatgtgtggtattatttctgaggcctctgttctgttccattggtcaatttatctgttttggtaccagtactatgctgttttggttactctagccttatagtatagtttgaagtcaggtagcgtgatgcctccagctttgttctttttgcttaggattgtcttggctacatgggctctttttttgttccatatgaacttgaaagtagttttttccaattctgtgaagaaagccaatggtagcttgatggggatagcattgaatctataaattacttcgggcagtatggccattttcatgatattcattcttcctatccatgaaaattgaatatttttccatttgtttgtgtcctctcttatttccttgaacagtggtttgtagttctccttgaagaggtccttcacatcccttataagttggattcctaggtattttattctctttgtagcaattgtgaatgggagttcactcatgatttggctctctgcttgtctattattggtgtataggaatgcttgtgatttttacacattgattttgtatcctgagactttgctgaagttgtttattagcttaaggagattttgggctgagacgatggggttttctagatatacaatcatgtcatctgcaaacagagacaattcgacttcctctcttcctatttgaataccctttatttctttctcttgcctgatttccctggccagaacttccaatactatgttgaatagaagtgttgagagagggcatccttgtcttgtgccagttttcagagggaatccttccagcttttgcccattcattatgatattggctgtgggtttgtactaaatagctcttgttattttgagatacattccatcaatacctagtttattgagagtttttagcatgaaggcatgttgaattttatcaaaggccttttctgcatgtattgagataatcatgtggtttttgtcattggttctctttttgtgatggattacgtttattgatttgcatatgttgaaccagccttgcttcccaggaatgaagctgacttgatcatggtggataagctttttgatgtgctgctggattcggtttgccagtatttcattgaggattttcacgtcaatgttcataaaggatattggcctgaaattttctttttttgttgtgtctctgccaggttttggtatcaggttgatgctggcctcataaaatgagttagggaggcgtccctctttttctattgattggaatagtttcagaaggaatagtaccagctcttctttgtacctctggtagaattcagctgtgaacccatctggtccttcgttggtaggctattactgcctcaatttcagaacttgttattggcctattcagggatttgacttcttcctggtttactcttgggagggtgtatgtgtccaggaatttacccatttcttctagattttctagtttatttgcatagaggtgtttatagtattctctgatggtagtttgtatttctttgggatccgtgatgatatcccattgatcattttattgtgtctatttgattcttctctcttttcttctttattagtctggctagccttctatctattttgttagtctttaaaaaaaaaatacctcctggattcattgattttttgaagggtttttcgtctctctatctccttcagttctgctctgatgttagttatttcttgtcttctgctaggttttgaatttgtttgctcttgcttctctagttctgttaattgtgatgttagggtgtctattttagatctttcccagtttctcctgtgggcatttagtgctataaatttccttctaaacactgctttagctgtgtcccagagattctggtatgtagtgtctttgttctcgtcggtttcaaagaacttatttatttctgccttaatttcgttatttactcagtagtcattcaggagcaggttgtttagtttccatgtagtcatgaggttttgagtaaggttcttaatcctgaattctaatttgattgcactgtggtctgagagactgtttgttatgatttctgttcttttgcatttgctgaggaatgttttacttccaattatgtggtcagttttagaataagtgccatgtggtgctgagaagaatgtatattctgttgatttggggtggagaattctgtagatgtctgttaggtccacttggtccagagctgagctcaagtcctgaatatccttgataattttttgtcttgctgatctaatattgacagtgaggtgttaaagtctcccactattattgtgttggagtctaagtttcttcataggtctctaagaacttgctatatgaatctgggtgctcatgtactgggtacacgtatatttaggatagttagctcttcttgttgcattgatccctttatcattatgtaatgcccttctttgtctttttgatctttgttggtttaaagtctgtttcatctgagactaggattgcaaccctttctttgttttactttccatttacttggtaaacctttctccatccctttattttgagcctatttgtgtctttgcacatgagatgggactcctgaatacagcacactgatgggtcttgactctttatccaatttgccagtctttgtcttttaattagggcatttagcccatttacatttaaggttaatattgttatgtgtgaatttgatcctttcattatgatgctagctggttatttttcctgttagttgatgcagtttcttcatagtgtcgatggtctttacaattttgtatgtttttgcagtgactggtactggttattcctttccatgttagtgcttccttcaggcgctgttgtaaggcagcctattggtgacaaaatctctcagcatttgctcgtctgtaaaggattttatttctcctttgcttatgaagctcagtttcgctggatatgaaattctgggttgaaaattgttttcttataatcaatagcttaccaaccaaaaacagttcaggaccagatggattcacagccgaattctaccagaggtacaaggaggaactggtaccattccttctgaaactattccaatcagtagaaaaagagggaatcctccctaactcattctatgaggccagcgtcatcctgataccaaagccgggcaaagacacaacgaaaaaagagaattttagaccaatatccttgatgaacattgatgcaaaaatcctcaataaaatactggcaaaccgaatccagcagcacatcaaaaagcttatccaccatgatcaagtgggcttcatccctggtatgcaaggctggttcaatatatgcaaatcaataaatgtaatccagcatataaacagaagcaaagacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatgtccttaagctcataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgctatctacaactatctgatctttgacaaacctcagaaaaacaaacaatggggaaaggattccctatttaataaatggtgctgggaaaactggctagccttatgtagaaagatgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaactgcaacaaaagccaaaattgacaaatgggatctaattaaactcaagagcttctgcacagaaaaagaaattaccatcagagtgaacaggcaacctacaaaatgggagaaaattttcgcaacctgctcatctgacaaagggctaatatccagaatctacaatgaactcaaacaaatttacaagaaaaaaaacaaacaaccccatcaaaaagtgggcgaaggacatgaacagacacttctcaaaagaagacatttatccagccaaaaaacacatgaaataatgctcaccatcactggccatcagagaaatgccaatcaaaaccacaatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggataaagaaaatgtggcacatatacaccatggaatactatgcagccataaaaaatgatgagttcatgtcctttgtagggacatggatgaaattggaaatcatcattctcagtaaactaccgcaaaaacagaaaaccaaacaccgcatattctcactcataggtgggaattgaacaatgagatcacgtggacacaggaaggggaacatcacactctggggactgttgtggggtggggggaggggggagggatagcattgggagatatacctcatgctggatgacgagttagtgggtgcagcgcaccagcatgacacatgtatacatatgtaagtaagctgcacatggtgcacatgtaccctaaaatttaaagtataataataataaaaaaaattgttttctttaagaatgttgaatattggcccccattctcttctggcttgtagggtttctgcagagagatctgctgttagtctgatgggcttccgttgatgggtaacgcgacctttctttctggctgcccttaacatttttttccttcatttcaaccttggtgaatctgatgattacgtgtcttagggttgctcttctggaggtgtatctttgtggtgttctctgtatttcctcaatttgaatgttggcctgtcttgctaggtcggggacgttctcctggaaaatatcctgaagagtgttttacaacttggttccattcttcccatcaatttcaagtacaccgatcaagtgtaggtttggtcttttcacatagtcccatatttcttggaggttttgtttgttccttttcattcttttctttttttttccaatcttgtcttcacactttatttcattaagttgattttcaatctctgatatcctttcttctgcttgatcaatttggctgtttatacttgtgtatccttcgtgaagttctcatgctgtgttttcagctccatcaggtcatttatgttcttctccaaactggttattctagttagcaattcctctaaccttttttcaaggttcttagtttccttgtgttgggttagaatgtgctcctttagcttgaaggagtttgttattacccaccttctgaagcctacttctgtcaattcgtccatgtcattctccttccatttttgttcccttgctcgcgaggagttgtgatcctttggaggtgaagaggcgtgctggtttttggaattttcagccgttttgtgatggtttttcctcatcttcatgaatttatctacctttggtctttgatgttggtgagcttcatatggggtttctctgtggatgtcctttttgttgatgttgatgctattcttttctgtttgttagttttccttctgacagtcaggcccctctgctgcaggcctgctggagtttgctggaggtccagtccagaccctgtttgcctgggtatcatcagcggaggctgcagaacagcaaagattgctgcccgttcattcttgagtaatgtttagcaggcatagtaagccttcttcaatatttaattgtctgcatactgatggatatttttagggatgaagataagtggttcttgtttgcagtggatacgatgcttatgaggaaagaagagctctttttaaatagagtctcttgggtagaaactcccttgattaagttcctgaagtcttttactttgctgatcctcaattcagtttcatcagctcacccagagtttatcaaactttggaggaatgattttaagaaccaaatatggccagatgcagtggctcatgcctataatccgagcagtttgggaggccaaggcaggaggatcacttgaggcaaggagtttgagaccagcctgggcaacacagtgaaaccccgtctcaaaaaaaaaaaaaaaattaagttagctgggtgtgtcactgtgcgcctgcagtcccagctactcgggaggctgagttgggaggatcacttaagcccaggaattgggggctgcagtgagccatgattgtgccactgcccttgagcctgggcaacagcgtgagactctgtctctttaaataaataaatatgtaataaaagtggaaaaaacaggcaaatgtataagtcactgatctataactctaacgtgatagtttgtttatttactaattatattgccaactgacactgattgctcagacccttaagaggcactcttgtgtgaggatttcactcaagacaccaaattacagacagtgaatgttccatggagaacagagttgaaatacttccatgcatattgtctctgagaaaaccacctcttttccaggagaggttgttctgcagagggtgccagatcccaatcctgaagaatccaaacaccttttgaaattgtattctggggctgaggccctgcttgttcaccttgatcagacaggtgaatttcctcagcttcctcagccattgatttctaaatgatctcttactttgaggtgcagataagctttcttgatgtagatcctttccattttccttgtaggtacttcgtggttcaaactttcactactgcaactacggttaccataaagtgattactatgtgctagattgtgtactaagtgctttccatgaaatatttagttgtcacggcaaccctacacaggtctggccaataaacatttctgcaatgatggaaatgttttataatactagcaccacctaactctggtagccattaacacatgtgaatattgagcattgaaaatgtttctagtgtgactaagaaactaaagttttaattttgtttagttttgattaattaaaatgtaaatagctagtgtggccagtagctatggtattgacatgatgcagatacaagtactttgattctcatattacatgtagagaagctacagttcaaagaaattaaataattttctcaaggtcacagaacttgcaaatggcagagcaaggatttgattttgaagtcagtgtccttatccctatagtgtatggccactatttagactgtgcctgctctttttgtatccaaatttgttaagaaacacctctggtacatttgcaattaaccattgaaagaaataaaactgataattatacaataaaggacaacagtcattaaaacagcactaccctggtcccaaaatagaagtatggctaatggaacagaagaaaaaatgtacaggtatgaaaatagatgttcttgtgttatatttatattcttatattactgtgatgaactgagcatcacaaaagaataagaaaggaagagctatttaactaatgacttgggaaaaactggttatcaattaaacattcataagctcccaacctagtatattgtatgaaaatatatttcaaatggcataagattcaattattaaagaacaaacttgtttaaaaaatcaaatcacaagaaacagcagaaaattcatttaagaaaccatctgttccatggtaagttctgaagaaatcatgaaggaaaaaattacagatttgactgcttaagaaataaagactaatgaacaataaaaatatacatagaataaaaaggataacagatttggggaatatttgcaacgaataagaaagacaagggtgataattacattatcaataagaaaaccttaagatacccgggaaagttaatggaaaagaacgtgaacagacagttcacacaccagggaatataactagtgattgagcttatggggaatagttgaattagggcttttcaaagaggtacaaattaagtgatgacaagatagcatcttatgccttttgaattagcaaacatttaagaaaatagtaattctttgtgttgaagataaggcagaaaactgctgtatatgctgcctgcggcagctaaaattactctgatttaggaagcaaatttgatgaagtaatcaagaaccataaaaatgttcattcagtctgacttaataatccgcccctgaaaatttatctgagaaaaaaatcctaaggaaaattcacctccttttaccatcaaacctttaaagtagaggaaaggccatatattaaataatgtgaagattttaatttatagagttagccctaataaggaaaggaagggaagcaatctaaaatgctgagtcattggtgaaggccattaaatatattatgacacatatactctgtagaatattatgcatctgttaaagtgataattatggccactgtgtagcaacatggaaaatgtttataatggcaaacgaaaaacagcaggatacacatttgtatcttgtctaaaatttcaatcctgtcgaaagatacacatgagggccaggtggtggctcatgcctgtaatcccagcacttagggaggccaaggcaggcagatcacttgaggtcaggagttcaagaccagcctggccaacatggtgaaaccccttctctactaaaaaaatacaaaaattagctgggtgtggtggcatactatgactgtaatcccagctacttgcgaggctgaggcaggaaaatcacttgaacctgtgaaatggaggttgtggtgagccgagattgcaccactgcactccagcctgggtgacacagcaagactccatgtccaaaaaaaaaaaaaaaaaaaaaaaaaaagatacacatgcctaaggacccagactggaagggaactcaaggcaaacaaaaacagttggtatgttagggtcatgggacttgtttttatttttatttacctttgtcctattttctcaataaactcaaactagaaatggaaacacagtcacagaaatgaaggatattcataaagcattgtttcctgttggaagctgccttttattctcctttgccctcagacatgtactcctcattttgatgagcagcaagtgatcagaattatccagccttcagtcaaacataatctgtagaagaaagcactgctttatgcaaggagatttactgtgtgatggttggcaaaagaaaggatgcacaaagactctgtgtgggcagatttagcagaggtactgaaagtgaaaggagaggccatctggtagaatgtgctgtggcaaattaaactgagttttatgaacatgaaataccagaagaaaatccaaatgccctggacttggaaaaagcccatctgaggcaccataaaaccaatcaactacagactgacaatatgccactcataagctcagatatgcccattactagggacagcatcattcaagccagattttgcagagctcatttgatgtggatttcccgtaggggaaaaaatcaacaaattacccaccgtgtcccccacacatgcgcagatgcctgatacagagctactgtttcaataaatatggtaaatgcataatgatctggaaggcattggtttggcttctcctgcctcacattcattagtgaactctgacacccaaaccagacaactagacttgggtatggatataaggagccatttttccctccctccctccctcctttccctgcttgcctttctcttttccctcccaattattttcattctttcctctcccctccctccatctctccctccttctctcccttccttccctctgtccctccctccctcacttccttccttctttccttcctttgtttctctctccctcccttcctccctcccttccttcctttctttctcgctccctcccttcctccctcccttcctgccttcttttcttcattctttctttcctgtccctccctccctccctcttcctcccttccttccttccctccttcctctgactctctccttccctccctttctttcctcccctcctcttttcttttcttcttttcctaagcagttcatatccctatcctttagcctgtatgtctggaattctttatagttccactacacttgccccctcattttgtcctaatgttcctccaattctccatttcctctttatttttactctggggctctttcgagtgcatgtatcctgcatattcagctacttctgcttttcctcacctttaatgctttgattgcttccattagagtgttgataattctgtcatgatccttgtctgtatatagttcttccttatatttcaagtccctttatgatagctctgctacaagtgtgttttcaatggcactgtagttctgctgtggctttggggctgctttggttttctttggaaggagatagctacatgggtagcttgattgaggaagggcacaaaagcagtctaagtgtttgaaggactgtctctgggaagaggagcttagctattcccatgtggctagaaagggcacaacaaatcccactgggaggtgtacttagactctgtaaaaggaagcacattctaatatagcaggtcaaagactgaatgggctatttccagggccgacatatctgggtgttcagtttgtgcattgtacaaagacacctggccgagaaaatgaatgggagctgaaatgcagcccgtgctttgctcactaagccctgtgctctggagtgaggccatgccgacctagaagaacgggtgccaagataagttaccttttgatattccacataaagacaccagtatgtgctagtggtagccctagctatcccaggaggggatattgtctactgttgcagaacaagggagagaatagatgaacttgtgtgctagaggaagtgcttgcctcttctccaccatctccacatttcctggatgtgctttgattctattgcactgccaaacaatccctttttctaaacttgtctgtgccaatcttgtgtcttcttatctcacatatgctaacaacatccacattaagactctcaacttccccgagatggataggtgccatcacataccgtgctggattgaattctcatttcagagaatacatcttctttctacttttcaatgaggatcagcatcccattcttgcccaccacctagtactttgttaggaacacaggaggtaaggcaaactgaaagcactttgaaaactgtgaagaattttttcatcaatatcattagacaagatcctgttacaccaggaagtcaagaggctttactggcatttagtgcctcttgtttcaccatcaagattccctgtctacaacagttcatagctgagtctctattcatcaaactttctgcagggttgacatacacaccatttatttggctctcagtgtataacatttggtggtgagtcaccctttcctgtgtacatcttgtttaccccagatagactgtaagctcctggaccaattcaggaaaccacatactggtttcctggtatggaaaggaaatgttttatttcagaaagtcacttctctccatgagcaaagaacagtgagggtcattttaaactgttgtagctgaattccaaatggcaactgagatggtcccaagatttgggccatgtcaatttagggagtaggtaattaaaggcagtccaacaatttcacaaatttatagttaggtgccatgccgtgcactgtcttggaattcctcacaaggacattgtgtaatgtatactttttgaattcaattgaatttatccttccttccacctttcctcccttccttcaacaaatattcattgagactgtactatgtttcagtctttgttccaatgaacctaaacagacaaaagtctgtgccgtcatggaactttctattcttgtccagatctgccatttactagttgtgtgtagactcaaccaaatcacttccttctccggaccaagtgtgttcttctgtgtacactgaaggtttcacagatgtttccatttttccttcctattattttttctttaatcaacctccgtacttttaattgctttcttggttatctatttttgcctaatatccagtactgtaaggaaaataacaaggatgtactttttcttttcttttttttttctttttttttttgagacagagtctcactctgtcgcccaggctggagtgcagtggcgtgataacggctcactgcaacctctgcctcctgggttcaagcaattctccttcctcagcctcctgagtagctgggattacaggcgcccgccaccacacccagctaatttttgtatttttagtagaggcggggtttcaccatgttggtcaggttgatctcgaacccttgacctcgtgatccacccgccttggcctcccaaagtgctgggattacaggcgtgagccaccgcgcccggccgaggatgccctttttcaatggttcacctttgggtatttttatatctatgtttgcctagatcattcctttgttttgatatcatcaatttgtttagcccaaagataatggctgttgtatttccgtcttgagtgccaagctcacaatgagctgttactcagtttttgaagtattttctcccattataacatcaaccttctttcatttatttcctttagtcctctgtcctgagagcatcccccagagttatagccttggattctcaagctgcaggagattgcatgtttaaccatgataaatactcaggacaaaattgagcctttttttctctcataattttatttgtttaaatcttgactgcttatagtaaatatcctctcaaagataatttcatttccaaacaatttggtacctgatctgacgcagcttgagtgtttattttggggatgttgtttttcttttttaatgagttccccaaaatagcttttattgtttttacatctttcttttttttccccgggctatcagagggattgtagttagcattgctggaggattattagtttattaataataattatctcttaaatttcttttttggaagcagcatttggtcattattgaaaaaacagagcttttaaaaaatggaatgactttaaggaatctgaagaaaagataaatgtactcctgtatgatttttatagtgtttgcaatccagtgatcattctcacattgtttaagtttcagtttcaaggtgcgttgtccccctttatctgtggggaatgtgttccaagacccccggcggatgcctgaaaccctatatatactatgttctttcctacacatacttacctatgataaagtttaacttataaattaggcacagtaagattaacaacgacaacaataaaatagaacaattataataatatgctgtaataaaaattatatgaatgtagtctttttctctcagaatatcttatactgtgatcacgtatttcctgactgtgagtgaccatggctcactgaaaattgaaagtgaaaccacagataagggtggggactatgatagtaaggtaagattggtattaatatattgtctgagcaaggcaactaaatgtgttccttttggaatgcatactgttacaattcaggtttaattattaaacagcattggtctaagtggatgaaggttctgttttcgacccataatttaacacatgtcaagtttaaatgtacacagtaactcaaaaaacggcctgcctttggttgttgtttccaggatactgtgagcattgcaattagcaataaggaaagcactgaccaactcccggaaccacatctagttgcctggcatggaaaggaaatgcttttattttagaaagtcacttctctgcatgagcaaggaacagcgagagtcattttaaactattgtagttgaattccaaatggcaactgaggtggtcccaagatttgggccatgccaatgtagggagtagaggattaaacacagtccaacagttttacaaatttctagttggtgggtggctgggaactgtttattattgttaatgttactgaaaaatcacttgtttcgtgttaatacatcatcccttctccagtcctccagccccagtgaattttgtgttgatatagcaatgtgttcatagtgccactttactgaatcagttgttaaacaaatatttgtgccatacctactattttacagacattatgtcaggcactggggaatttatgttggtgaataaatagacatggttcctgctctcatgaaacttaaaatctggtctttttaagcaagctatttcacttttctgagagtcagtttcattatcttaaaataggcataatgcctatctggaaggattgtggtgagaataaaatgagactatgtctataaagcactggtgtgatgtttggcacatagaacatggtagaacctcaacaaatgatggctcttataatcattgtgagtgctggagagccccagtgctggtctatggattgaagagctatcgaagaggttcttgctgaaggttcaccccttggagtatctctactcaatccactgagtgggaagatttgaaggtaacaggctacgggggttgaacttttcccacatggacattttaaactcagttcaaatacatttgaatgagagagcaaagtacattaagcacagaatttctagaactcaccttgggaaatttaaagctgaccattttctctagcattttggaaattatcaaaaggccagacggaatgcacaattcacttcttggctgccaggagtgaaggagagaagaggtgaggttgaatgatttgaaattcagttcgtctgtgttagaacaagtcaaaacaattctagctgttaattttagttagttgagtccagagtaaaggtttgtaaagggcataagaaagcaacattacttttttctcacaatgagcacttaaaagatcttttaaaagtgtttctgtaatgtaaaagaaatagtcttactgcagtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgattcacttacaatcataatgtagggcttgatgtaaaacatgagaagacttgatgtttctgggtaacaatgggtgcagctcttgattattcatagtctgattatccttactggggagtatcctgtctcattttacttcttgttgtctgaatgcctaccttttacctttgtaaactccagatttaaagtttgtgtagggtggggtgcggtggctgacgcctgtaatctcagcactttgggaggctgaggcaggaggatcgcttgagcccaggaattcaagacaagcctgggcaacaaagcaagagaccatctctaaaaaaaaagaaaaaaaaaaaaaagccaggcaccctagcacacgcctgtagtcccagctactcaggaagctgattcaggaggattgcttgagcccaggagttggaggttgcagtgagctatgattgcatcactgcactccagtctgggtgacacagcaggagacactgtctcaaaacaagaacaaaaacaaattttgtttaaaactgaaaatggggggatagatggaaactattttactttttatcttaacagcttgtgcaggtagaacagtttaatgaggaaggagctgacactcttgcctatggtgtgttgggagattatagattttagttatccatgtttatgttgtaccccaggactacagattattggcagctggctataaacaaatgaccaaataaatctacagttgaagttacctagtgtctccaagatttcagggatgatcaaggacaggtagcagagcctggggccatcagctgtgtgttggcctcatctcattctgaacccctctcctactttaatcagaaccctgatacttaagggactgaactagctgtgacatccatttatccattttatagaatggctgtaggtaactacagggccataatcggaattctatacagggatgggtccctaggctcattaattgatgacagggtaggagaagactttgacacctacagattcattagagacagctgaatggatttattccaaggaggtcacctttgaaaacgcaatgaatttctatgggtggataacaatgcaaataggcaaggatgaagctttagatttaatctacatctgctgcaacaatgttctgatatagaattgtttagcccaagtcctaattgaaaaggtgagtaacattgatattgtctttctgaaatggattagaaatagggctggaaattggatgctaggaagagggacatataaggtttatgaggtaaaccccaataaatggaatttactatgattatattaaaaatagagacaatgtcatgtttatacagcgtgtaatatcatgcataatgtcaaatgccctttggagttactcctgtcccttgtactgataacatggcagttttttgagtcctagcatagggaaacagtgaaaatttccaggagtgcatcttttcaataatgcaaaggatacatatcagtgtttcacaaatttctctcttttttttaagagacagggtctcactctgttgcccaggctggagggcagtggtgcaatcagctcactgcagccttgaactcctgggctcaagcgatcctccctcctcagcctctggaatatttaaaactacaggcgtgcatcaccacacccagctaagttttaaagttttttgtagagacacggtcttgctgtgttgcccagactggtctggaactcctggcctcaagctattctttctccttagcctcccaaagtgctgggataatgggtgtgagccaccctgcctggcctcacaaccttttgaaaaagatcatcccctaaggaggaaattcaatttaaataatcctaatgagagaacttaaatactaaggaaaaagatttaggggaggaggattggatgtgaagggccacaatctactgtaatatctttttttttcactttccccccaaatcaattttcttccccttatggacaatatcacccttgttggaaatgcatgatatagatctgtgaagccagccaatttatgatgtgatatttaaattgtctctggttatggatattgtttccattgcccacattaaccctcaagaggagggcagtaatgccaattaagttcttgctatgtgttagatcctttccatgcattgtttaatttcacccttacaacaaccctgaagttgagaagttaagcgactttcccagactcatacagtggcaagtcaggggttgaacccaggcctttctgatgccagagactagaatatttctaacacttacttatcttacgggaggcattacaagatgtgtcttacatagaaaggacataatggtgggtgtttatttctgaagttgattttggagtctctggattgcattttggttaccctcaggtagaatagaaaagagaaacttgattaatactaaattttctcttttattctctccacccctctttaatggtttgtattgtgtttcttagtattatgtggaaataaccttagcttcttgatatgtgctgagatcctaggaactcagtgacttacagcacaggttggataaggttaatattatgttaataacacagattttatagctcttctactaatctttacatagattaatgcctctcaattttacaaaaaatagaccattaattgtgaagctggaagaggacaattcatggcagaaaatgttaggttagtagaacaatagtcatttacacaggattgttaaagaaagggaaaggtaaactgatgttcaacatctagtgcttgagaagttgctctgcacataaaatcaaaccaggcagctttgacctagctcttgggagagaatatatcaggttgtattgatgatgcattgatgagaatacatcagtgtgtatgatgtgggagcgtgtgtgtgtgtgtgtgtagatgtagaaaatagcattttcttatctggactttagacttcatagttaaagtaaattatgttcatacatctgtatgtgtagacttcctacctgtgctttaacgcctctatctccacctccatccctttcttctgtctccccagggggcaatggtgcaagtaaaccaaattcgaaatgcttggtcccagtgttgttagcagctgattcataggtgctcccctcattttagataagaagaaattgagatttgcaaaagtcacacaaactggagctcagattgcctgatttgtactggtatattgcactgtctgtcggccttcactctttctgactctctgcttcttagaaaaagagagtgtgggaaaatgtgctggcaccttcatctggtggccagagaccaattctaggccagaggtaagctttaaagagaataaaaagtgaggaaaattggctcaccagagcacgtcattatttacataataatacattgactacgatgtgggctttaaaagaaaaagaaaatgaaagtctttctcacaaaatactctaaaaataaactttttagggaacattataaaaccatacaatgtattttttcccaaacacaaagtcccactgaaatctgtctcttggttttttagatgccaaaagtcaactcatcttgatgtagaaaatgaggaggtgctgttagtgcatggagaaatagccttctgctaagaggtagttgacttagtttctaacttatgttttcgtttcatgctatgtgatcttggtcaaatcattttgcctctctggactttgatatccttttctgcaaaataaaagggttcaactggatgattttgaaagcacctctctcttctataagtctctgcaagtgggaagatgattagtttgtagtcttataatgtttagatggtttaacactgctatcttctagcttttctaaaagttttctgatgttgtcataggcagttttgtgtacaaaggtcatttgatggatgctaatgtacctttggttgataggaggttcgtaaaagaaatatgcatcaaaccttattattcgtgtattagataaagcagatctactgacattttaatgtcaccaagtaagtaatttataaagtcagtgtgccccactgaaacatttccaaagatatttactattgagtacttgggttctgctgagggtgaatactgaaatgtattctttttgtgctaatgtttgcagtacagtgtttcccagcagtcagaatgattgtctgatattgttagtgtaacccctgtgatctaacataggcttctgtgattataatgatttttatttgaaaaggtaattgtgtttgcctggcaacctccccacttgattttttttctgtatacacctctttctttggctctttaaaagccagcagtagagtatgtgtagttaaaataccttcttcttcttgcatccacgtttttgactgtgtctttgcattgccattggggggactggagagttaatatgctgtgttgcctaaaggaataaaagcaaaaattatctttgcaatcaaaatattaccagaaagaatttattaaaaattacaacagagagaaaaacggacattaaaaagagatttttatctttgtttgctttttgttttattggcttgccgagctttatcagtcattaatgatgaaggaaatagaagacctctccaaacctatgcatttgaattttgtccagttatcaagctttcccctgtgcacacccaattttttttactagctcaaggacaaagagatttttctcattttcccattttaagataagctatataggaatctgggtacatttgagtatgtgaggaaagatcaaggactctgtaagcatgcatctttccaatcatggcccttttagcaatttgcagtcattggaatgtgggagtttagggagagtgctgtttccagagttagacacttcggtaattccactactttagggtttcctgccacatgctgttggctttcagtaacaagtttcagtaaggattctcttggagtatgcatagaattttcttaacaatctgtgagtgattataagcagtatattctgggctcttgtgttttcgggagttaagagacctctcttttgcagtccccaagagtccatggcgctcatctatgaaaacggcccaagtgacagccagatgaatgtgtgctgagcgccactgaggctaagtgccaggaaagtagaaggcaccaccctgtggaagagggccaggaattctagaggacactactcctttgaacaaaaaggatgtggaaaacagttttctttgtttccttttgagttagctttgggcatgggctgatgccaagcttcgtcctatgacaggctcattgccatccatcctacccaggagggatgcatctctgagcatggagacagtgctgaggaaggcaggttggatggtgcttccttatctgattatcagacaagccatattttttcaaaggaacagtgagaacagatgatctttctgatctcgtgttaaatacagtactgggcatctttagcatatgtgctttaggttattgccttcttagcctgctcagaaaaaaaacacagcactggcagcattccgtttacttactcattagaatctaagggctggaagatcccttgaaagtcatctactccaccacccacccccatctgatgcaccagctgtttctacaaccaagtcgttatccttgcctatgcatgatgttctcaaagacacggcattagaacaccttccattgattgagttgaaatctttttcccattgctgtcatgcactgatgctagctgggcttcttggaaccatacaaaacaagtctaatgttcttctctatgccagcccttcggagctttatgtcacattccagtctcacccttcctttccatctcagctgcagtaaggttgattaacctgaattaaggaagacttgagggtggggtgagaagttgcacatctgttcctctgataacatggatttgattctccctctcccttttggtccctctgatagaaataggctctagttcttccatattcctcttaacaatgttcagatgtggtctcactagtgttgatgatctccgtctttatacttaactttgattcagcagtggagtccaagattctgttagttcttttggtgatctcaccatactagagattcctattcaacttgtacttgataaaaattttattattgtctgtgcttcctctaagccactggtgctcaaccggggtgatactgtcatcccccacaacgtccccaggacatttggcaatgtctggagacaattttgatttttatggcttgggggatggtatactactggcatctaatgggtagagtccagagatactgctaaccatccaacaaggatgcacaaaacagccccccatgacaaagaattatccagcccagaatgttaatagcatcaaggttacagaaccctgcttcaagccacttgtgtccatattccttccaaattttttctctgtactgtgaaggtagctttgttgactcaagtcaggatcttttgcttattcctatttaatttcatctggttagaaatcatacagctgtagtgtttcaagaccttcttggacttgatatatatcatcaacgaacatatctgcagtacctccagcttcatgcatgaacccctcttgcttctgatggactattaataccaaattcagggaactctcctcttaaccaaaagcaaattgttttcctagactggcatgggattccatggcaggtggactgatgatcattaggaggtgctgtgctcagttttttttcttttttacatttttggtactcccagacttccttagtagagagctggtgtgatctagaatggcatttgtatcttctcccacccaattagattagcaagagagagtttagccaagcaccactgctctgcaaatggagtctccaaatgccacatcagcagaaagaaaagtatctacactcataagagcatggggtagggggaaacaaggatgcataggttgttgcttggcaaatccattcactcctagcactgttccagtgatattagttccacatgcctagacagatagagaatcactgcgactggtaggcaggtcctgctgtctctaatgggatctgttttaaggaaaaagttcttgcatctattctgatttctgtatcaggccaaacaatgctagagttgctgacttaatgaccacattggctccgctgttggtcaagatcatcagactctcatttcagctttcaatgatattgcatcctgcaaacaaaccacttgagatgagcttggtataagggtcctactaagagagttctgattaccttattcacttgagatgaaatttttcactggagtgaaattaccagacaactaaaatgttttttccaagggacaaatgtgcaatttttgatccccaagagtagaccagaggccaaaagctacagccattctaccttgcctgctgtgtttctgtggcacacaaactaagaatggtttttacctggttaaatggtaggaaacagtcaaaagaagattttgtgacatgtgaaagttgtatgaaattatatgaaattcacatttcattgtccttatggcggggtcatcagaacgcaaccacacttatttatgtgttatttatgctgctttcttgaaacaaaactagagtagttgcaacagagaccttatggcccacaaagcctaaaatatttattttctggccttttacaggaaaagcatgccaatccctggtctagagcttaatttgtgtaaaagacccttcattttgtgacttttattctgttaggggctgagaaaataaacttcttatgaataacgtatttgatgggagtcttttggtgtctgagtgtggactcaaggaaggcaccgagggcttttgagactgctaaataaggcatctatttctatatatactgtcatggtctgggagctggaagaaatactttaagaagctcaagttgccggatgggatttctggattttttatgtgcacaactaatagcctctcaacctagagttgtaaggtaacttctaatgttcatagggattttgagaattgcttcctgattaactctaagagttgttcagttatttacattctttcagtagaattcttttatacctcctatgtgccaggtaataaatgtggagacctttcccaaagctttttgtatatatttaatttagagagcttctacctcaattttgttgcaattaaactgatgctaaattatgttcttcccttttgaattatggctgattgtgtctctcatcatacatagagatgttagaaagctaagctttacatttcagctgcttatattatatatacacacatgcaacacacattcacatataattgaactaaattgacattgacattgagagaatatcccctgatatttatctatgtaatttttattcttaggattagattaatcagtgattgagactgatcctctgaatcaatctctctctcgatgaaatacacaatatgtataatgtatatattaataattataattattaattgttaatatataataattagatattataactacacatatatatttaaaatttatattttctccagaactttgagttttaaccctagagagactctatcacagcacccagaatattctattttaatagttcatttaggataccaacactggaaaactccagttttccagtgatgaataaagttggaaactttattcatctagcacgacgtatggtgctcagcatagtagatgcctctgaaatgctgattgaatggaactaaactgactttaatcgagagaatagccttgagatttctttatctatataatttttatccttaggattagattattcagtgatggagacttgacctaaaaatatggctctgtaatttcactgatattgtcaagagcttgtttatgctccatcagcatcaggtccgtgggtgttgattccacttataggagtccctgtggtgttgggagggggccagaaaagtaaagagtggtctgctggaagtcagtggattagctggagagctcattctgctgatggctgccctggtagagcaccccatttggaagtggagctgaagggagagacagtagtgatgctaagagaaatgagaggaagatgagaagggaaaaattagctcatccaggcagaacctttattaaatttagttccagatcttgagttcacaacttaaataccctgtaagatcagaaatgttattatttgtacctgtagatcaagacttagaatacaggaggatcatggctatccaggatggaagagacattggagcctctctatttcagccctctagctcaatggttcttcatctgggttagtcagtggcttccctgaaaaggctatgtgtctatgcatttttcttgagaagagattccacgctttcattattttctataggatgagtccaggaaacctccttcatccccactcccccaaaaagttaaaagccacctctctagaagatgtgtgaactcttcacagggattctgataaacaattgctgacagatctcatgtaaaccttcctataaaagcgaatgtaggatttcatgaggcagcacagctggaattgttgtgaaattattccccacattgagtggaaatttatctctatgtaactttccccaacttcattttatttgtttgttctctgctccctaaagtaactgaaagtaagttccacccctcttctatggtcctttgaatataaggacacaatttgtatgccttccttaaggcgacttccccagggaaaagagcctttccaaacttttctcatgtatttgtgctttacagactcttccctgtgttggttgttttgtctgttttgtctttgtccctcataaagtcatggcagctagaattgaagatcgcatttcgggagtgttctgaccagcacaaatcagaatgctatcatctacaatcccctcgttctaggtaatatatttctagtaatgcccaattaactagtttctgtgatagtgcctcacactgctgactcataatgaactgttgattgctaaagcctcctccaagctgcgtttggaggtttggcatgtgaatctatttatacccacttttttatatttaaaaaaggcatcacattgatgcccaaatcaggactgttatgcacatgtatgtagatgagtaagtttccctttatgaatttaaaaaaacacacacacgtcatttaactttattattcttgttgctttgcaaaatattaaggacatcttgatgctttcagaatgaacaccaaaacccatgtaagtggtataatacttaacaatgttcacacatgaaaatacataagtggtttatttaattcatgatcaattatttgtttttgaaggaattttcagcattttttatttggacattctggaaatgaaatagtaaacatgattagttcaggtagcattgagaacttttaacggatataatacttatgaagaatttatttgcagcagaaagtggtcacttgctatttataagatgaggaagatagtgtgagccaagtaggaggtggagataacctcctgccaacagatgccaaaatgggagactgccactcggggctgcctggaatgcaactgcacctagaagcatactgtgttgtatgtgtaaacaagcaagaacatccttgtgtaaatgtgtggtggctctgctccttggagaaatagaatggtttctcaacatcattttcttataaattccttgctgttaaatcagtagccatttatccagatacttgtagtggagctagagatccccctctggttccaagtctataatgaattgtggataaagactgggctggcttaaacatcccaggcatggcaggcccctcatatgggaatagagtcaccaggatctatctccttcagaggctgcttctgtcggatgcactgatgaccagtgagagtattctactgtgtgtggtaatctggaaaggcccctgccttcatccacagatctgtctattcagggcagggggaggggaggaagagaacaggccagcctggaagcactgtttctctctgtctttctctctcgggattttctgggaatcaaaaggaaaatattttcctgatagtttagcaaaacatttaattaggggtggtaatgaaaagtgattacagcagcacaatgcgcttgcattatgagttcgagttaacatatttaggggtacttgcgcacaagctgtttggtgattagggaccaatccgctgaacatgaaaataaataaataaatgaaactgctgtgtgaaaaatgaatgtgctgaaattaggctgtgtataattgcaacgaaaccaaaattgagcagatacagttcccacagagaggtggaaaaccttgtcagggagcattcgccagcctgagctgttgtttgtggctgtgtgtggaatggactcaaagcccactgtggctgctggaaagtggtagggtgatttgatctattcagtcagaactagctgatgtagtgaccgaattatctcaagtgcttcccctcctgttatgtaggcaaaacctctaaattcaatgggttggattttttctaacctttaatcatttgcgtttgatatcatgtcttcattgccagtttcctccttaacccaacgtctttcatcttcaatcttcttaaactttaaaagatacaacccttcatctttcctttgatcttcacctgatgggcatgttagctgtgtccatcagtttcactaacctatttctatgaaaacagagaaaatgtttaacctagtatgacgggcctatagattataaaaataattgactaattttgttgtaaaaaaatactactctttgtaaaaacaaatcagcaaagctggagttttgtctttataaaacatgatgcttggttgcttgcttttttcaccttttaactggctatttgggtatcaagttcaactgaagtgtacttttgagaactgtcacagtagggcctccccattttatatggtagctcaccaaactgactgctgctgccagcacccttttggtttgctcttaattctattgggagccctattgctggcaagaaggctcctcatttaattcccataataagcttcattttcagcaatgcctccctaccctgagcttcataaagagtatcatgcctgtcgattttctttacagaaaggtgagcggtacttctgttgcccagtttgatacccagtagggagattcacaagatgccaagggtcttctacagaggaggtactagaagagtatttgtggagtatatgaaggaccaaggatgcagcaactaagcaatatgtatactgattatagatattttcttgattttggggggaaaaacctccagataagaaaagcagtctcattggagacctttggaaaaatgaacaataaatctttggagctcttctaaagttggtaagtctcaagtttctcccatagttctacgtaagagtactagctcattatttctcatagaaataattgagagactgaatttccttcaaagtatgaaattgggtgattgtatgagatcatgtgatttcatttcctctgttagggctttctcaccacttgtaactagaatttaagaacaactttgttgcacttgaaaaagaattaagctctgtaagcctactgctttccactggcccactccagttttaaaattgctttgcgatttttatgaaccacccctgtgaagttaataaaacacaaacatggtatgcattatatatgagagggaaatagaaaatgttcaacataaccgcttttatcattaagaacaggcagcatacagaatgatttaagaataagtgctaatgtttatgcatttttgtacctgcacatatattagaattgacttcaattcttagtcatggccagataaggacacaatggctgtaggaagggcaaagtaggaagaagaaaaaaaggggaaggaaaggagaaatagagtgaaattaatattttatgagcttccaaaatgtatcaggcactgtactaggcattttcacacacccaattccatttaatccttaaaacattcttgcaatatacaggcttttaaaatcccaataatattaataacatgtgttaggtacttagagagaaagggagggagggagagagagggaggatgaagaggaaggggaagaggaggaggagggagtgacaaagggaaagagaaagggagagtggggaggagggaaacccaacgcttgcctcattccaaaatatttgggcttgattgactttgggaacctgcattattgatctcatgattctgagtctcccctctacctcatgcaactaaattcaattgttaaattaactggatctttgtgggtataatatcaaattagaactaaagatacttgtttcatagtcaagagccaagtggttgacccagttcacagctcttcagctgctcttactacttctgcagaggctctaatttatttattatttttttttgagacagagtctcactctgttgctcaggctggagtgcagtggcaaaatctcagctcactgcaaactctgcctgctgggttcaagtgattctcctgctcagcttcccgagtagctgagattacaggcgtgcaccaccatgcctggctaatttttgtatttttagtagagatggggtttcaccatgttggccaggctggttttgaactcctaacctcaagtgatttacgtgtctcggcctcccaaagtgttgggatcacagacatgaaccaccgtgcccggccagaggttctaatttgaagaggatactcatttgcatcttcccacttccatgggaagctgttttttaccctcctcttctggttgcagatccttatcatcttgaacaattgttgatcctcataggtaacttttttttatgtgtataaatttaaggtttacaagtgcagttttgttacatggatatattgcctagtgatggagtttaggcttttagtgtaatcatcattggaatgatgtacactgtatctattaagtaatttctcatccctcaaccccttcccacactcccacccttccgaggttccagtgtttattattccacactctatgtgcatgtgtgcacattatttagtgcccacttataagtgacaacgctaggtatttgactgtttctgagttgtttgacataagataatggccgtcagttacatccatgttgctgcagaagacataatttccttcttttttatggttgcatagtatgccacggtgtgtgtgtgtatatacatacatgtgtgtgtatatatatatatatatatatatatatatatatatatatatatacacacactacattttctgtatgcagtcatccgttgatgggcacttagatcgattccgtgtctttgctattgtgaatagtgttgtgattaacatgagtgcagatgtctttttgatataatgatttcttttcctttgggtaaatcacagtagtaggattgctggatcaaatggtggttctatttttttttttttttgaggaatcttcatactgttttccatagaggttgtactaacttgcattcccaccaacagtgtataagctttctcttttctctgcattcttgccaacatctgttttttttttttccgactttttaataataaccattctgactggtgtaagatggtatctcattgtggttttaatttgcatttctctgatgagtaatgattttgagcattttattatatgcttgttggtcatttgtatgtcttcttgaaaaatgactattcatgtcttttgcccgctttttaattggggtgtttttttaaaaaaaaatagtgacggcaggtggtatgttcctcacacttgacttgtcatttacaactgaatttttcagctcacgatattgaaatccagaaccactttttctatagtcaagtgtgattcagcaaaaaataaaaccttcttgcattcatttggaagtaatatatgtccttttggaatttctgtgtaagtccttttttagtgagaaaaaaatcaagtccaagttaaaatgataaaatactaaattcggtgttgccaagtagagtttaatttcaattcagatactataatttataattctgggtcttaggagccaaagcctccttagaccatccctttaatccaggcctatcatttggagatctcatagctcccttcactgtaatcaccgtctggtgctagatagtggaactgagatacttctttgctaatgacctacttgctttcagatacagggcaaccagcggatggttcctgggatctcatctgatgagtgacatctttccggacagaactgatgactctctggcagtaaaagggtggagagggcagggcagatatgtttcacgagcaagaagggaaatagtgtgttgtaaagctttgctgtaggcctgccaggatctggtgaagtgggtgggcggggagagcttgtgttcacagaagagtcagatggttaaagaatttatgataattaaaatgacgtttctatgtaagtctgaaggaatacagccataaaaacataattgctgtaaaacatgctgcatcagactaaataaccacttgatgatggcaactatgcctgtgccataaagaaacctgtgcttttgtgaggagaaaaaaatatgtatttattatggctatttgcgtctcatgttaattgttcacaacaaagccattgattaagcaatgactccttacaagatggggctggatcaaataatgcacagagtacagcaaacaaaaaatggttgtgagatgaaaggatgattctgagaaacagggtcaagctgagaactctctgaactctccttgggcacctgcagtcatagttctagaagtgtgcggaacaatttgaatgagagattagatctgagtttcggggttttcttttcccaaattctactctgtaaagaatggcttgcctggatatggaagaagtgctaatggagggaaacaataaggactgtttcacaggaacctgccacacagggttcctgtttgaggtagagatttagtgacactgcctgaactcaatcagagtgaagccaggctttctgcattctgctagtttcactgcaaactgtggccagtggggccagcattcagtcagaaacacctgtctaggaagtcacaaggccatttatgattagtcttcccaatctggacatcatggagcagactcaggcacgtgaatggcgtctatttacacacacacacacacacacacacacacggctatactgttttcctggacaatcatttttcccacatttcctggaggaactactggaatcacaaatcacaatttgtggcttgccctgggtaatgagtcattggatggaatttcatttggtagatttaaagagagttagtgttgatctatgaagccagatgatttaagaaattgaagcagtaacaagtaaattgcttttctcttgtactgcaaaatgctttctaggcgtttttggcttttctttttaaaatggatttataatgccatttctctccacctcacggctcaagtaaacctctttgctctgatgaatcctaaatgactcctcatttcccacaaacagattgttcaaaggagttcttaatatcttgttttacactgtggaagctagaatttttaattctataggacacacaaatgaatatacattccctgttagaggctttatttattctgactcctctcatgaaaaattatgtccaactatgttcaaattccttgaccttataatcaaggcctgccactaaccaacctaaactcacttgcctttatttatttgttcatctggaagcaataggaaaggcttagaatctgccatgtagtatgctagttgttaaagaggatacagaaaagaaaaaggatctgggatacagataagtccagctgcttccttcaagcaatttactggccattggccagggcagatatgagagtggacacttctatgagatatgttgaacctgtgttgaagtgtgtgcaaaggactatgagaggagaggagagctgttgcttctcacagcagcacctcctctacatgggatgcagagagtccaagaatgctccaaaatggccttttccatcttcataatggccttccagccttcccatttgtgggcacaggggccccctgccctagcaaccttaaggtgccctgttgccagtacccttgagactccctcatgtttacggatagattgtaaattacacatgaaaaaggtctcatattaactattttaactttacagaaaccccacagaagtgcagcccacttggtcttgagctccttgaaggcgaggactatgtgatgccacatctgtaacccaagaacccagcacaaagtgttgcacatagcagatgctcaataaaagttttaaactgctgggggaagaaagtactatgggcatctggaagaggggccagctaactccacataggggactctggagctgtgctaaaaaatgtgtggtccactgcttcacttgaagagcctaaaaaatgtgtagagatttatgagggattaataggctcaagaattcgaaagggtactccagacagctcagagctcttgcccccagaatatgtgaggcatcgaaacaggaaagtaaaatgtttctagcagatttcttcccccctccaccccagacagtcttgctctgtcacccaagctggagtgcagtgtcgcaatctcagctcactgcaacctccacctcccaggttcaagcgattctcctgcctcagcctcccgagtagctaggattacaggcgcctgccaccttgcccggctaatttttgtatttttagtggagacggggtttcgccatgttggccaggctggtctcaaactcctgacctcaggtgatctgcctgccttggcctccaaagtgctggcattacaggcgtggcctaaaatgtttataacagatttcttatcaatctggttctctaaaccacagggaccacttggtgaacctgaagttttgtgactacaaggagatacataaatgtgtatttgagttaccttcatacagctacaatttggagaaggacgtccaggaagatactgagaggagaagtaatcatcgggtactgtttaagagagccgctgtcattactgcctttactgggttggggtcagagacaggtgggggaggtgctctgcaggttgtgttttatgtaattggtgctccgtcctcctccttctgttatatcactcatctgtgcagcttttcatctcatatgtattttccaccatggtggcctttgtaagacataaggtgagcaaactgcttattaaggtaagacaatggaggccccattttaaaaaggttaagatgtcctcaaaagtgtcagcgcatcccaggaatcattaacagtgtatggaatgcacagcctggtattttccaaaggccacactaaccttttcaagcatggaacaggctaaaaggaatggatttcttcaccatttgatgagagaagaaatctttttaaatgcttatttttatttgcttgctgagaatcatctctgtgaagctcaatatggagaaatgaattctgaacattttagcaactcacttaaaataccattagaaagcacttgggttattaaaagctgaaaacaaaggactaggagccctctggcactaataacacttagggagaaagcgagagccacctatgccctcatgtttgccaaaaatgtatttgaatttaaactcttcattgttaagaagggaagcttaagttttgccaaaccctttttgcctttcagtacaaccacttttccatgtaattggctcaacactgctatttgcataattgtcatatttttctgcttcccaagagggctgtaaagcgtaaaggtgaactgcaaagctttgacaaagtgcacatttatgtgtgatgtgcaattctcaaattacgaagaaaattatatctttttcattgagtttatcttacacttggaaatgaagtattcagaactcattgccccctgagatgagtttagcctgcttttctttaacttggccaaagtgcaatttcctgagccttgggtcttcaaataatgatgttgccacaggaccttgactgtatgaatgacctaaagcagaggcatttttctttaagccgcggaataacaataagctcttttagttggaatcagagatttcatcacagctgggccatccgttaagctctgagaggtcaaacagatcatttaacctctcaaagcctcagtttgtttaactgtaaaatgggcatgcctttaactcacacatgtattgagtgcttatatgtgaggaagtattttacccagggcttggtgcatagtaagtgttctaataaacacatgatattgcctcgttcctcttcttttatagcaggtggatggcatttaaatgaatgagagggcttgaactttggcacgggaaaagaatggagttgagtcctgcctatgtcacctttttagggagtgggaggatggggttgcagagagctgtgtgaccttgggcaggttacatagcaggagagcctcagtttctgtatctgccaaatgaggatggataatagaatgtgattgtgcatataaacagcatgtaaatgctcagtgttacctgtagttattaacatttcatccttaacagcggtcattatcaggtttaagatatggccctatgaggagttaatgggtgcagcacaccagcgtggcacatatatacatatgtaactaacctgcacattgtgcacatgtaccctaaaacttaaagtataataatttaaaaaaaaaaaaaaagatctggccgtgaaaacttatgttccctccaggtttgctgtgtgttgtcccatcacttttcacattggggagagtggaatgttcaacttcccttcctgtgaatgctcctggaagcctcctgcttacttccccaagtggggactagatttttacaggtttcctaattgctgtgtgcttctggctgcagcctgagggcatcagattacagtgccaaatggaggaatagtattctgggtgtgatactgatcagatcaggaagatatcaggacactagacatccggcatctgacagctggtcacaggggtcacttttgatccctagtttccccttgacaaggttagccactacatgccaagtgtttcatgggcagaattctagccaagcactaaactctgacagagaaggagaaatacaggctggcaggagggctggcattgccctaatgtcacagctggcactcacattccaatgaatgaatcttggatcaattgctaatgtacggggcccaacacaacattaacagatcaaaataagaggaagttggaaagtattcaagtttccagaaacaggtagttaaatatattaacgtaaatctacttgataaacttatctaatcattttaaaaaaatgaaaacatggtaattaatgttagaaaatgcttatgttgtaatgttaggtcaaaaaggataaaaatatatagtataattagaaatgtaaaacaacaacaatagacaaatctataaagacagaaagtggattagtagttgccagggtctgggaataatgagggttgtggaatcattggccaagggacgtggggtttgttctgggagtgatgaaaatgttacaaaattgattgtggtgagggttgcatcagtgaatatactaaaaaccactgaatggtacactttacatggatgtgttgtatgttatgtaaattatatctcaataaagctgttactgacaacaagaacaagtcttatacatacaaaaatagaacagaaagaaattttccagaaggctaacagtgtatataagttagtagcaaattgggactgatttttcttctgtattttttcacattttaaaatacagtgattaagtttaatgatcacatatgtagtctcatatattaaaataaaaaaactattggaaaggcaaataaacaaaaatgaattaatgccaacttttttagctcatggaattgaaaatataaataatttaaaaagtaagagaaaaaattatttttaaactagatgaaaatgtagcatagagtatgtggccccgtgtactctggattaaatatcaatacttaaccttttcattaatattttggcttgtaatgaaattgccaaacacaatggtatacataagacacatggcataaatattggaaaatctgtgataaaaaaatttttaataaactgttttctcagaattgacgtctatccttgtttagatttagagcttttgaaactttcagaatataaattaaaaattatctttgtaatcataatgcacccctaatttacatgtcctgatcttaaatctattatttatattagcttttatcaaaacattcagataagtgatcttcaaatgattagtacttaagtactggttggagatgaacttttgcaagtgaacgtcatacaatctattatttctattggagcttaattctgaagctcagagactccctagctctcctcgcctcaccatggtaatttattattatcctttgtctcctataatgtttgcttctttggcctacctgtagcataaaccttttggttgttctgcagctatttcagttaaataactcaagccctaaaaaccacagaaagaagagaatgtgcaaagcgatcatatttatggaccaccagatccttctcagcataattgccaggctttttatactgaaaggcaagaaacagctgccttgttctactttggtgtccaactcagctgtttcagattcatcctgttgctttaagcatctgttgacaggtgggaaagctcactgtgaagagaaacattgttgccctgggtggcttctgcctaagacaggcctgacccttttgtttctcccctggaaaaggaccgaagtgttccttccagccttattaagtacagctgtcgggtacattttagtagatgagaaccatttccaaagtatctcggttctgagaactgagaggcagtgtccagaaggtagttggacaagctcgtgtgctgtagaatgtctgtaagtggctgggacttacagaggagaggcccgcacgttgctagtcctccttgtcttggacatcttgagcctcccacttgaatatcctcttaggctctcattttgtaccagaaattctggaaactggaaggctattttgttggaaccccttattttacagattagaagaccgatgccagggttagttaagtgttttgttttatgctacaaagttggttagtggaattcttctgcctatataataacatcacagtatttcagagttgttttctgtcctctctttgtcaggtttctgggaaatctctttctcctcatgtttattatttggcccttaatccagcataataaaattacaggtacatatagtttgtcacaggatttccagttaggtctcagagacctaaaggaaagaaagttattgaaagttctggaaaaacaaaagtcctgagatagtttcttgacatacatcttctttgaaatctttaaaatcaaacaaaacaacccctagtgtcttccctgtcgcccccttcactaccttcttttgtattctgcatatgtagccattctcttgggcaatagcagaaaggtacatgtggattaatggaatttatgtattcactggcggtaaaaggcactgggaattcctgcactgggtgtaaaaacttgggccttggggacctcactaatgacttttcaagagcagttctttacagagcccaagtcttcaatcttgtaactggaccatcaaccccagtgacagcctactttgaaggaggcctcataaagacaaggttcaggctctttctaacggttttggctaatggaagacctggaggggaaaaatgaaattgttctcaaacttcttacaggtagaaaggagaaaatctctggaagttctgagaagtgacaggaatgtaaaattttgtgtttaaaatgtaagaagtagcaggggatgatgaagaatgcttaaaaatgcttgtttttattataggcagtggaaaaaatgtgagtctcaatttgcttgccctggaattgctccagctagcagaataaatcaaggctagaaccagatcagaatttcttacgagatgacagggatctgaaggactttacctctatagtcgttttgcctttttaggcactgggtgacctggtcccatgtccatcctagtgggccctgtatgatccaatccaaaggcccctttaggtttgcgttttatcattccctctttctcagaatttgatgtttgtatgtaaaagcactctggaaaatatttaaatcatggtacaaatataagagaagtcatgcaggtatggaattgctttgagaagtatcattttattaatttgtctggcttgataccaattacctgatgcagttgttaagggcagatccatccagaaacctttgggttctctgctccctgattttgttttgcaaattatataaccatacttcatagaaaacaccagtggtggctatgttgttcacagacacaaagtgattctaaggcaaccacaggagagagacacaaaagaaatcacacaaaaatctctcatcacaacataaatattgtgacaattgtgtggtactttttgtcttttttgttctctctgttccttttttgtcagtacaagtaagtcatcatgaacaaataagcttttgtatcctgcttttttaacctgacatgttcacagaacataacctagtcacacacgggcaagtacatcttctatccagtgatttgtttcaccatcaccctgcacatcacttttctcatgtttcaaatgatttcctcagaagagacatctggaaatgggattactgagtcaaagattctcaacctcttttaaggcccttgatatgtagtggcaaattgccttcctgaagggctgtgccagttgacatggctggcaggggcaaggcttgagtcttcctctggacctgtacatgggtacagttaacattaaatttttttaatgagtataatttacatacaataaactggacaagccttcagtgcataggcttggggaatttttacatacctacatttgggtaaatgccacccagatcccagatctctctctctgtagacagatagatacatacatacataaatacatagatacatagattgatctatctgagcagcatttatatttatatatgatatatcacatatgatttatatatttaatattatatatgatttatatgttagtatgaatcatatacacataggcttaatttatgcataaacatatgtgcttcacatatctttacatagataaatataaatataagtatgtatatatatatatatatatatatgttccttacctacaggatccaacacaagattaacttagatactttccagcttagatattaacttagatctttccagatcagaataagaggaagttggaaagtatctaggtttccagcaacaagtagttaattatattaacatgaatctactcgatagactattatgtcatcattttttaaaaatgaaaacattgtaattaatgttagaaaattcttatgttataatgctaggttaaaaaaggataggtgtgatttttatatataaaatatatgtacagcatatatatagctacatatttaaatatataaatacagcatatatatatttatatacttaaattataaatatatgtacagcatatatatacttaaatatataaatatgtatatgctgtgtatatatttatatatataaatcacacctatgtttgtgtgtgtatgtgtgtgtgtgtgtgtgtgtgtgtgtgtgtgtgtgtgtgtgtgtatatatatatatataaaatatgatatttccattatccccaggaagttttctagtgcctagttggtatgtagtgcccagtcggtgtctccacccacccccaaggtaaccactattctgaaagtccctcatttttgagtgatttcggaaatgttcttctctcatctgaaatgatttgacaggcagtctctgaagggagattgccatggctttggtgttgctcggatttctgccaccttacattggcaggctcaagaagatatgcacagtctttatttcattgatgtccagttgcctgtattgagcttagctatcctgtgcccaggttgccttagggatcactttgtgactatgtgcagcttatccactaccttttttttcccttcaagaattaacaaaaccactaccatctgttctgaaccatgtgcggtagcaggtagggggtgacaatgaaggtgtgttacagaaataaagtaggagccatgctgactttaaagaaacacccccacccccaaatgctcctggctgttttctttctatagatgagttaaaacagagggtatgaagtgcttggtttgcaaatcctgcaatactttgccatggcaagtccctaggaagtagattaaaagtggatctcccagagtgattaggattgggcagataaaatgatatgtttgttttggtcaattgagttcgaaatacaggttcagacagtaaatactcccttgctgagactaaacagtcattttgttgttcattttgatgaaaatcatggctcccaattttccgtgaaagctatcctttctgagatagactggctcttcatgagttatgaagcacctgaaatcctctctaacagcaaaatcgaggggcaacatcaaggttaggaacatcacgagcaagaacttacggctcagcagtggttgtaggtgtaaattcagtgtcccaagtcagaaaccaagaggtgtaagcccaacatgaaaggcaaagaggggaggaaattaacaaagatggaggctaggaacaacgttaggggctttcatatgtaataatccatttaatatttgcaataagtttatgaggttgatctatataaatctccctttaaagggagggaattgaaacatgtccagagtctcacagttacatttcttctttgcctctttccttccctcttttctttcttttttccccttttcccactgttgacacattccaggacacacatcctcctcctgttttccttttccttcacatctttctcgtcctttgctgtaacatcctgtgccataacaaactgtcacttatccagtgtggcatgccctgtgaagccttccctgacaccgtgaaccatagtaagtttacaggacccttcagtgttggagttctatcttttgcagctcccacagcacctatagaagttgtgttcacagagcactcaacaatttctaggcttgaataatgctgtgacaaagatggggttctgttgggaagacactgtagccactgtcagcataaagatacaaatggtccttgtaaatggatggagggcctttgagtgatttcttatcaatggaagtgccttaggaaatgcccagttgctgccttaaaatcaatataattatccaacattggtcactgagtttgttcctttgccaccctccccacttgcatgtggaaacctttttggccatattttattttagtatttcgccaaggagttttcagtcatcttaattaataacaaaaacacatcaagctggaaggagatggcctgaccatagtacattcctttaccaggactctgtagacaggtccccagctggcatacggatcaggagctcccattccctccaaggacccgtgaacagttcacacctacagtgttagattagaacagatgtgaaattcaaatgccactaggttgttataggtgttctctgaaaagaacagtggtaaaataattagtgcatctaattatcagtgtgttcacatgctttatatttttaaagggccacagcagtggccctttatatatatatataatgtgagctatatatatataatgtgagccatatatatatataaaatgtgagccatatatataattttaaagttttttagtagtcaatttaaaaatgttgaaacgtgaaattaattttaataatatatatttaatttaactgagtaggccccaaatattatcaccttgacatgtaaataatataaaaatattaatgagatattttacttgtttttgttctaagtcttagaaatctggtgtgtaatttatacttacagcctacctccttttaagctggctatatttcaagtgctcaagagctatatgtggctactggcgatcatattggccagcacaggcccaaagaaacttctagtggagtctttcttataaagatggagctacgtttgttcataggcaaaaccaaaaccaaaacaaaaaatgactctgtatgtttattggtcccatgctctgtgctaggcactagagtggggagacaaaagggtgcagtgcagcctctaccgtaaagcagtcacacgtgaaaagtgaaatcattttggttgtaatttataatgtgtccaagcacaaggcagtttttgtgattaattctcaagcaagtgattctggcagcttaggactgtgagtttaaaggagaaagtaatccctactatttgagatggtcatggaggacaggggacattggacaaagtataatatttgtctgagatggggaaagaggagaacaagcagttcatgtgggggagacagcttgaacacatctacagaagcattgtgacacagagagtagattagcttggctataactgagaattcacataaaggaaattgtggaaagaaagatgggattccttttggctgtattaaagagagttggactatatagagagatggctaagagacctcagttaacaacaggaatgaaaataataatcgcagctagcatgttcctgattagggtccagtccctgtatcaaattctttgcatttttttgtcactgaatattacaaatgagaaagtggaatctctagagaggtagaagtacttgtccaaggtcacacatccagaaagttggcctagcaaaattttgaatacagaaccttctgagttcagagcatttactttaaccatcaggagatatgctcctgagaacgttggaagcagtgatctctgtgtttgattaatgggacgccccccagccctattgacaaaggtgctgcccaagtgctgacgtaccacctcaacataggacagagaatttccaggccaaggattctctgcagtttgtgtcctctgaacagatacaaatgggccttttagcatgatgcccctgaaagttgactgaagtcactgactcaggtctttacaacccagtgttccactagttggtttcctcctttctctctcctcgtataccccagtatcatactagaatactgggatctcagagaccttttagttcaaggccctgttcttatagaacagaaaacagaggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaaggcctgaaatagctagttgctacttaatgtttgctgcttatcattgcatttgctgggacctggtgcttgtcatgcttatgcagtacaaggagggaccaaagaggcagaagacagtccctgccatagtgaagtgtagtcattttagaggacaggactaaaaaacacgaagcaatgaacaaaccccccaaaatacaatagtgtgctgaatgatgcagtgcagatacttcttagaggtatttaggtgtagctgggctagattgtttctgtattgcatcaatagattggtccatgttgactattccacttcacaatatctcagggatggacaagatggcagagttcaggccccaaatttaccaaaatagaaattttctccatcaactaatgagtggataaagaaaatgtggtatatataacccacggaatactactcagccattaaaaatgaaataatgaaataatgtcttttgcagcaacttggatggagctgaaggccattattattattattattattattattattattattttttatgaagtctcactcttgcccaggctggagtacagtggtgtgattgatatcagctgactgcaacctccacctcctgggttcaagtgatttttgtgcctcagcctcctaagtagctgggtctacaggtgggtttttttttttttttttttgtatttttagtggagacagggtttcaccatgttggccaggctggtctcgaactcccaacctcaagtgatccaccagctttggcctcccaaagtgctggctttacaggtatgagccatcgtgcctggcctagaggcattattctaagtgaagtaacataggagtgaaaaaccaaaattcatttgttctgacttataagtggaagctaagctgtgagtctacaaaggcatgcagagtgatacagtggactttagagactcagaaggaggagggtgggagtgggccagggattaaaaaaaactacacattaggtacaacatatactactcaggtgacaggtgcactgaaatctcagaattcaccactatataattcatacatataacccaaaaccacttgtaccccaaaagctattgaaataaaaaaattaaaaaaatatgtaagttccatttcagcatgagaaatacttcttagaggagtgttcataacataggttagtccccatgagatttgtgcataaagaggactccataggcaagccattccatatcttcctcttggagacttaaaagacatgttcgttcgtatattaaaggctatacagctttcaaacttttttatcaaagtcttgcagtttgtaactttgactttaacccagtattaaccaaactagtcttcctacagagcctttatttcgtagtccatgttccatgggccttgtggcagaacacacaatgggaaatgctgctttacagtggactcttggctccccagtaatggctaaatgcctgatttggttatagttctgtcagcccctgttccttccaaacgagaatcttgtgcaggaagtaagaaagagaaactagcccaagctattttgacaacaggcctctgactgaaacaacctccctgaatggttgataaacattttccctctcttaagggaaaatcatgcacagaaacaagcacatataaataatttaccaagctgtaatatgctgtaaataacaaccctgctaaataatgaattaacccaactgctgattcataggtaaatgtctcttgtaaagcagcatttttatggattttatagcttagttaatatccactcatatttcattaggacacttcaggtgaagtattggggtaataatctggatatatttgaaactgacatagcacatatcaggagtccaggcagagtttggggagctgccaggatccttttgtcttagctagagcatgaggagagattgtactgggccttactcttctccttcctccatggtcttggtttgcccagctcctcagtgcaagcctgagttgctgagcaggatgcggctctgatatcagagagggtgtcctctctgagaccacgggcagggatggaaggagaggtagctctgggccaggggaagaaagggacacagaaatcactttggcctactcgacagagccagctcttctgagtttttatgacacaggtgtgcagactctggagctgaactctggatatttgcatctttaccacttattaactttctgacttgggcaagtcacttatacactctgtggctcagtaccctcacctgttaacagggacaataaaagtacctactcctagggttattatgaagattaaatgagtttgtattgtcaagtgctggaacattgcttggcacataagcaagtgctttcatttatttattttttgagatggggtctggctctgtcacccaggctggagtgcagtggggagatctcagctcatagcaacctccacttcccagactcaagtgatcctcccacctcagcctcccgagtagctgggattacaggcgcatgccaccactctcagctaattttagtatttttagtagagatagggtttcgccatgttgcccaggctgatctcaaactcctgggctcaagcaatcctcctacctcagcctcccaaagtgttggaattataggcgtgaaccaccatgccgtgccagcaaatgctttttgagtacagtattagctgttatatttgttagaactggactcttttagattcttcattttggcattctccagctctggtgttggattctgagaacctagaccctggggattggagggcctgggtggggagggggtcaccgggatcactcagatgcctcttcttgcctctaaagaatgggaacgggggccaagtgcggtggctcacgcttgtaatcccagcactttgggaggccgaggtgggcggatcacaaggtcaggagatcaagaccatcctggctaacacggtgaaaccccgtctctactaaaaatacaaaaaattagctgggcgtggtggtgggtgcctgtagtcccagctacttgtgaggctgaggaaggagaatggcgtgaacccgggaggtggaacttgcagtgagccgagatcccgccactgcactccagcctgggcgacagagagagactctgtcttgaaaaaaaaaaaaaaaaaaagaatgggaatgggaagcaggaactatgatttcattacagtgaggaaaaactgcttttgatgatctctcagtaactataagtaagaaatattctcttatttaaaaggaatgttatctatctttgttaatgagggttttatggtggggggaggtgatgagaattatcagtcaaatcactttgagaaggaggagatctgaatttcataaataaaccctaatttgttaatgggaactgatgccaaaaacaaggagtttttcctccttgcggtgacactgaatgtcctgggctgtggagggtagaaacaggacattctcagtgttccagctcacaggggtggagttagagtaaatatcctgcccagtttgccatcacactaacactgcataccctatcatcagcctaatgacctttcaattctgattgaatggaagagcactccggcccttgatccaactcgtggttgattacagtgctcatgccccattaccccaaatattcctataaattaccagagcgagcattcacgcttatacaccatcatagatttagctcatgccggtggttctcgatagcagccatctgaagctccttttgcccacagctccctggatagctccaccattccctgcatgctagtcttgtggtttggtcttcagcctgctgtctgtactttctcacacgttgcatgggctttctccgatgcctacaagcaaaatctcttttccattcttcctttctctggctcctgggttcagaaatctctagggatcattatcagtcctctggctgccccctctcctacctacctccatctaccctagctctaggacagacctatggcgatgcccaactttctgcattttgaaataggggtgattgctttgacttgggccctatctattagggtctttcatctgtctattttggacaaagacaatagcagtgaagcagggggcctttgcattgagaggctcagactctcaaactctctcttaaaaaaaaaactgtctggcattaaggggcatagtctgcttgccttcaatagacctcaggctggggaggctcgaggtgcctactagggcagccagtttgcatagtgccttctaaaagcaggaagagccacccttgctgccttacagcctttgtccttgggccttagaatgaaacgcttcagagctcacaattaacatttggccaagcctcttcctcacccccacccccgtgaagtgggaagaaatacggtggcgtgacattcactttgacaaagctctttttcttttctctacttctcaaaaaagcctaaagaaataaaaacagttgctaagctactgggtgggctctatcggtgtgttttgttgcagtcttggcgttaaggactcatgctatcatatatgcagcagcttagactaaagggaggaagcaaagtgcttgagagggctctcttgcaagttcacttttttgtcaggtcaagtgcttggctctgggatggcaggggacatggagcatgacaactgcaattctctctccagatgggaaagtagaagggaggatttcttccaatcctcaaattcttccaaaagagaatgctgttttggaaccttgtctttctttaccatttatttcagaaaggttggatctctaggaagcatgggtcatactcttagttctctgggtattgtcttttgtacacatcacatgcagttggtgctactgatggggcctggacactagctagttctggtgagctcctagctcagtgtgccagaccgttgtactgtattgtatttaatttttttgtctccagcattttcttttcaaagctggtgaatcccaggttttgcaagttttcatttaacaacattcacataatccctaaattcagcatggtttataacttgttaggtccgtttgctatatacaaatgccatacctccaattggtactgaggaatggttccccactcctgatttaaaggcattaacactgagaatggtggaaagagagcctatttcccaacactgctttgcaacatcctctaaatctttcataatggcctaatccacccattgcgcgttggttctcagtgtggggacaatgggggcattactgattttaaacttgttttcatcaactagctcattctgtgtagagttgagtttagaaaaaaaaaacataaaaattaatgcagcctgggacaccctctgtggaggatacattgaaaatacatcttaaataaaaacccaggaaattgtcccttctgtctttcacctgtcagaatcagcaatagaattctatagaccattcagtggcatacttaattaagcaacctatctgctgaatgtgctgggggttggctgacagtgcttttcactgctgatttggatgacaaaggatatggtgagatactcaacagtctggtggaatggaaagaaactcccaattggtcacacctacctatttctcttggcatgttgcattagctctgataatacagaaaatagactggcttttatgcattgagaaagtcagtggacaccaacctcttgccttttgctcttccacagcaagccctgagttttgcacacatttccattacagatgaatacagattttagttgtaggtgagaaacatgagcttgtaattttcaagagacaaaacctccagctgctttttttaatcctagtgcagaatagttccttcctgatcatcattctatattttgatggcagttattgcctatccctaatgtatattattagtattagggacagttttgcagtgtttatctggtgccagacacatgccaaagcatcatccctcttgccaactctgtagggtaatactctattttgcagatatgaaaattgaggctcaaaaaacttaagtgacttgcctgaagtcactcaaccaaacagtaagtggtgggtcaagcttagaacatagagctcttctaccctgcagtccgtgcttttaaccgctctcttgcatcgtctctcttgaaagccgaaagagtgtcacacagtacaactattaataactaggggttggggcacacgtgtattaggattacaaaccttttgggagtctctcccacaaaattgggctcttcacctaggttttgtagagcctttcagtatccataaagcccttcaaactagatgcaaaaatatgtgtgtatattcaagggagataggccagagttttcatcaacttcttgaagaagtccatcacacacaagagggttagtaacttccacataatcctaaagtgcatgtagcacttgccaggcatgaatatgattcatgaatatgtgcatgaacttaagcaaactcatttcattctcaccatagctatcagaggtaggtatgattatcatgcccattttacagaaggggaaactgagactaagagaggttataaagctaataagtgacagcactgggatttgaggccaagcagtctagctcctgcttttaatcacttttgactgcaatttcctttttatttacttgcatatctccagcacagtgcccgacacataatgggatgtttattgatatttgttcaattgaattgatttgcacactgccggctctgtgtagatttcatcttaggaatcattctcaaaggtgtgactccgtaagtcttggctggacgaatgaaaagaatcaacatggtcaaaagataatttattagagtttctaaagacaaatggcttggcaaagcataggcattttactttcaatcagtgttccctggagggctgttacactgatttccaagcccattcttctcccaactggctcactagattgttccaattggttatgtggtgcccctgagtatgggctaggtaactctgcaggccccatgaatctatgtgatgtttcatttcctgattactatgcataatctcccctgccttttatttccaagtgaccaaccagaagccacccaaaccctctgcatattgacatgattcaaatgtaggtctctacaaggtatgccaagcttattgaggggaaggtggggggagatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacatgttccaaggtttaactttgtggcctccactgtttccctaattttacctgctgcgatcttattttacttttcattttattctctaatcaccgccaattagagccctgagtccatgctggttctgttgtctgcctctcagcctaatgggcctctttgtactgaggcacagaacccagctggcagcgagacttcctagggcccggaagcttcattactctttgttggcagtgaactctaaagttgctgtctttggagttgggttttctcaagtacagtcacttaacatttggtctcaaagttgttgtttttcagatttttttctcttttttcctaagtcaatcagatgcatgagctaattataagccagcaaatattttgagaaaacttccctccagtggagacccttgcacaaacttcagactatattcccagtaattaatatgctccttttatttcctttgaggtggaaaacagtcattgacaatcattccctacccatttggttcaaataactaattttgtacctgaagactaattacagtagtgacaccatcttttcctattaggtctctcacttgaagaactcagagcaatttataacctttgaatcttggggactagtttaatctgttcgtgggcagcatagcagtgaacattgttatcagaaatatagttaaacctctttaattgagcccctattaattcaaaaggtaataattcaaacagtgtgaagaacaaacttgaaacgtctatgacaagaagaaagtaagttggcaaaggggttatttaaactgccaagtagagcacacttttagaagtgccagttcacatgcaaagaactggtaagtacacacaaattgttccattaatagactcagaatcttaagattaaaagccctgtagtacaactgttcataactcaaaaaacatttgttgagtaatgctatgtgctggggcctggggatataatttttttgttaatagcttcattgagatataataaatacaccatataattcactcatttaaaatgtacagttcagtgatttttggtatagtcaaagagttgtgaaaccatcactacagtctattttagaacatttcatcactctagaaagaaaccctgcatcctttagccatcactttcccatccccctattactcacagccctaggcaaccactgtggggatacaaatttgactaaaacacagtacctgcctttgagaggatggcaagctattgaaagagacatcaggcaggtgaagcgtacttatcatagcatcgtagaatgttgatattgagaggcactaagaagatcatcagatataatcttctcatttcacatatgaggaaactgaggcccaaagacaagaaatgacttgcccaagaacaaaaagctaacagagccaaaattaaaactcatgtattgtgccatcttagcctgttgcaatgttaattacaatacaaacttctggagcatagtaacagttgagagcatggattctagagccagactgcgtggatttgattctcagcttaccttttataggctgtgtgacctcaggcaagttacttaacctctctcagcttcagtttcctcatttgttgtcttgaaataataattgtaactaccttataggactcttgtgaagattaaatgagtttctatatgaagtacttaaaatagtgtttggcacagaataatcgatacataaaatgattgttattattatttcattacctagttattaaatataaaaacatttcgtaatgtcctaaagtatattttaaatatttgttcttcaggttttaaatcctgactgtattcatacataatttctatttcgtttcttccaacatatatttttgagtgttaggggctaggtataaaaatgatgtttaaaacagagttcaaatgcctaagaagttcagtcaggtaaggaaggcaggtgaacagatatgtagctataaatcaaggcaagcaacaggaagtgccccaaataaagtatgtatgaagcataaagggtataagaaaggcttcaaggaggctgtggcatttgacttgggttttaaaatgtgagccagatttcaccagactgaagagggcgagagaagaagacattccaggctgaggtaacagtagaagtggagaaaagaaagtatttgccatggtttgggaaaggctaagtgttgtatgtgttcatcgcatagggttttgcaagatgtcctgggagacgagcctgaatatagatggggccgtgctcagtaggaaaagggaggagaatttatacttactgaacaccttttatataccaggttctgaggttgggcgcagtggctcactcctgtaatcccagctacttgggaggctgaggcacaagaatcgcttgatcctgggaggcagagaagtgagccgagatcgtgccactgcactccaacctgggtgacagagtgagacaatgtctaagaaaaagaaaaacaaaaacaaaaaaactatataacaggctctgtaaaataccaagtactagatatgtatgggtaactattttgattctcacaatcatcctgaggaagcagtgtagacaggtgatataaattgatcaatatcacacccaatatgtggcagactccagattcaaactgaagtctctctctgatgctaatgcttattccctctccatataccacaccaactcctgaacttctgtaccagcttggacgttatggaaaatgggagctttaaatgttcttgaaggccaggcacggtggctcacgcctataatcccagcactttgggaggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaaaagtcaattgtgaggcttttacggtaggtaaaaggcagcgaggacatgaactaggggcgtggtaatggagaggaggggacacatataagagagggattgacaagacaggacatgtgaccaatttgatgtggtcagagcaagagtcaaagagagtcaccaatgaaggcatgattttttcagcctgtatgttgtgatgggttgaactgatggactgagataagaagcctgggcatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataaggaaacggaggtcaacattgctaagcgctaaagaatggccaagttagatagactgaaaaatgtcccttggatttagtaattaagtaatttagtaattaaagaggttattgagtaataagaagcaaaccaagtagaatattatgggtggaaattatgtggcagtggtttggaaactgaatgaggaatggagacctggagacataaatgtagacaactctttctagaaacttgtctggtaaggtatagagagatgacagaatcttgaagacaaacagatcctgaataacttttttttaattatggagaaagttgagcatttattttggctgagaggagtgagtcagtgaagaaagagctagtaaaaggggagaaatcgggggataacggataaagattggagaggtagcaagaggaccaaaaggaaataggaaaccacagagagatggttagctatggacttgagcccttcctctgagatggggttttgaagcgaggatgcacaggggcacagataaactaaaggctttttccaacagagtctgaggtatttgtgattgattattttctttaatttagaattctctgcgtaagaaaccttgctctttttacactatgtaaaatccttatggaaacaagaacaacaaaaccaaacacaaaaacctactttatttaaatgtgggagaagggcttgaataatttctcccccccccaaaaaaaaaaagatatacaaatggccaataagcaaatgaaaagatgctcaacagcattaatcattagggaaatgcaaatcaaaatcacactgaaataccacttcacacccattaggatggccattattattattattttattattattattattattattattattattattattatttgagacagagtcttgctctgttgcccaggctggagtgcagtggtgcaatctcggctcactgcaacctccacctcctgggttcaagcaattctcctgcctcagcctccggagtagctgggattacaggtgtgcaccaccatgcctggataatttttgtattcttagtagagacagggtttcaccatgttggccaggctgatttcgaactcctgacctcgtgatctgcccaccttggcctctcaaagtgctgggattacaggtgtgaaccaccgcgcccggccaggatgtccattattaaaagaaaattaaaagtaagtattgttgaggatgcggagaaattgcaacctttgtgcactgctggtgggaatataaaatggtgcagctactgtggaaaacagcatggtgctttctcaaaaaaattaaaagtagaattaccatataatccagccattccacttatgaatacagaaccaaaagaactgaaagcaaggatttaaatagatatttgtgactatagtcaataataatttaattgtacattttaaaataactaaaagagtataattagattatttgtaacacaaaggataataaatacatgaggggacagatatcccattttacgtgatgtgattaatacacattgcatgcctgtatcaagactgtacaaacaaaatgtgatatatatatatatatatatatatatatatatatatatattattcagcctttaaaacaaagttctgacacagctacaccttgaagacattatggtaagtgacggatgggtgaactttgaagacattatgctaagtgaaataagccagttacaaaatcactgtatgattccccttgtatgaagtacctagagtagtcatattcatagagccagagagtagaggttgccagaggttgcgaaagggaggaatggagtatggactttcaatttggaaagatgaaaaaagttctggagatggtggtgatggttgcacaacaatgtgaatgtacttaatgccactgaactatatacttaataatacttaaaataagttttaccaccattaaaaaaaaactttctagagccaccattttagcttgactggggtctcctgggttgttcgtaacctagagtagtggctctttccactgctgacagatagcaaatccagagcagacacctcgtgtaagagctacctcttagcagaactatgattcaggtttgtgtgcattacatttaagccagctgacatatcactttctttctcactgctgtgtacacaatagtgacatgatcaaacttgaaagtgcatgagaaacaatcacttggagaacttgttaaaaatgcggattcacaaaatcatctcttccatcaaactaatgtagtaggtatatcagctagtttgtgctatataacaagccacccccaaaactaagtgatttaacataactgtttattattttatagcctatgagttggctggatggttctgctcatctgggccaggcttcgctgatcatagatgtactcagctgcagtcagccagtgggttaaccagggcttggcttttccaggatggcctcagttgggatgactttaatctgctctacgtggcctctcatcctcaaaacatcagcccaggcttgtttttgtgctgtggcaggagtctaagcaagcaagcacaataatatgagggaacaagaagaaatgcacatgagctcttcaagtttctgcttgcatcctatttgctaacgtcctattggccaaagcaagttacatggctgagtggagattcagagtgggaggggtgtacaaagagggcaatagcaaggatgtagagaggtcactgggtccactaatgcagttaatctactacagtaggtttcagtaaagcctcggaatctacatatttagcaagcttctcaaagtgatttttttctttctctctttctctctttctgtctctctctttctctctccttccttccttccttccttctttctttctcatgatctcactgtcacccaggctggagtgcaatggtgccatcacagctcactgcagcctcaaactcacaggctcaagcaatcctcccgcctcagcctcccaaatagctggaactacaggcatgcaccaccaggcctagctgtttaaaaaaaaaattacagagatgaggtgtcattatgttgccaaggctgatctcaaactcctgggctcaagcaatcctcccacctcggcctgtcaaagcactgggattacaggtgtgagccaccatgcccagcctaaagtgatactgatgcaggctatcccttaatattttcagaaatattattctagtatctcttaacaccaagattggaaccagcatcattgaacgttcagaaaacgaagactcagtggggaagggagcacttattcttctccttatttccagcttatgattcaggcctcttggtctcttagaggcagatgctgaaacgaacactctctgtctgcttttcagacaatctcatataatcatttacttgttacaaagaacaatggagttggattaaactgataaagtgttatttttcaatgcaggtcaggaaggcattgttggtttgttttgcattgctcattataatttctatttttgtcctggggaagctcatggtaatggaatgaagcatcgaggtggtttatgggccatgtgataggatcataaagttgaggttgttgcttggacaatacctttcttagaatagtaatccaagcaaagagaacatggacaggaaagaaaagaaacaataagaagaaacttcagttatttagccagttgtatgaggttttcattgctcagatccttagttaaaatgtgggatcagaggcctgcaggtaatgcctgagctcaggaaaggcagggaccatgatgcttttgcattcctgatacgaaccacagtgccaaccacattgtcagtactcaaaacgtatttgttgaatgaatttctgctaattcctgggatctattctcagagattctgattgagcaggataagtaaatagtttttcacagtgtggtccctgaaccatctgcatcagaatcacctacagggcttgtttaaaaaatgaatgccagggccgggcatggtagctcatgcctataatcccagcactttcggaggctgaggctggaggatcacctgaggtcaggagtctgagatcagcctggccaacatggggaaacccagtctctactaaaaatacaaaaattagccaggcgtggtagcacaggcctgtagtcccagctactctgtaggctgatgcaggagaatggcttgaacccaggaggtggaggttgcagtgagccaagatcacaccagtgcactccagcctgggtgacaaagtgagtgagactccatctcaaaaaacaaacaaacaaacaaaaatgaatgccaggatcccaccttctacttcttgcgtttgatgcatgagaaatcctagtttacacattttattaaatctgggactggttgtaactggcactaatgtagtcttgtgtgaaggtagtggtgcgatggtcattctctacccttgccccacctgagagcctctagagggaaggctgtggtccagtgcactgacctgaaccctcaccacatgcgtcccacacatatggaattgggagcagtcatttagcatctcttagccatttcgctctaatttctttgtttgccatttttgttgactttttccttgggaacctgaatttaaactcatgccacttttttgtcttccttattctagtgggtaggaatttgatcttgaccccaaaagcaatgataggttcctacagttctgtaaagtatccattgcttctgaaaggccttctttccccattgtctttgacaatttagattttccaagtgctaggattttggagaaagtggagccatgagcccaggcaagtggggtagcctgataatgccctcccatgacacatggggctggggatgtaaaaacttcagagtttccatgtcaaataatctcctttgccctgtggccttcggttacaggaatcatttatattacaggcacattttgaaatatcaaaacaaattggacactttttccctattaggaagaaaggcatgttaatttaagtgtggagtgtgacatttggaaatgtaaaaagaggcttttggggagtagttgggggtttgagtggaatatctccctttttgtatatctctcttgtttttattcatcctgtgtcttattcagatagtgattttcattcacctgcctgatcttctggaacagggattttagagaaagccattttctcagcagctccacaagggcgagatttccaaatgggcaaggaaaggctgcagagacacatctagcttggaagtaaatgcaccaagccagccaaattggaattgtcttatagggatccttgtgtgctgtcacagaagagttttcaggaggctttcctttgggcactaatggccaaccactgctgctgagtttctcccagccttctggagggaatgccagccagcgcactctcagctgtgacatgaccctcctaggagctgttcaatgctagcgccgttttgctctgatgcccagcaccctctgcttttagtcactttccttagcgtcctttcgcagtgcttgcatttcagccaaaatcgtgcctcgtgacttttcttttcctagagttttcgcttctcacagtgaagaatctatcagctgtttcctgaatccttctatgtcttttaaggtgttaacattttcaattttgccacattcagcatttttggcctactctgacctgagctcgataaagagcatcagaaattgagtaaagacagaaataagtccctataagcatgagccctggcactgtccacttcctcctcctcccctaccctgacagcactaatctcccttcagctctactcattggaccccctttattctttaggctctctttagtgatttatcttagtttagctatgagaagaatcaagctttttaagggcttcgctgaaaacgtaatgaaagttgtttcaactctttaaattttaagtgaattgtggccatctcaggcccactagttcatgtacctgatacaatttttatttggagccactgtattcacatcttcctgggacaggatttcacataattggggtaggttaatgagtgtggatttggcactccctttctatagagagtggtaaggagctcaggccttggagtcagtcaggtgtggttccaatcctggatctactattaggttggtccgaaagtaattgccatttcggccattaaaagtaaccgcaaatacttttgcaccaacctaatacttagtagctgtgcagtcttgggtaactcgtttcacctttcttgtgtctcaatgtcctcatttgtaaaatgggcacaatagtcccaatcacataggttgaagactaaaccaaagaccccatttcattagcttagccttatccctggcagataccatgaactcatatgtcattataattatgataatttacttaccctttcaattaggggtataagatgctacacagttttcctctaggacagggcccgcaaaccatggcctgcagcttgcctgtgagctaacaatgattttcatatttttaaaaggttgaaaaaaatcaaaagaagagtgccgtttcgtggcatagggaaattatatgaaattcaaatttcagtgtccataaataaagttttattggaacacaactgtgctcactcatttatatattgtctatggctgcttttgctctatcatagcagagttgagtggttgtgatagagattctatggcctagaaagcctaaatatttgccaccttgccgaccacttgccctaagacatttagccatgtctctggaacatcactgtgatagatagttcaggaattatttgcatattatcatcactgttattccaaaactctgactgcgtgtgtttctgtgtggagagtgatttacaaaggaagaaattatacaagtcataacaaaaagaaaaaaaaaaaattacacaggtccatgtaagacaaatgagatgaggcttttgtggcagttttagctaaggactcactttgtgccttcgagggatcagaaagaatttagaagtagtagcaatattggttaggagaatttacagattctcttgttttcttttcctctatcagtaccttctctgcaaggaggagagaatggatgttagtttctccttgtaagatgaattgaattgcttgtgttagtgtactaggactctgggttggttgtgaatgtggtataccaaggcaaagtctcatctgagcaaataccaccataacaccctgttctcccccaaaaggcaatctctgtagagaattataaaatcttagaatatcaagattggaaggagcctggagatctgagggaatgatattgatattaatatctccttgccgatgtagatacaatatcctgtttgaaggcaaaacattgtgtaataaacccagtctactcaatctattcaactaaggtggcctctagtgggtgtctgagtactggaactagatttgaatacttgtgagatattaaatttcatatgctttacaaaacgtgcagccatccgggcacacaaacaaaatgcccacttttggatgtgaaagtgggggcaggagtttttcccatttaggagctaaaagctctggagctctggtcctcagattcatcttgtgtctggcctgtggtcgcagtgagatgccttttcagtagggatgaggtatacttggggctgggagaggggggacatttggaggtctggcctcccaggggtaggtatgtgtttagccgggctatgcagatgaaccaatctgggtgtctctgtcagggaagaggctaggaaagctgctggtgagaggggtcagagactggtttgccccaagggggatgggggaggcagggaggctgtagaggagctgttgggccagatcttgttgagaaaatctctcagacccgagacttctcccctcctctcatttcctatatttgggctttcacacttaagggactggtcttaaggagagatgtactttttaacatttgatttgcccatgttgtgccccgtacttctgcgtaccaccagaagaccacaatgacaaagaccagcgaaggccaaaggtggccatgtgtgtatagaattgacactccaaggtcaccggatctgcaatctaccaaacagtcttgactcacaccctcaggtttcatatttgaacctcctttgcagggctggtcctggctcctttcaccttctagactgcctttcctttcttactgtcctctgagaggcacactgaacatctgtggacagtggcagttggtagctatatatatacatgtatatatatcagaatttcctctttgtacactgtagcagtggacttccattttgatgatattatacagggtataaatctgcctatctcaacaagttgctttaaagaagaatcagtttcaatgtccaaactaccacttcagtaaagtaacagagccaatgccctgtgtctttttcctttatttatttatttattttgacataggttcttgttctgttgctcaggctggagtgtagtggtttgatctcggctcatagcagcctcaacctcccgggctcaagcaatcctcccatctcagcctcccaagtagctgggactataggcacatagctaactaatttttaaaaattttttattttgtagaaatgaggtttcaccatgttgcccaggctggtctcaaacttctgagctcaagcgatcctcctgcctcagcctcccaaagtgctgggattacaggtgtgaaccaccatgcccacccccctttttcttatgaatgggtgaagcaggagaagagcagtgagtatggctagagatgctgacaccatgtagtatagcaacttgtgggcttctgccttcttcctcaagatgaggccaagaagagcactgggacttccagcctctggtgcatgtgtttcctctgggctaggtggtatgtggtgtccaggtatctgcacacttgctcggggcagggttctaagcagtggatggtggcaatggatatggccaacaagagacaatcatggcagtgtcactgagctgtgaactcccacagaatcttttggcctcccaagctcagagaagaagcttaagggagaaaacctgtcaacagtccttttgccatatttattcactggagtcacacttttataacaggcataggctcaaaggtgtaaataaagccaattattttagttcagcattgattttcatatataaattatcaatatagttttgatttagtaataaaaataacagcctggagttttatcccctgccatggccagtgagagctgtttttaagctgtttctttgtacagggaagcatgtgtcaaagtcacacctcctgattaataaaaacaataaccttttagtccttcctatgttccaggcattgtgcagagggctcacaaatactatttcatgtaatgctactcataattctctgaggtagattagtatttgtatacgtatgttatagacggggaagctgaggctcaggaaatcacttacccaagacagcagctggcaattctaagaaaatttttgaaattctaaaatgcatctgaggacctggcactgtggctcatgcctgtaatcccagcactttgagaggccgaggtgggtggatcacttgaggccaggagttcgagactagcctggccaacatggcgaaaccccatctctactaaaaatacaaaaattagccaggaatggtggtgggcacctgtaatcccagttactcaggaggctaaggcacgagaatcgcttgaaccagagaggtggaggctgcagtgagccgagattgtgccactgcactccagcctgggtgacaaagcaagactctgactcaaataataaaataaaataaagcacgtctgctgccttcacaccccattttctgtaccatgcatgtcaacttctatagggcccttctcttgtatgggtgtccattaggtcatatcttgcagatatggcagagctagagacctagaggtaaagcaagatactaggaaaacaagtaaaagggagctattttctgggagactaggaaaaagaagagactaggaaaagtaagtgaagaagctctaactagtagggggccaataaggggcaaacaaaggagagaagctggctgcttagctaaccaagtagagagcctcggatctggaaggaactggaccgaacatctgtaactgggcagggctggccttgggcctgtcttgacttccttgaaatgtctcttttacctggcctccttctcatggctgtcatcaagcagccctgttgatcatgttcctgaggaaggacagaatggggttggggagattaagtttattagcaaggcaatttcctctagggagaccccaaacctggcttggtaactacagtgaaaggagagcgtttgagccccttcccccttctgcttgatctcctctccttcaccaggctttcttcagacctggttccaatcattataaggcagatctaaagccactcttcctgacactgaaactttgctgagcctggaaaaatcacagaggctcagtttggtgtttttgcatgcaaaatacgagaggcagaggtgaaggtgcattcctggtgccctgcggttcccaggcagtatctgagtgcattttcacctgttatcgcttgcctttcaaatattcgttagctcccccagaagtttagccacgagtcatcttctaggggaaatagctgctctgctctgtttgtagaatctcatagtttattttggaatgaagatgtattttcctggaaaagtgttactactttacagtgtccccttcatctgcgaaactgaaaaggcaggcagccttgctgtatgagaagaccacacacttgcggacagaaaaaagatgcatccgggcttctcttcaagtccaagacaattgatgacaaaggaagtatgacacaaacttattgagatctgttattatccttgtgctgcccgggttttagacaaaaacaataagcagattacataagtgagtgtcaccacttttgcataaccaaggtttcatttttctcttctcacttggttagtcttccgtgagctaagcaacatcatggtagttttctgtagtaccacttatggctttccttgttatcatcacctgcctttgacacatgccttcattaatgagttgatatatttaattatatgttatacagatattttatattacaagcaatgttaattgcattcattcagaacagctcccaattaaaatctataaactacttagacctctataaaaatcccaccatttaccttacagcttcacattaatatttaccctggagaggataaacatctcatcctgtatttatctgttagatcatttttgttgtcataaaaaacaaaagccacatgtttaattggatcccttcggtatgaatttttaaaataatagtaggaatccttacttgggaagatggtttcatagggcatcctaaaaccatcctttgttccaaatcctttgaggatgcacacatttaatgttttccttcttactactatgctatgaacttaacagtgctacatgctaaagtacaggcagcagaagttctctgggaaagtggagatccctagcaagtaaggaacccaagagaaggccattctaagctgtagtcccttgttggaccaagggaggaaggaaacagatagcatccacctggcgctgcaattctactggcctgtggggtggtctggctttaggaagctcactgtgtaatccatcagaggacaatcctgccaagtcttcttttcaagtaaaaaatgttaatgtttctttccatactttgtctcataatcaatattcaattttcaaggcagtaaaactaatcaaagaatataaaatgaatccaacacaagagaaaggagggagaatgagtaagctgcaaatgggactgagcaagaaaataggaggatattataactatagaattttttttttttgagacagagtcttgctttgtcacccaggctggagtgcagtgacgcgatctcgactcactgcaacctctgcctcccgggttcaagcaattctcttcttcctgttggtgaatttctcccaggaggcatgagccaagatcctgtttcatgggtttctgggtataccccttgaaacaccagagtcaggagtcaggaacaacacctagtgtattagttggttttcacactgctgtaaataactgcccgagactggataatttataaagaaaagagatttaatggactcaaagttccacagggctggggaggcctcaggaaacttacaattatggctgaaggggaagcaggaacgtcttacatggcagcaggtgagagaagaaagtgaaggaggaacagccaaacacttataaaaccatcagatgtcatgagaattcactcactgtcacaagaacagcatgggagaaaccacccctatgatccaatcacttcccaccaggtttctccctcaacacctggggattacaatttgagatgagatttgggtgggggcacaaaaccaaactctgttacccagttagaaaccggccagtcagcatgtagtccctctggagctcacaattgcagatcatggtatgatggagttctccactgcacggtaggctctggggcttaggcaggcatatggggcagcagtcaacataggggatggtgggagtgaggtgctctacagcagtggtcctcgacttttttagcaccagggaccagtttcatggaaaacaatgtttccatgggcttagggggtgggagatggtttcaggatgcttcaagtgcattacatttattgtgcactttattttgataattattatgttgtaatatataatgaaataattatacaactcactataatgtggaatcagtgggagccctgagcttgttttcctgcaattagatggtcccatctggaggtgatgggagacagtgacagatcatcaggcattagattctcataaagagcacacaacttagatccctcacatgtgcagttcacaatagggtttgcactgccatgagaatctaatgccactactgatctgactggaggcagaacagagctcaggcagtaatgcaagtgatagggaatggctgtaaatacagatgaagcttagctcgctcatctaccgctcacctcctgctgtgtgacccggtccatggcctgagggttggggacccatgctctacagcactgttatggcatgttccagactcttgagaatcggtccttccttgcatctcacctcaccttcaactttattgttcacttttagttcaacctttgccagcaggtaaagaggtaaagagaacaatgtgtcctgtgaagtatttatgagagaagcagataaatcattagatttattgagaacttttgaagtgcactaggcatctcacacacattacttcattgaatcacctccataatcctatgtggttgataattatattatccccacattctggatgaagaaagtggagctcagagaggttatcatgacatacatactgctcacaaaaccattctgtggcagaagtagattcaacagctcaaaaataaaagagggctgggcacagcagctcacacctgtaatcctagcacttttggaggctaaagtgggtggattgcttgatcccaggagtttgagaccagcctgggcaacatagtgagaccctgtttctaccaaaaaatgcaaaaaacaaaaattaggcaggcgtgatggcatgcacctgtagtatagcttcttgggaggctgaggttggaggattgattaagcctggaaggttgaggctgcagtgagcagtgattgtaccactgcactccagcctggatgacagggcaagaccctgtctcaaaataattaaaaaaaaaaaaagtaaaagagaacatgatgatttatggggaaattgacactaaaaatgtcttggatgaaataaagtgacccaggcatcaggatttaggggcttacatgggataacactgttctactccatagcacctcacctgtctaattagtgtctaattagagacatttttaatcagataagtgcatttatgaacattgcaatttttcccaaagtttaaccatcagtttctctgaaaggacttctaaagcctagaaactcacctcttgttaatagtgctgctcttcctcttaaggattctgcccaggagttcaacaccagcctgggcaacataggtagaactttgtaaagtggaataatgctattctaataacttatttagcaaacatttactgagcaattaccctgggtcaggcctccttgcaaggttctggggacatagacatgagggaattctcacccttgaggccatcacagtcagctagggaagaaaagaagtaaacagatcattataaaaccctgagataagtgctactgtgaaggtatgtaactctgtcccctgggtgctttggaagtgtgagagcttgggacattgtagcaggatgttggtagctccatcagatctggagtcttttccaccttgaacttgagatcagcctaaagccaaacacttgacttttaaatgatttgattttaacagaatcaactttttattatgcaaactcaaaagatgtattctgtagagttttactgagccttttttccctttaaaataactaactatatgttttgacatgcttcaggggactttttttgtaaaatagcacaaataggacaatactggaatacatcagtgtgctgtgaagcctgaatgagtaatacacaagtgactgcactttcaaaaatgtaaagaaaagtaacatgctaaaaatcataaactacaaagaggcggcatagcttggtgagacaagcgttgacttgtgaacaggaaaaaaaggatccctgctggctattctgctgagtgaccccaggaggtccctgttcctcttgggacctcagtttcctggttggtggaatgggtattggatgagaatctcaatctgaagatctgcattccctttcaagtcgctaaaatcctggacttctacgataatgctgcatccttctgaggttccaaacaacaatatgcagtaggggccccttttgcttccttccttgcatgtatccaggcagtctcctgagagcatccagcattggggaggaatggggtgtattgaagggaaaagcaggtgccccattgggaatgggacactcccgccccccgccctacctccttctttcaacttgacttccttttttttttttttttgagacaaagtctcattctgttgcccaggctggagtgcagaggcgcgatctgggctcactgcaacctccacctcccaggttcaagcgattctcctgcctcagtctcttgagtagctgggattacaggcatgcactattatgcccagctaattttgtatttttttagtagagactggctttcaccatgttggccaggctggtcttgaactcctgacctcaggtgatccacctgcctcagcctcccaaagtgctgggattacaggcataagccaccgcacccggcctcaacttgactccctttcttgtcactgtttctagatggtcaactagatcaatactcagatcagctcttctttcagaggaacaaatgagaactttcctcttgttctccatctcctccttctcctaatgcacacacatgtgcatacacacactccactgccatcactagagagaaggaattaggtccaaacctctgttcgcactcagagtcttaaagtgacagctttacgtttacaagttaggcattaaatggaattccattctccctgtcaagtttcagacaggggaaagcccagaattccaatagtgatggtgttcttggcaagcgctttttacagggtggtaagctaatcagtctgcagttcggcagtctgaaggcttgagctttcatctgacttggaatatataaagggcttggcattgcagcttccaaccctatgacttagctttgagcttcgcatcttcccatcaacttcgtagctctctccatcaaccaagtacccactacaatcaaggagaaaggatatggcagattaattgaatctttgtgtctttttagcacctgtgggctatggacttcttgaaattggagttacttttattcctttgaattgagcccaataccccgcttcagtcagggtgcttttaccttcccagaatcctcttgctaaggacaagcaggcaggctaatcggggactactgaagttttctggctcaaagaacataatgcagtgtgtttacaaatccacctcttcgccttcaccctaaattttcctttcctttatatgattttagcactttgggtttacattaagctctcagttacttaaagtaggctgaagaaaataagaagtgtagtagtgcttcactccccagtgatgaaatagggggtaattggctccaaaaatcgttgcatgtcttgtccctttcagggactttaactgctctgttgcccttgctccatggattggggctgcatcagtagcctaatgtgaggggaatggttgaaagtaattgtcagagcccagagctccacttgccatggaaagcctattgactttaatagtgaccatctggctgggcacctctgaagatgtctcagttaaggcctatttggtgaatggacctttgcttatttgaaagctacactgctgttccaacctgatcattgcattttatgtgatgggcactggaagtccaaatgaaagtttcttagaaaacactcccattaaatttaccagtccatgtgtgattgccactttcagtgcagtcagagcacagtcattctctttttattgaaagcatatggtaggtacttagagcataccctaggccagactcagttatggtgccatcaagggcagcaagaattaaaaagaggaaaatggtatccaggtggcagtaggaattcggtaggttggatggaaaatattcatagttaacgagctttcataaggagaacagaaacaagttagatgtgatttgcagatccataggcaatcagtctctgctgagcagaggggaaacttggagaagattctcagaagtgtgcctcacccttgacccaaacctttccctgaacatgtgcaataaatattattaagctttgagaatttctttaaaataatatctgtcaatggtaagtgccacatgccaggccctatgctaccagcatcatctcatatcatcctcacatgtatcctgtgaggtggaggatactatcccaatgttacagatgagaaaactgagacttaaacattaagttgttcaaggtcatacagctaagaagtcacagagctgctttgattaaagttctgtctgaggctgggtgcggtagtgcatgcctgtaatccaagcactttgggaggccaaggtgggcggattgcttgagccctggagtttgagaccagcctgggcaacatggcaaaaccctgtccctaccaaaaaattacaaaagttagccaggcatagtggtgcacacctgtagtccaagctacttgggaggctgaggtgggagaattacctgagcctggggagcttgaggctgaagtgagccaagactataccactgcactccagcctgagggacacagtgaaactctgtttcataaaaaaaaaggtctctgtgacttcaaggcctttgttctctatactattaggaagtccagtaagtgaagaaaagtacatgtaaatttcactaaaggatcacagcttcttgtacggaagggctttgagcacgtcggctgtggctcctgtgcagccagccagatctgcctaagcagctctgggagtagggccacacaggaatctgtcacagggaggattccacattccttcagcccctatcagcacagtcaaagaatggtaagaagaatgcagagggtggctttgaaatactcacagccttccatggataaaccatggagacattacactcatttgatagaagccagacacaaaaggccatattattgtatgattccatttatatgaaatatcagaataggcaaatccatagaaacagaaagcagattcgtggttggtaggtgatgggggaaagacttcagcaccatccccttccctctcagtctcagtgaagtggaaggaaggagtagtctcagctagggaaaagaggggaaaagctgaagacgacagatttctatgtctcccagtttaattacctttccctttgctctcgcctatgaatgccactgcctgcaggttcttagggaatcaaactgggacttcagtctggaaatgtgctttcaggacaaagacccatgcatacgagacaaggtgacaatcctaaggtggcccccagtacttcggggcagtggaaaggaccttgcgatgggtgccagaaggactaacatcaaggccagctctaccatgtctgaggtgtatgactgtgggcaagtttcttcattacaacttctgcaactgcacagtgactagcataatcctttcccattaggcactgctggatcattgcaaagattaaatgagggccaggtgcagtggcttacgcctgtaatcccagaactgtgggaggccgaggtgggtggattgcttgagcccaggagttcgagaccagcctgggcaacatggcaaaacccagtctctacaaataataataataataataataataataatcatcatcatcatcatcatccaggagtggtgaaatgcacctgtagtcccagctaatcaggaaactgaggtgagaggatcgcttgagcctgggaggacagggctgcagtgagccatgatcatgccactacactccagcctgggcaacagagtaagaccctatttcaaaaataaataaataaataaggagacatatgtgaaagcatttccgaagtctaaagctccacatacacataagtgattataagaaatttaacaaagggtagtcacataattgacattgtcctttggaggagagaaaattggtgctatccccttggtggacaggttccctcatccttaaagcacatttccagagcagaaggaagccttcatctaagtccaagcgctacatttctgatatgagagctagtttgagatttaaatgaaccctgtctctcaagacacagctttgcatctattttgcattcaaatttatttatctagagacaaaattgtgcattctttaattctactcacagcgtatgcacgcagaccaaatgaggtgctgatccagcaaaacggcaagtagccttttgcttccctgaaattgctaattttacaaatggcagagtggtgaaacgtggcacggaatatctattttactagaatccggcaaaacgggcacatatggtcttgtcaagaatgaatcaaacacagtttcgggattataattaagtagttgaaattccaaaaggaagaagttaatatgaacaaagtgagatttcgattgcttttggttagcattctctcaggctccttcctttacacattatcaggaacatagctactttgatttcttgtcctgaaaaatgtttaattgtaaaatatcaaacgttttcaccccaactctaattgtacttgatttgacatctgtacaccatgctcagggtaccaaatattattaaatgtaataagtccaggcatagaagtcaagccaaatgttcctacgtaagtatttaggttgacaccttctgtcaacaaagctaaacctctgaccaattctgtagcaggccaataaagatacaggaggaagatgggaaccattagaagaaaacactctctcctcatctctctctctttcagtactgtttctacctgaaatcagggacatattccattctggtccacaagcccagcatctagcacaggggctggcatgtaaaaagagttgatttgggctgggcgcagtggctcatgctgtaatcccagtactttgggaggctgagatgggtggatcacctgaggtcaggagtttgagaccagtctgaccaacatggtgaaaccccatctctactaaaaatacaaaaattagccaggcgtggtggtgggtgcctataatcccagctactcaggaggctgaggagggaaaattgcctgaacccaggaggcggaggttgtggtgagctgagattgcgccactgcactccagcctgagtgacagagcaagactccatctcaaaaaaaaaaaaaaaaaaaaaaaaaaaaaaggagtttatttggagatttgcaacttgtcatgggaaacattcccagggtttcttctagagttgttgtggacctgattttgggtgctaagtggtaactcactatatcttaaaaacacatcagctaaaaggtggaagcaatctacatgcccatcaactgacgaaggggtaaacaacatgtggtatatccatataatggcacgctatttattcataaacaggactgatatatgctacaacatggataaactatggagacattacactaagtgatagaagccagacacaaaggccatttattgtatgattccatttatatgaaatattagaataagcaaatccatagagacagaaagcagattagtggtgggcaggtgatgggggaagagggagattggtagataatagttaaaggatatgaagtttctatttgaggtgttaaaaatgttcttaaattgattatggcaatggttgcatgactgataatatactaaaaacctcaaattttacactttaaatgggagaattgtatggtatgtgaattatatttcaataaagctgttatataaataaaagtttacttcagattattttgatgtgcacttgcagttcagaagcttgagctagattaacagttcctaaccttagttttggctcctaactcctgtctcctctcagatcttaggaccttcaggttccacacagcctaccttgctgctacctagtttttgaagttctaattcccgaaacaaagaactcccttgaagagcattgatgccatggcggaggagaggaaacaagaacttttggttttaagctgtgtctacacttaaccaccttgtgcccacttgggtaggtgctctatcattgaggatcaggacccaattattcccattctcatgtttttccaggacctgacaaatcctaattcagattgctattccctttgagagtgaaatagcttaggtacgtttcttctacaacaatgcagatattctattaatgaaaggagctgctacaaagtaatttttaatgtttatataggaaagtgtaactttttttttttctggagacaggctcttgctttgttgcccaggctgaagtgcagtggcacggttatggcttactgcagcctcaatttcctgggctcaagtgatcctcccacttcatcctctcaagtagctggaactacaagtatgtgccactacacccagctatttgtttgatttttttttttttttgtagaaatgggctctcactaggaaattgtaagaaaaaggagtagctttcttaaaaccctggtttaacatgacaaacccaaaacattgagctgtacacttcattggttaaatcttctttttgcttatttaaagaaaggacaagaaaaaagaaaagaaaaacttttttgctagttcacacctcaaggtacacccagtttctgactttaaagggaatcagtccaaagtaacaaaatattattttgacatctgaaaaagaaaatgctcgttttataaattggatagtgatttctaaccattgttgatggacatagatatcttttgttaaagcctcatcaataagctcatatttctaggagatcatattgcgatgagaattatgaagagggaactggaggtccatgctggaaagtcagtactcctttaattcaactaaaaatatttattcaatagttaaatattgactgtgatatcaagtattttgaatgttggtaaaaattaaaggttttggcaaaatagacaatggtatacttacaagttttctgagggtggttcccagaatatattacccaaaatactatacagtgagaagtgatagtcaccattccatgtctttgaccacaaacatatcttaagattttctttgaagagggttttttagctttttgagacagagtcttgctctatcacccaggctggaatgcagcggtgcagtcatgggtcactgcagcctcaaactcctgggctcaagcaatcctcctgcctcagcctcccaagtagccgggactacaagcacatgccaccacatttggctaattaaaaaaaaaaatgtagagacgggatctcaccatgttgaccagactaggctggtcttgaacttctggcctcaagtcattttcccaccccggcttcccaaagtgttgagattacaggcctgagccaccacacccagcctgaagagggtttacaaaattatttcaccaacatgtaagaaaatgtaataggcattttaaagtttaaccattgtcagtcactcttttaatgccttagtacccagaacagtgctacttttagagatacgtatgtatctattttctgaattcatttttggttgcaaagcatcattctacaaacattatgaaagagagccaaatactgtgacttcaaggattatccaatactctataattagtttcatgaccaaaatgctttgaataactgaaaagatgagtgaatgactggatacatgaatacatatcatccatttatatgaaaatacttttgaatacaggcatatcttagagatactgcgggtttcgttccagaccaccccacaataacatgaatattgcaaaacagtgagtcacatgaattttttggtttcctagtgcatatagaagttatatttacaacatactatgttctattaagtgtgaaataacattatgatgactaaaaaatgtacatgccttaatttaaaaagagtttactgctaaaaaaaagaggctatcatctaagctttcaatgagttgtcgttgttttgctggtgaagggtcttgcctcgatgtgcatggttgctgactaatcagggtggtcgttgctaaaggttggggtggctgtggcactttcttaaaataagacaacagtgaagtttgccacatcaattgactcttcctttcacaaaagatttctctgtagcatgtgatgctgtttgagaggattttacccacagtaaaacttctttcaaaattggagtccatcttctcaaactctgctgttgctttatcaactaagtttatgtaatattctaaatgttttcttgtcatttcaacacgattattcacagcatcttcaccaggagtagatcctatctcaagaaaccactttctttgctaatccttaagaagcagctactcattccttcaagtttgatcatgagattgtagcaatccagtcacatcttgctcctcctctaattctagttctcttgctgtttccaccacatctgcagtgacttcctccactgaagtcttgagcccccaaagtgattaatgagggttggaatcagcttcttccaaactcccgttaatgttgaaattttgacctcctccattgaattacaaatgttcttaatgacatctagagtggtagatcagttccagaaggtttttactttacttttcccagatccatcagaatcaatatggcagctatagccttacaaaatgtatttattaaatgataagacttgaaagttgaaattattccttgatccgtcaactgaagaatggatgttgtgttagcaggcatgaaaacaacattgatctctttgtagagctctgtgtagatctccatgagagctctcaggtgaccagatcagtgagcaacaatattttgaaaggaatcatttttctgagcagtaggtctcaatggtgggtttaaaatattcactaaatcatgctataaacagatgtgctttaatccaggttttgttgttccatttatagattactgactgagtagatttaacataattcttaatggccctaggagttttgaaatggtaaatgagcattagcttcaacttaaagtcatcagctacattagctcctaacgagagagtgatgctgttcgttgaagctttgaagccaaatatagatttctctctagctatgaaagccctagatggcatttacttccaatataagtctgattaatctacattgaaaatctgttgtttggcatagccaccttcataaatgatcttacctgtgtcttctggataactggctatagcttttaactcagtacttgctgtttcactttgaacttttatgttctggagacagcttatttccttaaacctcatgaaccaacctctgctagcttccaacttgtgttctgcagcttcctcagcactcttagcctttacagaattgaagagagttagagccttgctctggatcaggctttggcttaagggaattttgtggctgttttgatctatccagaccactaaaatgttctccatatccgcaataaggctgttttgctttcttatcatttgtgggttcaccagagtggcacttttaatttccttcaagaactcttcctgatcaatcacaacttgacaaactgtttggcacaagaggcctagcttttaccaagaggcctagttttcagactatcttggcttttaacgtgccttcctcactaagtttaatcatttccagcttttgatttaaagtgagagatgtgggactctttctttcacttgaacacttagagaccattgtagggtagttactggcctaatttcagtattgttgtgtctcaggaaatagcgaggcccaaggagagggagagagatgaaggaatggctagttagtggagcagtctgaacacgcacaacttctaccaattaagttcaccagtttatttgggtgcagtttatggtgcccgcaagtaattacaagagtaacatcaatgatcactgattacagatgaccataacagatatagtaataatgaaaaaatttgaaatattgtgaaaattaccaaaatgtaacacagagacatgaagtgagcacatgctgttggaaaaatggagccaatagacttactcaatgcagggttactacaaatcttcaatttgtaaaaatcccagtatctttgaggcacaatgaaatgaggtatgcttgtctctactttctgaatatgcttttggttgcaaagaatcattctgcaaacaacatgaaaaaagatccaaacactgagacttcaaaggttattcaataccctatcgttagtttcataaccaaacaaagagaaatgccttgaataaccaaagggatgaatgaatgaatgatggatagataaacacatgtcatcaattcatccaaaaatacctcttttttttttttgagatggagtctcgctctgtcacctaggctggagtgcagtggcttgaactctgctcactgcaatctctgcctcccgggttcaagtgattctccggcctcagcctcctgagcagctggcattacaggcatgtaccacaacgcccagctaagttttgtattcttagtagagatgggggtttcgccgtgctcaccaggctggtctcgaactcctgacctcaggtgatccacctgcctcggcctcccaaagtgcagggattacaggcgtgagcctctgtgttaaaaatactttggagtatataggccaggcacggtggctcacgcctgtaatcccagcactttgggaggccaagacaggtggatcatgaggtcaggagctcgagaccagcctggccaaaatggtgaaacccccatctctactaaaaatacaaaaattagctggacgtggtggtgggtgcctgtaatcccagctacttgggaggctgaggcaggagaatcgtttgaatctgggagatggaggttgcagtgagctgagatcgcaccactgcactccagcctgggcgacagagcaagactctgtattgaaaaaatatatatatatattatataaatataataatatattataaatatatacatatatatacatatatgtatatatatgtgtatatatatatgtgtatatatatatgtgtatatatatatgtatatatatatatatatatacatatatatatacacacacacactttggagtatatagttttaatggtggtaagtgctctaaaagaagaagcaagtgctatgagagcatatattagggacctttgacccagcttgggatttatgtttaatttgagacgtgaaaatgattaggagctaagaggggttaggctggagagagggtccaggtagagacaatatgtggatccaagaaggaagaacaaagggatcaacaaagtgatagaaataggccgggaggggtggctcacgtctgtaatcccagcactttgggaggctaaggcgagtggattgcctgaggtcaggagttcgagaccagcctgaccaacatggtgaaacctcgtctctactgaaaatacaaaaattagctgggcatggtggcaggcgcctgtaatcccagctacttgggaggctgaggtaggagagtcacttgaaaccgggagccggaggttgcagtgagctgagacagggccttggcactccatccagcctaggtaacaagagcgaaactctgtcaaaaaaaaaaaagtaatagaaacaaagacaggaagcaaagagaaagaagataatgacaaggattaaagatgcagctttgaggatggcaaaaccgcagagaggagaactattaggatggtgcaaaggtaattgccagtttcaccactaaaagtaatgacaaagctcaaggtggtggtaggagggacagctgagtgactcctgagaaaatgtaaagtgctgaacctttgtagtttggaagacttggttaaccagaatgattcattccccaattatgccacatcttcaagattttactgtaaaagcaagcaggctggccctggcattcctaccataagctggtgcttcaacttccacatctggcagaggctctagatgtcacataaattgaacatagtcatccagctcaaagggggcttggggtcattgagtccaattttcattttatagctacaaagtactgataactaaaatttacaaagtaatgcacacgtggcagccactgttctaagtgtttactgtgtattaccccatttaaccctcagaacaacccagtgaagtagaaactattatgattcccatttacagatgagggaactgagacacagagaagttaagtgacttgcctatggggtcacacagctcattagtggtgctgtagaccttgggtataatcacttgtctgtatctctcaaaaatcatacagctggatagcagcagatccaagaatggactcggctgtctcccagtgcagtgccctttctactatggtaaccagaactcgacggtgctccctcagttggttgtaaataacataatcccatagtaattgcaaggatgagaatgaacttttcagtctccctgtccccacgtttttggaatggttctacctctgagagcacatgaactcagcctagttttggggctggtctgcccccaattttaacttccatcatggcattgccatttgaacagtgagtgttttggagctggcagaaggtatttttgcgcttcaattcaattcagcgatcgtgttagaagccatcctccaagtgtccaatgatgttagtgtgtccctttgggagtgatttatagtcaaatgggctgcattatagggtgatgtgctgaacaggggaccaaagtatgaccagcaatgctagagattagatttcaaggtcgttgagtaaacctgttgtcaggatttccagggatgatttgattgggaagaaaatgcatctttgtttcatcatttcaaagcaattttatgctttggttctccccgtttctgtcttctgaacacttccaaggccacacttgagcctcagcatcagcctgaagtcttgtgtgatagagttgccatgcaaggtctctctgggggtatgttgaaagctaccagtaagacttgactttgataaaacgtttaattgttttcttttgcctcaattaagttgagaagactcaaatgtagcttttaaattgaaaagtgtaactgagtgagaaggtttatatcaaatattgaaaggctaaggagccttttaatacattgttagctgtcaatgtgtttcaacaaattgtttcagtcactgttgtgtttcagtcactattacaactggggcctgcaatctgaagtgactcaggggtccatatctctggacaaggatatccacttttctgaaccgaaccaaggacgaggtagagtgggacagaaaaggacagattctagagagctttcccaagggacacgtctggcacctggaagtggtcgagcctaatgtgtaaagatttcaaataccatctggtcatttctttaggacctcatttgacaatctgtgggattgttttttgatgtggtgccagcccgaccaaatgaagtttctttcaatggtgtggttggtgtctgctgagaaagcagaagagggggctcttgtttagctcacaaccattgtgtgttaggcattatgcttgagcattttacatgttctggaagtattctcaaccctggctgcgatttcagtcacccagggagcttttcagaaacactgaggctcacacctgtgatcccagcacgtttggaggccaaggcgggcagatcacttgaggccaggagtttgagaccagcctagctaacatagcaaaaccctgtctctactaaaaatacaaaaactagccaggcgtggtggcgtgtgcctgtaatcccagctacttgggaggctgaggcaggagaatcacttgaacctgggaggcgccggttgtggtgagccgagagtgcaccactgctctccagcctgggtgacggagcgagactgcctcaacaaacaaacaaacaaacaaacaagcaaaaagagacattgaggctcagttcccatatcctaagattctaattcattcagtcttaagtaagaatcggggcgtttgtaattttaaaggcttgtcagatgactcatgtgcaaccgaggtggagaacccctaacttagagtgtcttgttgaatttggggatatttttctgctctgctcatccatccgcttgcaacttagagggagagtcacattcttcatggtgacaagagtgagaagtgtatacgttggcctcaatactccgaatgcctgtgccaaattccttcggcaccttgctttgatggtttggattgcctccctctcctgcctgattccagctaatattgctagctttccaggcgaatatttttggcaacccttgccttctgcattcaaaagaattgcttgccttcattactttatgactctcccagtgtgcaaaagtctatggagaggagacttttaggaggccccaagcaaataaggcctcatcttccatttaaggcttcattcccaggaactttcccaatacaaacctcagtgctcctgggctggccttgctggagagggcttcctgaggcggagttattgggacctgagggaggggttcctagagtgcagcaattccagactgaaattcccaggcttggggtctccctgggaattccctcaggaggaccctgtgtgcatttgggtgaaagaaagctattgttgaggaaatttgccctgccagggaccccagggcctactttgggtgtgtgtgggtgggtagagatgaaggggaaagttccagctgcttcagatggtggcgaatgacttaaacaaacaaggactggggcttggaagaggagagactgcacgtgcctgggcaggtttcaggttcctgacaaagagacaaatctgagagagatttacagacaccctctccatctatcacacaaatctgtgtcaagattttgagtctgcaaaacagcaccagcattatttcattgtctctgtgatttaggaaatgagattgaacacttgtggaatacccactgtgtgccaagcaccaggcaccagggtattcattcacccatatgttaccctagcaaatgatttgattttcaaagtatgccctgaagtgcctatgattactatcccaattttatggatttagaaactgaggcccaggtcactgacatgatttactcaaggttacacaaactgtgtaagaacctgggttaacctgacatataattgaagttatgcttcttttacttcacctctcatgaccctcttcccctatgtctttttaaaaggatatacatattgttacttttcttctcctaaatgttgcctagatttgctttctccatagtttcacctttcattcttctttggttcctgaatctggcttctatcccagcatctccaatgaagcagtactcctgtaggtcatttgatgaccaaaccatcaaacccaaccctaatcagtccttatctaacctgccttcatagtatttagcatgaatggtctctctctctctcttgaattggactatctcattcattttcataggtgtaccagctctatgctgatcaatctcaaatctacctctgcagtcctgacctctctcctaagcttcaggcttatccatctactgcctactagacttattcatctgggatatcctacagaggctccacacactcccaaaaggaatccagcatttctcctaaccaccaccccattcaaccccctttgcaggatctatgaagccagcaacttgggtgtatcttttccctcacccactcatctaaatcagtccatcaagttctctccattctgttttgtgattatttcttaaagacgatctctctcttctctacgcccaagactccttctttaagtgaggattcttttcaagagccttctaaaaagtctctctgaatctgcttcactgcatgagtctgttttccatgccgctgacagagatcttttgaggtgctaattaaactgttccatggctctcagaacctctattttccaaagtacatttgcaacctatttttccaggatactctgtgaaaaataggaccactgtggtcaagtagctttggaaactttctgtgtactatactttttgtttccttttggagattcagatagcatattaaatgtcctgagaatcccttaagttaaaaacaggcttacatttacatacttcagcatcccaaatggatttcatcatggaatcacccctcctcccaaacactcatatttttaagcatgagtcctgctcacaaccttctgcagaacacatttgaaaccacaggatgaatgctgtgatccttggcctgccatacaaggctcttgttcatctgacctctgttcacctgttgatatggttaggctttgtgtccccacccaaatcacatcttgaattgtaatccccataatccccatgtttcaagggagagaccaggtggaggtgattgaatcatgggggcaattcccaccatgctattcttgtgatagtgagtgagttctcatgagatcggatggttttataagtagcagtttcccctgcctgtgctctgtctcctgccaccatgtaagacgtgccttgcttcccgttcaccttccacctcaattataggttccctgaggcctccccagccatgtggaactgtgagtcagttaaacctctttctttataaattgcccagtctcgggcagttctttatagcagtataaaaacggactaatacacttgtctagccacctctcccccttaaattctcactactctcaccattcttgagaatactcatcttcctcacatacctctgtgttgtggttttgtttttgttttttgcttgaaaagctattcccctcccctcaccatctcggcctgccttcaactcatcattgaagacccagctcaactgtcttcccctctatgaagctttctcttattttctgcaagggagaagtagacaccccttctttttacttagaatcttcctttataccttgaatattacacttaggacatacgaagttattctatgtctacctagccttttaacctttcaaaccaattgggttattgtcttatatcttttcatgttatgactacctttatctcctgtcagaagtttggactcatcactgacccaacagaaaacagtcttatcctttctagtttttggtaagacagtgtatgtgagaaaccttacagttaggtatgggtggaggacatgtcaatccagagtgtttgctaatgtgttcagctacagtccacaatagcatgtgccacagtatgctgtctcacctagatggtgtgtagattggcttgattgtaggtatatggtggataataacatcttggcacagaaacaaaacccaaaggcaccttatcccctgctcctaagacaggctcaaggctcagcttcagctagttagcctggatctgtattcagttttccagtcatcttgaggctgggggctcggagtagcagcccacctcatgaatcctgctcgtcagtaaggggaatattcattgtcaagggcttactctgttcaggcactgtgctaagtctttgcctgcattatctcatgtcattctcacaacaactccattaggtggaaactcttattttcatcatgtaacagatgagtgagcgcactgaggctgggcaagtaaaatgacctgtcaacgagccatagcttcaggccctaatccagcctgtggcactgccctgatgggttaccttgggcaaatcaattgatctaactgagactcaatgtcgtcatctgtaaaataggaacaatactagtgtctatctcatggaatagttatgagggttcaatgataggatgcatgcaaagtgcctggcatagtgcctgacacttggtaagtgctctataaatggtagctattatgcgctcacatcagagacgttgttttcagccaggatgaagggaggcatgagggcagttttatactgaaggagagggtaggtctaaaaattatttggatgatgaaaaggtcacaatcctttgggaggcaaaggaggaaaaatttatcttaaacacagggagggagatggcagccaggtaccagaactcttgatgtgtaaagggctggccatatggagactgaacaaagtcagtgaagcttggctcctgtgcaaatcagagatgggctcaacatgtattccatgtagctgatcttgcatgtgcacggtggtttctgatgcctcccccgtaagggcagcttcatccactcctgtgagaaatgcagctcacagatgtggaggaccatctggagaagggatgtgagtgaaggtgggtgactgacagtgggtggagctggagctagggactcaggcggcagacctactgggttagaattacgactgtgccacttgctagctgtgtgggtttgggctatccactatctctctgagtctcagtttccttatctgtaaactggcaatagtaagggtaccaaccttatagggttattgggaggaacaggggaatttattcctgtgaactacttagcacagaccaggcacatggtaaaggttcaagaaatgctgatttttcatcattattatgtgttctggacgtggcaggggagatggggccaatgtggaggatcatagggcttgctgaaacagtcccaaatgaatcttcttcaaattaacctctgcaaatattgcctctgcctccattaatttagagaagctttgcattcttttctcttaagtttattttgcagctcatgtcttaatgagctaaaaaaaaaactatagaggttttgatccaatttcagactaccctgtaagatatcagcatctgacagttctgctgtactctttcaggcattttacttgaaatgatagtaatgtgatatttgcatccagtgcaaattatgaattttcactaattcttagattagatggggcttaactgctaggatgcagcttgcacatttaatctacttcagagcagcttcacttactagatggtcctcatgggtctggggaaaggatgtaaaatatcatcaatgaggtatgaagcatgttttaaaagatggagtcttgttttcagagtggattgaactgctgctaaatcacagccattacccaagcacacatagcatgtattccagcctgagttgccaccagtttttccttgtgacttgatccagtcctccattccctgctggcagtttgtgcacccctttgcttttccctgtgctgctcaggcaggtggttgctgcctaattaaacacccacacagcaattctctctgttttcttcctccattccaggatactgtttattcttgtttttacatttttttggaaaaatgttttgaagcaccttttgaaaaaagaaacatagtgctgatgatcagctaaatgtttttatagcttttcaggaagtgtgaaatgttctgatagctggcagccaagtgtcaagaaggccttggagaaaaagaaaaggccaattccaactcctttaaggcaacttttagaaaagatttagggctttaaattcagcttcacatactacctcccaagtcctctctaattagtagaaggtaaaaacattttggccgggcctgtaatcctagcactttgggaggctgaggcgggcagatcacgagctcaggagtttgagaccagtctgaccaacatggtgaaaccccatctctactaaaaatacaaaaaaaaaaattagctgggtgtggtggcacgcacctgtaatcccagctactcaggaggctgagacaggagaatcacttgaacctgggaggcggaagttgcagtgagccaagattatgccactgcactccagcctgtgcaacagagtgagactccatctcaaaaacaaaaaacaaaaaaacaaaacaaaacaaaacaaaacaacgttttttgctcaatccagcatctgatatacattttaactactttattgagttgaatttatatttaatagagttgtattctgcatgttgaatacatacatcattgtatccagaggccattgtttatttaaagaacttatagaacaattgtctattttaatttattatagaagctacactataatttggttgtgattgcctttatgttacatgcatagtcgtatctgtgatatacttggagcctaatctctggtcaagattgcagcattattttcatgggaaaatgtatgccatgacagtgacatgacttctggcctgcagcaataaatgcatcataccaaaactggagaagtgagcatagcccggtgtctgctgcataatcggaattcattcaaagtctgctgaatgagtgaattaattgtctatattctgttcagacacaactacgtggaacatgaaagactgagaactgttctctcaagttccatcataatcgacaacttcagacaagcccctcaactactcgctgtccccatttccttagtaagggctatccatctcataaagatcttaagaagaaaggacatggagcattagtctaaaatgccattctttaaaagtgatatttaggccgggtgtggtggctcaggcctgtaatcccagcactttgggaggcctaggtgggtggatcacctgaggtcagaagtttgagaccagcctggccaacatggtgaaacctcgtctctactgaaaatccaaaaaaaaaaaaaaaaaaaattagccgggtgtggtggtggcatgcctgtaatctcagctactcgggaggctgaggcaggagaatcgcctgaatcctagaggcagaggttgcagtgagccaagatcgtgccactgcactccagcctgggcaacagagtgagactctgtctcaaaaaataaataaataaaataaaataaaagtgatatttaaacttcattaaaagtagaagaaagccaaatgcatcattttaacttattttttttctttttactcaaccagatagttggtgacatataatcaacacacatttatcgagggatgctattgtaggtactcagcaccgtgctagacacagggaatgccaatgttcctgctcagacagcttccaatcctgttgaagagacaacccttctcaacactggttctattgacattctgagctagataattctttgttgtagggggttgccctgtgcattgtaggaagtttagcagcatccctggcctggccctggcctactagatgccagttgtacccccttcctagttgtaacaatgagaaatgtctagacatttccacggccttccatttcctctgtgatgcaaaatcgcctcctactgcaaaccactggtgtaaaaagtgatctgtcatgcaaattagtatgagacagtcaaatgaggaagtaatagggagtggaattcactggcgtgaatgagctggagtaatcagagacttaaactggacctttaaaaaactgagtgggattttgataagtggcaagattattgcaggtatagaaaattgcatgtgctatggttctaagactgcggtgctgcaatttggtgggtttgtgggatggcctagtgactaactgactggcttgagtgaatggagaggaatgcagatagtggacaatgaggcgaataaggtaggctggttgccacaatgtcagtttaaaagagcggcaggatgcagggggggtttggatagtgactctgccagtagtgtgtaggatggtttggagtgaggatggatgggggaagggctgtaactccccttatccatgcttttacaaagagagaggggaaaacaagttgaaatagtgaacacagattcctaatgcagcaatagcatctcctaagctttgtgtgcactagacatcacatcgctcatgtcatagggtagattctgcagatttgtttttctttcttctttttgcctgtgatttggagatcagaagatgtagatgccacagatttgtctttgaaagtaattgtcttgttcttcacattaatatacttcattaggtcttttagattagctcctgggactaaaatccatattcttcagacagctctctttgcaactgtgtcttgcgacaattctcttttcaattatgttgtgccactttcatatttctttcaaaatgttctcaatcaattttgccggcactttctctcctccaataatatggcaatgtattatcttattcgccatccaccccatgatcatacaattgttgcaagcacctggaaaaaacttttttttcattttgtcaaacttcatagtatttacattgatgagtttaacaactacatggcatgtagaatgtccatgaagaactccacataatcagcatctaaatttgagtatttgaatgtttagggcaacaacatgatctcaggacttctttttttcaggacctaagacaaacaaaaatggctgcaaaacatgagccttgtactgtggctgatatcattgaagcacgagttagctgcaagaggaaaattcacttggtttagtagcggaaaggtgatagagaagatctctagcacaactaatctgaaaattattaaaatctaaaaattaaggtagaaaatggcatgagaacagttttaaaagtcccatagttctgttcagtgaatctgagctcaatcggcttgccatttggtaatacaatgatgtggccttggcagatggtgagtcagtggaaggctcagtattattcaagctcagtttatataggaaagaagcagaaacaacacccccgttttcttgcattatgtctcataaagaaatctttttagtaatttcacttagaaaaggaaatactcaatgtaccctttcacatatctgaggtaggataagctcgcagaatcagtactagccctgaagcttctacatgcctcttattgtgtgagaggaactggaggaagagcggcaaaccatatgatcgctgacctcaaggagctcacgactgagctgaggtaattgagtagctgtgtgtggcacacctaaggtcactatggtctggagaactgtagaaagtttcctggaggaggttgaatttatacttggttttgaaaagtaatgtagagagaaaggtatgggcattttgagtaacatgagaacagaactagcgtggtgtctatagggaaaagctaggtgctctgctcagctggtggagggaagcagagaagctgtatatttagggaaagagtggaagtaaggctgatggacaggatgcccctggctgtgatgagagtgttttggaaaacaggctacttagtgtcgtcagcagtggtaaccactgcagtccatggagcagagatggatcatgaagaaaacggtactttgggccgggcacagtggctcacgcttgtaatcccagcaattttggaggccgaggtgggaagatctcttgaggtcagaagctcgagaccagcctggccaacatggtgaaaccccatctctactaaaactacccaaattagctgggtgtggttgtgcacacctgtaatccccactactctggaggctgaggcaggagaatcacttgaactcagaaggcagaggttgcagtgagccaggaccacgggactgcactccagcctgggcgacagagcgagactccagatcaaaaaagaaaaaaaagctactttgaaggggaaactcctttaaaactggagcagtcctaaagtgttcaacaacccaagtttacataaaatgaattgtgatgattcctgtaaatctgtaaatataggtcatgctgatctgttccctgaaggtgcttaaaccaacctcaacttcagtcgtccatgcctttcatgactcactctggctttccccagatagataaggtctctctgcatgagaagctgggatttagcttcatagcagttttgagacacggtctgtaggagcaatttttcaagaagcaagactatttgcacttcgtcctaaaaataaatgtttggggtggagagcagaaaacagcaaatagcactgttttataaatgaacaaggaggttcaggagcttttctctcaaccccctaaaccttcttctgggagttcctccaaacctaaagtcacacccatctgccagattgtgtaaagctgagtcctcggaatgtgaaatttatgagggcagggactttgttatgtccattctttattcccagcccttaaaacagtgtctggaacacagtagatgttctacatttccccctttaaatcatatgctgtggaattcataaactttccatttttgacacagacattatttgaataatcatctttattttcagttcatccatttcatattgagtttttaaaatagcagctttattgaagtacaattcctaagatacacaattcacccttttaaggcatacagttgggtggtttttagtttattcagagttgtgccaccatcactactaattctggagcagttttcacacctccataggaaatcccataattgtcagcaggcactccacatttccttttccctccagcttttggtggtcacaaatctgcttactatctctatggatttacctatattgaacatttcatgtaaacagaatcacacactatgtgatcttttgtgtctggcttttttcatttagctaaatgttttcaaggtgcatccctgctctagcactatcagagcttcacttcttttttgtgaccaataacattcccttgtatgagttaatcacattttatttatctatttatccattgatggacatttgggttatttccatttctcagctattatgaatggagctgctatgagcattcatatagaggtttttgggtggacaggtgatttcagttctcttggatatatacctaggagtggaattgctgggtcatatgatgatttcaaatttaactttttgagggactgtcagactgtattgcaaaatggctgcaacattttgcacttctaccagtagtgcatgagggttccaatttctccacatctttgtcaacactggttattcctggtcttttttatataaccatcctataatgttaatgagttaatgttgacttttggattataaatatattatatgtatatattatattataaatatataatacatatttattatatattacatatttataatatgcattaatatatattatatagtatatataatcaatatattcacatgattaatatattaatatctttaatattatatatttataatctatttatagattgtaaatctataaatatgaaagtttatgttaatacattataatatataaacatatatataatctattatttttatatctttacataaatatataaatataaaagattacattaatatattatatattaatatataatctaaattatatattaatataattggattatataaaatatattatattttatattacataatatataatatatgttatattttatattatagactatattatatgttatattttatattatagaatatataatataatatatattatattttatattatatcatatataaaataatatatatattatatattatattaagtatatattatattaataatgtagttctatatttttatatattgtatattaatcattacagttaattatattgtatacaatataattatattgcatacaattatattgtgtacaatatcattatatagaatacaattatttatattgtgtacaatatcattatatagaatacaattatttttattgtgtacaatataattatattgcatacaattatttatattgtatgcaatatatacatatattaattatatatatattaacaagtgtgaaagtcttatactttgcctcagaaatggccttgccagcacaatatttcccttcttgcatctttagtttgatgtgttgttgttttatttcctcataaagcaaatgaaaaagagggattggggatctgctaaaccagatgttagcactttttaaatttagagtgtggtggtcacaagaaaacacaactgggccttgagacggcatggaaaattctagaaatgtgtcatttcacagcatctgtgcagaaactgcttctgtgccagcatgttacatttgaaaccacattttgtgtgtgttcaacttttacacagatctcgagaaaagtgaaattgaattttatgcatctgtaatttgatttcagtccatgaccaggccatttctttataataattataagaatgtatccaatatatgactttcatcttctggtaattacaacaatttaccatttatagaacacatagtttaagacaccataagtaacatttcatgctaattgcttttctgaaaataaagggctctgttgtacacatccaagaacaatggtaggagaaaagaaaattgattgatacatcacatcaaagaggagatcaaaatgaagtcatccaatatatgccaaaggctctcataaattacaaattttgaactcactccaaactttatttttaggcaaatacagtatcttcaagtctcattatgaaagttacttcaaagatgatttgatgtgacagtatttttcccaaggctttgcctgttttctattcctaaggcttcccatgcgagcagggattcctggggcccaagctcaagcaaccaacttatactttgaatttgaactcaaaggacaagaagcccatttttgtgatgtgcttccccatttccttcttttgagcctaattgaagaattaaaagttgtcttcatttctaaagttatatgccgaacacaaaggggggtttcaacagctgcttcttgtcatgctgtgggaaaaaaataacatctcatctgaaaaatacctccaggttctccagatagttcttgcttttctcactcacatttttctctttacatgaacagatttggctcctcttcttcttttgtaggtagtatccattcagtaagatatttttcagatattgagagtaatacattgttcattagaaaacaaagttaaacatccataaaatactaaaaagaaaataaagatcacctgcagtgtcacaacccaaagtgtatcattttgctttagtttcttacactgtttgtttgcttgcattcattctttctttcactcgttgcatatttactgagcacctactatgtgccttgcattgtggtaagatacaaattgtgatcctaattttctttataataattaggtttataattgttggcatagtccatgcctcctctcctagactttagtgtctgggaccatcttactcaccatacatcgtattatgaccatttaccaggtcattaaatattatctgaaaataaaaagtttaatggctgcataagacttcactttcagcatctactagaatttactatttccttattgatcatttaagatattttctttttattctgctatttttgataattataattaattaattccattttgaacatcatttgtaagggtatacacatttttatggcttgtgttgtattagccacactgcccaccagaagagccctactaatttaagcatttaccgcagtaggtgaatatttctcaaatgaagttgaaggaagttccaaaatggcagacccaaggaactgaaagacttacccaatacatccctttgcctccaaggagagacagaatgaccactaccaccagaggggaagccagtttgtttaagagaattgaaaaacaccagggagagctctctcaatataatagtactgggatttgggggcaagaataagcagtggtgcaggttgtttatttacatacgtttataaattatctttacagggctaagagtgaactggatgaatggtgttggcataacctcagagaggcaatccaaattttattaattctctgttatgtgtcagagcttgagttaggtgctatgagtgatgcatggatgaactaaacacagttcttggcctcccagaatgttaaaatccagtagcagggaaaagtgtgtgcgagctggaatttgaatgacctgggttccaattctgattcttctacccattatagcagtgactttggagaggttacctgatgtctctgatcttctgttttctcatgtgtaaaacagggtgaataacagagttcttgtaagaaggaaatgagataatgtgtataatgttcttaggagagtgtgtggcacataacactatagcagcactcaggagatgataactaccattgctttggtaatgatgtttcctatcttccaagggttttgtgatgattcaatgaagtaacaaatgcaaaacacttagtgctactacagtctcaaattaagatgacgatctgatgataatgacaacctttttggtgaagaacatatcacaagcgagttgtaccaaacataaatgagtaacaaaagggtagcttgccccttgtctcagagaaagtgagtctcggcatgggttgctgcagaagacagtgttggctctccacatcctgtgacaccaagacttattaaaaccagacattcaaagcaattgcaagttctgatctacacaactgttggtcacttccgcttttgcgcctacctcatttgaggcacctggagtgtgttttttcttggtagaaccgtgacaacatgcctattgctggcctggaattgtctaccaagcccaaagctttttagcagtgggtgatatttgtttcttgtgccatcgctgaataatgacttttgtagtctgaaattaaacaagcattcaagggctctaagtgtctggcaaaaaaagttagtggctggaaaagctgcagaggatgtctatgaaatgcaattgatgaacacacttttccccctgagctgctttcctgttaggtggtggaaactggtctatttcggtgatgtgtgctgacttcttcccttctggagcccatgcattgggtgcctccaggtttcaaaagaatgaggacaaattaactgttcttctaaagtactaatgctgcaggcccttctgaaataaaacctttgcagaatggaaaatattattgtcttcttgctttcaaaagttacttgtttacctgttgctcataaaatgcaggataatttgtggttgggaaaaggtattctttgcctgatgggtttaatttcagcaccgtagacttccctgaagattacaaagctattctattgctacacatttatagagctcaccccgaggaaagggaattagtgtctggcattaccttcctgcctgccaattttacctcactgattcaacctttgaaactgatttaatcaatggatcagcacattattcaaaggtggaaatgttattacagagaagctttcaggagggtggatgattcgtacaggcactacacaggacttttaatcacaccacataaaagaagcaaatttgaatgttgcttatgcccagaattttgatgaaaagtaaaattttgatgaaacgtgaaaaggagtactaggagaagcccatggcttggatttatgttggcagacatttcttctgagaaagaaaactcagtatgttctaatgtaaagatccacaaaatccaaaaaccacaccaatgggtaagcctattgaaagtaagagagatgagaggttgaacatgataaggaagctgaaaagccaagcctgttcccaatagtcactacactccagtggaagaattctcagtttttgtgcagagtcctgcattttgcatagctcagttgctggacaagtgaatgatcattttcctcatctgtcaaatgggaatagtaatacttctcaaggtgtttgtgaggatcatcagatactaaggattttacaggtttttattttccttatatgatgtacacgttctttacattgaaaaaattatttctccaaactagaatcttaagttccatgggtatgatgggtctgataaagtatttggcatctcttttactaggtagatcccactcaccctgagttttttttttttttttttttgagacagagtctcactctgtcacccaggctggagtacaatggcatgatcttggctcactgcagcctccacctctggggttcaagtgattctcccaccctagcccccgagtagctgggactaaaggtgtccaccaccacacctggctaatttttgtatttttagtagagatggggtttcaccatgttggccaggctggtctcaaactcctgaccccaagtgatctgcctgcctcagcctcccaaagtgctgccaccctgagatttgacttaatggagcccatgggagatatagataccttgggtcattagcaaaaccttcaacgtaaagatgtatcaactctgagagaccctggctaggtctactaagttaagtggaagcaccacaacatcatggttaaaaggaaagcctttgtgttgagccaggtgttgttttgaatctcagccctcctgcttaggaattatgatcttgggcaagttacttaacctctctgtggttcaggttcatcattcaaaaagtaacaagcatcatactacccacctcaaaggggagcagaaattaaatgagattaagcatgcaaagcataggagcaccatgccgagcatagaggcacaataaagggcagttgagaggagtggcggcctggcagggtggctcatgcctgcaatctcagcattttgggaggccgaggtgggaggatcacttggttactttatcaaacccaccatacccatggaacttagattctagtttggagaaataattttttttcaatgtaaacaatgtgtacatcatataaggaaaataaaaacaagtaaaatccttagtatctgatgatcctcgcaaacaccttggaaattattactattcccatttgacagtgatcacttgatcacttcaagaccagcttgggcaaaacagcgagacctcttcactactaaaaatttaaaaaatcactgggcatggtgatgtgcgcctgtagtcccagctactcaggatgctgaggtgggaggattgcttgagcactggaagtcgaggctacagtgagctgtgattacgccactgcactccagcctgggtgacagagcgagaccttgtctcaaaaagagaaaagggagaggagtagcaggattgacagcagcggtggcgttgccccttgaggatggaaggtctcagtcatcttgaagtctgctggagcattagttccattgaacctctctttgagggagactatgttctttgtccttggccttttttgcctacctagaactggctgatcttgcatggactgctatagaagtcctttgtaatcaggtcgttgaggtcagataatcgagttccaatccaagctctgtcatttgccagctgtgtgacactgggcaagttgagttactcaacctcgcagagccccttgttctcagctgcaaaatgataatacaataattatttgctgcatagggttattgagagaatgaaataggataatccatgtaaaagtacctcaaccattcactggaacatggtaagtgcctaataaagatatcttctgagtatggaagcaagacttcattacatgtggtattgatttacaattgagtgcatttcatgatattaaaattaggtgagaattggtggtatgaaaatgcaaccacatcaccacaggcctcacacccatgcttcctgtgcagtctgtggaactgtgcatcaattaaacctctcttcttcataaattacccagtctcacgtatgtctttatagcagtgtgagtacagactaatatacctggaaaagttgagtgctctaggtcaactggcctgtttagtggcagggctaggattagactgtcaggaccccaagattccactttgtgacattgtcctccagagccattgccttcgcatactgattcaccttcctttctatagtttctgccctccatttaaccacttcttttgttcccctcaaatcccagatggccagccttttaggcctgcctttcttagatatgatatcaatcatatcatttcaaaatataaaatgaatttgttattttagttagttaaattaatggtgaaagattcatttaccaataattttgactgctcttcatttgttctgggatccctgtagtaatattctagctttctccatgcaagtgaatgctgtactacagtgattttcaaacattagttgaattagtttcaccttggggtctggttgaaaatacaaattcctgtgccccatataacaggattctggttcctgagtctgggccgaggctcagaatctgcacttttaacaggctttgccacgtgagtctaaggctagtggtatatgcagcccacacctttagaaaactgcttggctttgagtcagactgcctggcttgaaatccaggctctgccattgactagctggaagtccttgggccttggtttcctaaacttaaaaaggagaataatacatactagtccatgtaaggttgctatgatgattacatgagataataaatgtggagcacttagtattgtgctgaacctacagttggcactcaagaaatgttaagtaatattattttaaaatctagggccgggtgcagtggctcatgcctctaatcccagcactttgggaggccaaggcgggaggattgcttgagcccaggagttgaagaccagcctgggcaacaatatgagaccgtgtctttacaaaaaacattagctgggcatggtggtgcatgcccgtggtgccagctactcgggagactgaggtgggaggatcacttgagcccaggaggttgaggcttcagcaagatatgttcataccactgcactccagtctgggagacagtgcaagaccatgtgtcaaaaaaataaaaataaaaaatagaaataaatctattgaaacacacacacacacacatgcacacacacaaagtctacaatgtgtttttctggttattaaatggtaattagtgttaacagaagattctccttgcattaacacacgtgtgtctccacacgcattctttaaagcttagtgctaatgttctcttgtccttgaggtgtttgtgatcttcctcttcactggaataattgttcattttatatctctcccacttgtgcctcccatagaaggcattttgttctgcaacaaattctagtgagaattttgcatctctctcttccaggcttgcaagctgctgaaggacaggggagcagttgtagccatcctgcaccccaactcatacaccgtggcccaggtcttacccagtgcttagcactctgtagtacttaaaaccacacttgctatattcacctgaagttctggaagtgagaagcctcaaatgaaatactcaagaccagaatctctttactctttctggtctgagcaagtgggaggtgagagaataaaactgggaagtgttggatcttctctggcttgtttgttctgcagtacgattgggagaaaatgtccaaaaatgtagaattgagaagaacacccccaaaaccaccccagcaattactgttgttttaaaaaatcgtaaccagatggaagacatttcctgaaatcacacctttgtttcttggagaaagaaaaagcccattcctgtgagtgggtgttcattaacttggtaagtagggaagattgagcttggcctggaaggaggtggatttttgcaggggcactcaacagacaattaaataaggaggggcatttcccatcagaacacatgaaacaagaggctggttgaattttctgcaactgtctgcttgaaggtttatattcaatgggtgtcaccacaacttacacctcatagaacagggatttggtccccaagagatgtaatgcaaatgtcacatcataaactcccagactgccaatactgaagggattttaggaatcgtctagaataagaagtacagaccacccaccattgttttgttagtgttaccaaaatgtcaatggttgttcaaatgcctttagttgctgttttactgcatattttctgattccaaaatgattagtatttcttggatttatactctggctctgccactgactggctgtgtgaccttgggcatgtcagttgcccttttgggacttcatttccttttataaaaggagcaaactaggttgaaagatcttaaggttctttttagctctaaatatgggagagtctcccagaaatagaaatgcaccactcctttttttggaaaattcattctttcctaatgttgaaatgctggcagtccagtgagtcaggtaaccatgttacaagaattgtctcacaaattctgtaaggaggtagggaacaaagatacattctgatgtatgtttcttctattaaatctattttggtattccaagtgacatttgttcttgcacagcttatgcttcacaccaacatgctatctgtcagggcacacactgattaagacctattctgagaaaacatattctctgtgattgaaatccaaacgtattgattgttttatttccatcaggagagattgctttctatttggtgatggatgacaactcttcacacctctctgtctgccagctggacagaggatgacacaagcagcctctaagtcttgtgtgggctgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcccagctcggtgcagagagaacatctcgagtctgcactgtctgctgtttctccgtaccacggtgtgctagcaggaaagccttcaaaggattaaaacccaagtatttatgagctaaacataatgtttccctctctctgggaatgcccagtgagaataccacttacatctgcacagaatgattgcatttcgcaaagtactttcacatgcgttagctcattaaattcttaaaacttttactcgtgggaaatagatagacactacatttttaccatgttacaaatgagtaactaggtatgccctttaatctctgatccctgaccccacaagccactcttcaaggcttgaacccatggcttctagtccggtctttccatcatcctgaggtgctcagttattcgagcctgtagctaatgactgcaggacacataatcatagcaactcacatttattgaactcttactatgtcccagacacttcacataattttaatttaatcttcacaacaacctagtgaggatcatatcattattgtcatcggcattttacagaggaggaaaatgacattcagagaggttaagaaacttacccagggtcacatgatagtaagtgacagagttaagactgaagctgagtcaattgaaaagtagaaaaattcttaaccatgatgctctgttgctggcaactccctgtcccttaccctttccaaaaacattaagaataggaaaaaaaagaagagtgagttttccctcttgggctatgctagcaacagaggcccaaggggaaatgctgttttaagccaacctcttggaaagggtcattagcagctgacatgatgccaatatggaccaatatgtctgaaagcttgtttctgggtcttttgtggtctctgccattcttgtccctgtccctggcctccacattcctttccctctggatcctcagtaacattgtcatcctactttggacatgcaccactctccattttaggtgagatatgtagggttattgtaaataaatatttcagaatcagtattatttattccccacctatttctgaaaaggatctgaataaaatctgtctattaagtaatttgaagtttacaaaaagatctgaaaccttgtggaagaaagtcaagggagaagaagacatgaacaatggttctatcaagaacttggggtggaagtcatctcacacatttcataagcactgtgaacctggccctgggattgccactaaaaatacagagctgagtaaaacatggctcctgccctcaaagagctcaatatctagtagcattagaattactgaatttgaacattcaatttgactttgagttcaaaccaagacaataagtgaaacatgatggattatctagtactcatctgataaatggagtagtgtctgttcttcagaagacacaagctgcttataatgctgaataataatgatgaattatttcatatcagtaatagctaatattctttgagagctcatcatgcgccagctattgcactaagcaatagctgcattatcccatttgcatgcattatcccatttaatcctcacaaatgtcttcatgatgtatgcatataattacccccattgtacagatgaagtaattagggtaaggaggaattaccttgtggatccataagtaatacaaggggtgaaaacttcaatggagtttttacagaagattcagacccgtatttcataaggccagtgcacacatttctcggccatttctgtcttccctgtcactctacgggaagtggctatgaatatactgtctccaaaggctgtgactgtagccattgtgcttcggtattgccatttgggacctaacggttcagaagatgtaataactctccttgcatggaccaattacagaaaaactccctttgtaaagcaacagcatgagccagaacaggcacttcattatctgcctctgcccacagggaagtagagacgctggcgagaggatgattgacctgggaaatggcagggcttgggatccatgctttcagggtcaaaggccttcgtgcccacttccaggattggcttctcaggatgccctggtgctggctcgccccctgctggggtgggctcctggggtttctctctcagtgggatcccattggcagtctctcccctcccacagcagcaggcccattgacttctgggcactcacttcccaggacccttttcagtccctgagaatcagaagttcttttcactctgagagtttgcagacggtgttgcaccaagaatggatgtactttgcctgtagagggctttaatctagtgaattgtgctcagacagataaagggtaattttgcttcattttctgtacctttctgaaagtttccagggtcagttagccaggtctctgcaggcttctcagctccaaagcagaggcaaaagtctttttccaccatttattccttgcatatatggaagattcttaggcaaaaagtgattttttttcacccatatcttatcccagaaaacaatgccctctttttagttaaactgaatgactacaaatcatatcaccccaaattgagtaattgcaagtcttgttagttatcaaggttttattgagccttatttcagttgcttacatatgtttttgtttttaaagaaaaaaaaagtgtaacgcctttggcccgggcctcaaattcctttttttccctcaggcaagcacgcttacaagtgagggattcccagcctacaagggtgagttatgtgtgttgagagcagagtggaaaggtgggcatttactcgccctgccccctccactgaactcgaagtgctcattctctcccatgcctgtgtcctctctctcttcacacatggtcatgtatacacacagttgtacatgcacactttctccttgctaaaacttttctttgctctgagtagatgcagtccgttctcacactgctacaaagaaatagccgagactggataatctataaagggaagaagtttaattgactcacagtttcgcagggctgaagaggcctcaggaaacttacaattatggtggaaggggaagcaaatatgtccttcttcacatggtggcaggaaggagaagaatgagcaaaaggggaaaagttccttataaaaacatcagatgtcgtgagaactcactgtcacaagaacagcatgggggtaaccgcctccatgattcaattacctcccaccaagtccctcccatgacacatggggattataggaactgcaactcaagatgagattttggtggggacacagccaaaccatatcatctactctctccctggcctcaccccacattactgctctggtggccaatgctgtagtcacgaattctgccttttctcatgtctgccatttcaaggagctcaccccactcacctcaaaaaccgagcttttatagacgcagaaaactcttcctcctatatgcacactgattgatcacctacacatgccatcaagagcatgtactctggaattagatagtagtgagttggagccatgtctttacttattagccatgtgaccttgaggatactacttaacttctctgagcctctacttcctcagtgaatcataaatagaacctacctcataggattgttgtgtggggattcagtgaaatagggcatgtaatttagtacagtgcctggcccatgtgatcaataaatgtttgctattatcattaagcgtggtgatcttagctgattgtattgttgttgttgttgttgctgttgaagattttgcatcttctaggttatgtttctttgctgctcaggaggcagaacaagtttctccattgccaaattgtttgcttttttttattggggtgaaattcacataacataacattcactatttaaaattatactattcagtggcatttagtgacactcattatgttgtgaaattatcaccactatctagtttcaaaacattttcagcaccccaaaatgagacccgtatgcattaaacaatcactccccatcacccccacctaccaaatctttttttaatgttgctttcagatcatatgccattccataaatctgagaagttcaggaaggctagatagtgagcttttttccaaaaatcaatcagaaacatattcctaaataaaagaaatatactctgatattctgggactgccttatcagagagtgaagtgaaaaatcagaagtgatatagtctcattcaggccaacacagaaattactcctttaatacttattgcccatatttcacattattttctttgcctggtagctgagagagaaaaggagcttgaaactttgagtaaggggagggaaagattttctaaaccccctataaacaaatgatggtaaagcctaggaagaggttagcaggtcagcctctttgcatttaatttccatcttgccacattccaaggaaggaattttagtcttgggaggcaccaaataaccctcaggggaaatgtgaccctttgaagctcctggttgtctatttctgcagctgcccatctactcacaccacccaggttggaggggcccagctcttcagcactcaaatacagtggagctggccacttctttgcacggggatggtttataggctttctatatcaggctgtgtgcagacgagacaggcttgatgagtcagctgaaaaggggaaaggaggggaactccagttggcttgatgctcaagtgagaagtgggaagaaggaccaacagttaagaggactcggtgaaaatactacgggatttggcaaatgtatgtgaaggcttttgtaggtcagccagtttgcccttggagctgtgggcctgcctgagaaggcttttgttggccttgggagctgaaagggagaccctttctttaggctctgcaggctacttggcaatcaatgttgaggcaggttttctgcttctgtggggtgcaaagctttggtcaatgtcatcaagagcatcctcttcttaggaaaccatgaccttgccttgggcaacttttctgtagcctttaagaccagaaaagtgagtagagaagactaacgtaattggacaaaccttgctttgatgggtggtgattgggactctcatatgaattccagaaggaaatatatgaagagtgtctgtaacttgaatgtgcttcctctgttgggtcttgcattaaatcactgatctgcacactttagcctgcagcagaatcacctggcgaggaggtgcctgttgaaaaagataagaagtttcattcagaaaagatgaccctgaagtaagtcttctcactcatttctatttattcacagttcctactttactaagaaagtttttaattattggccattatccgtgactgaaaatacattaagtaaagttgcaggatgagttttaacatttatgagttaacttcatccacatcagtaaatttgacaagtatttttgaagacccatctttgggttttattaaatagaaatttctgaaagttgtatgcccaagggtattttgtttttctcatgtgtgttcaaatttgggaagaatgaattttgcctcctattcactcggtaggagatttagtgtctccttctgaattagccctttctgttcctgaaggaaagtatttatgaaaaatcagactccattctggaaactgaatgatttttgtattttgctgcagttagatggagtcctataaatgagcccaaaacatgctggctaaatctctcataaaaggcaaatatcacaaagaggaatggcccaagtcttattttggcccctggcctgtgtttgtctaaaaagacttttagaagtgtcacaaaacactaaagcactgcctaaatcatcccttcctaactttttgcttatgggggtgcaagggaagttgcacgtggtgggtgggggtgctgagagagagagagagagaacacaaagggccagctcccacttggagctcccctcgtttctctccattttgctcttcaggatgtccccaccccactctgcattctcaccacacccacacatgaacccagcatctgcccaggtgccacgaatcatattacaactttgctccctggcagagagtggccagagagaagtttctggaggtgaggaagtgagcctgcctgactgctttggtggcagaaaccaggggcttaaccagtgactctgtgctcgaggcttgtttgtgaaatcctttagcaactcttcagaagcctctcctctctgacttctcagagatgctggctcttctactttgggaagttcctttgctagtaacacatttgaggtgagttaaatgtcttcctccttcagcctcagcttcctgtgcctaagggtgagttaagcaattagtcctaaatagccccagctgttagggtttctccagaggatgctccttgtgactttgattgcttctaatgaggctattggctttatctgtaatagacaatgttagattacacatctatgtcttttacagcaccttttacccccagggctttacgttttctgagaccactcttgagaaccttggatccagtggcatttttcttcttgtgaataaaaaattattatctttcctgttctccctgtgagatcagccttgttcttgttctgctctggggtactctgtatttagggaaattactcatgactctcgggtactgaaaagacacacacacacacacacacacacacacacacacaccatgcacaggggaatgggagagcaagaacgtgtgagagagagccacttgaagagagacagggagaaagaaagagagtaggagaaagcaataaagaaagcgagatcacagtcaggcctgagaaggtgacagcaagccagtgttttagaggtagggaaagagcccaagatggatggagaaagctcatgcaggagcaagagagcacacatgggagtgccagcaaccttgaaaaaaagcaccagtgacagcaaagggaatctatgaggccaggaggctgggcgagcaaaagcaagagagtgcaagagatcaagaaagggggaaaggaggtgggagagggagagcgagccttcagggcaaaggagtcaatgagagagatcagcacattatttgtgggcagatgaagagaaagtctaaatgaggagctgctttcccctcatcttgttgagttggtggaagaggaagagaagatgcacagggcacagactccagctttcattaatccaaaatggaatttctgggacatacatgctcaggatcaatgtcatctttaaagacccagattccaattagaaccacaagtacacctccccatccttcagtattatttgaaattttagaacaactgccattattctacacaaagtaaaggatgatcattttggagtatgtttttatcaaaccacctccctatccacagacctgtgttagacagcttaccttagtggttgccaaacaccagaagtagatcattgtcatgattttggagggctgggccgaggcctggaattctatggctttaatacgtggctccattgggagattccattgcccaggaagacactggccttaagctacaccctttttcagaaagcagtaacaaattcagttggaccactgacctgaagccagattgctttccaacaaggcccaaactaaagggggtaccaaaaaatcagtaatcaacataaataacattttaatgatatgattttttaaaagagaagtttctacttatgttgcccaggctggagtgcagtgtctattcataggcgcgatcatggaactcttgagctcaagtgatcctcctgccttggtttcctgagtagctgtaatgatatgttttaaagacttaaaattaatgtagacaaatccaaaatgaacaaatatcaaaattttaaatacagtttccaactctgcccttgcacacccctgcctctcttgacccaccctaacaccatccttggttccagttaaactttatatacagaatcaggcagccatcctgtgggccatattttcttgacttaaaaaaaaaaaaccattgccttaaatatcatttattcaagtagaatccaaatcttgtttgttttctaatactgtttttcaataaaagcaaccagggctccttggagaaatgaccgattccaggactgaggcagaaaatacacaagataagcctggaacatcttgtattgccagaaagtaaggaagtgttaacaaatacacaaacaaaaacaaaaagcagaacatcacaggagccaactaaaagagctaccaacagccaaaggtataaaaacttgagaaaatatactagtattattggactataacccaaagtataaaataaacatccaagagtccatactgatataattaaatggttaaataaatggatgatagacacatcttttgtgcagggtaattccaaataatttgtgtagattctctgccctcaaggaggtggagtgtaactcctcactccttaagtatgaactgcgaatagtgacttccttgtaaaagagtatagtatgggccaggcatggtgccgcatgccggaaatcccagcactttaggaggttgaggcaggaggattgcttgagaccaggagtttgagaccagcctgggcaacatagtgagactccctctctacaaaaaaattaaaaattagccaggcatggtggcatgtgcctgtagtcccagctactcttgaggctgacatgggaggatcacttgggcctgggaggttgaggctgcagtgagtcctgatcatgccactgcactccagcctgggcagcagagcaagatcctgtcaaaaaaaaagggtgcaggccgggtgtggtggctcacatctgtaatcccagcactttgggaggccgaggtgggcagatcatgaggtcagagatcaagaccatcctggctaacatggtgaaacccagtctctactaaaaatataaaaaaattagatgggcgtggtggcaggcacctgtagtcccagctactcaggaggctgaggcaggagaatggcgtgaaccaggggggcggaggttgcagtgagtcaagattgctccactgcactccaacctgggcgacagagcaagactccgtttcaaaaaaaaaaaaaaaagtgcagtatggaaagggaaagacaagtatccttaccatggattaacctgacaaatactgcctcagccaggtgatcaatgtgaacatcaccaatcataaatcatgctgattgtatgtgtctttggatatgatgagatgcgaatggcactttatctctgtggtcttcttccctataatccataaccacagcctacttatgagaaaaacatcagaaaaattccaatagaatgggattctacaaaatagttgaccagtactcctcaaaattatcaagtcatcaaaatccagaaaagtctgagaaattgtcacagccaagaggagctcaaggatatgtgacaactagatgtaatgtgggatcctgcaaccgaaaaaagtaaaaactaaggaaatctaaataaagcatagactttagttaataacaaattgatattagctcattaattgtgacaaaggtaccttattaatcaagagatgtttatgtgggaaactgggtgtggggcttatgggaactcattgtactatttcacaatttttctagaaatccaaaactattctaaaatacaaaacattctttgaaaaagtatcttgatggctgaatgttttggtgcccccttaaattttacacacaaggtgagcaccttgcttgcctcaccttcatcctggccctgctgtctgagtgcaaaatacatttgtagcactggatttcctaggagacacctgttgtattagtctgttctcatgctgctaataaagacatacccgaaactgggtaatttataaagtaaagtggtttaatgaactcacagttccacatggctagggaggtctcacagtcgtggcagaaggcaaaggagaagcaaagtcacaccttacatggtggcaggcaagagagcttgtgcaggggaactcccatttataaaaccatcagatctcatgagacttattcactaccacgagaacagtatggggggaacggcccccatgagtcaattatctccacctctccccatgttgacatgggggattattacaatcaaggtgagatttgggtggggacacagccaaaccctatcacctgtacacactgcattctctttatttgtatataaataaatccatagtattctttcctccacaaccttctccttagcataagctgaattacattccttggcttctgacaaggaatgaatttagatgaagctcagtgtgcacttcccaaagttgcagttgtacagccctgtgaagagaagaggcagtggttggaagcctaagccacagaaacagagtatagtccaagaaaggttataatgctgtgcccagcagccagagcttctcctgcagctgctttattcctgccaagcaaagccatgagcttctcctgcagctgatttattcctgccaagcaaagccatcctcgcaaagagcattggcccctctgctgcctgggcctgcctctcagatagagctctggaagcctggacctttgtcctagaaaatgacatgactaaagtgggttttgtctttcctgttgctctctttcctcctttccctcttttcacatcaataccaattagagaggacaagtgttcaatcaagacataatgtcataggcacggacttctcctcactgtcttcctcagggcgaagaagctgccagcctggagcagaaagctgggtagagacactgctttaactttattccctcagggaaaactgcagccatgaaagtacaacattgagctgacttgacttggcagaaagatgtgttttgcgaggaattgggatctgggagaaggtgattctgatactaactcacagagcataccatcccatttctgatcagcgtctgcgtgagaagatcgttcaaagctaggcagtctgagtctcattggaagaagtggctaaatctaaatctggtgtcagttctttttttttttttttttttgagacggagtctcactatgtcacccaggctggagtgcagtgatgcaatcttggctcattgcaacctccgcctcccagattcaagcaattctcctgcttcagtcacccaagtagttgtgaccacagatgtgcgccaccacacccggctaaattttgtgtttttagtagagatggggattcaccatgttggccaggctggtctcgaactcctgacctcaggcgatctgcccacctcggccttccaaagtgctgggattacaggcatgagccaccatgccaggcctggtgtcagttctttaacagttccaccacatgggatttagcaggggaaatgctgcagagtgaatgccagagactttgtccagtttcatgtatatgaccattggctctggtttcagagagacttgggtttgggtcccagaatttcttaattgtgtgacctgggcaagtcatgtagcccccacagagccacagtgtctttatctataaaatgaggatgctggtagagttgctgtgagattaaaggagctaattcaaacactcatcccattgcctggtgcaggaaaggtgcctactggatgatagctctcatcgttgaaactctgaagcttgggactggggtaggggacacttccactagagtacagacccaggaataactctggagacatgttgcaggaggcctgccagctttgttggagtgtgtccttcgtgctggttaatacatgggaaatggctcaggaacaatagcttgctcttgggagaatcccggaagtgacagtgtgaaaaatgatggttttccaaggtggtattccctagggctgagatttcttgtccttccttttccatgctcacaggaagaaggggaggtatttggtcaagaaagggtttccagaagaaagtggctcagagtcttgctcctccttcctcccctgtctgtaaattctttgcatttggaatgtgtgatgacccctgtctgggctttgcactcagatccctgggagctaggagcagccctgagaatgggcagcatcctgcatctgccttcccaggtgcagtcctgagaatgtgctgatggagtttagttttaatgacaatcataactccagaggcctgctctttactgtttttgattgtgcagctgaagactagatgacctcattgaaaagtgggagacagaagcagctgttgccacaggaaataagcccccccgccccgccccacctcaggagacacactgcttctaagagttctttggagtgggggtggatccagaatggcagctgtcctctacccagatctttctttgtgtacccagaggttgggctgagctgtgggtgactagactgtggattaagaaaccatgaatagcgtttccagaacaaattcttggcctgtgaaatctccatttagcttgctctaccaggaccacatgtgtctatgatttgcctcctttctctttttggattagagtctgtgccctgcacctcatcccctggttaagctaccatccctcccactgtcggcttggagctggtttgctatgctgtcaaagatctgagtagcaacagatcacgcagcctggtgtttgtggcttattacatactccccaccttggctgagtaaaacatcaagagagatgtactaagcttccaagcacaggggtgaatactgaagccgaaggcttggtgtactaatggtgtaatttgaggtcccagctacaggttagaggtggtggggatttagagacaggggaatttcctgggtatttgttaaattgcagtatcctgagagctcctttatcttctgtagacaacattatgcctgtttggggaacttcacacatatatatccacgtgattctacccagttcccatacccttggcccatcacaccacaaaataaagtgctggagccaaagaaactctaaacagatgtctttagatgaaaacaaagctagcagcactactgtacagcccacatattgttgtagttttaaaagtagattgttgtggcttttggtttacttgctcactccttaccccatttcctgttggtgtgatactgaccagcaaagtcgcctttgcagcgtttccttggatctcttttttttttttttttttttcttgatgggcatctttcacttctaggaaaaccaaacaaaaatttcctccaaaaattcaagtcagtcaacatttattgagcacctaacaggttcatggtgttgtaccaggcactgcaattggagaagaatgttacaagtacacatgcccaaactcgactgtgtccagtctggagagaaggctggatctggccccacagattgtggtgggagactggctggggatgaggctgttggctcttggtgttttgcaggaaacttcaagaaggaagctggggggtgtgtcctccctaggccccccaccccggttaatttgctttgtttctgaaacacactgaccagtagctaaatgggcctagctcatgttcagggctgcgtgctgaaacttcattagctcttttcaaagccctttcctattggtatagaggttcctcttaacactgccagcttccttgaaaggtttttcagctgctccttatagaatcacttcgaattaaaatgcttcattccaggggagattttatttacagccaagcaactgtaactagtagcactccccccaccaggctgcagtgactatagatctttgatactgctgaatgactctgtcaagggttccaatttgcttttatacaagtgcatcacccaattcaaaataaatgcatccagactcccttgtcctctcccaacccccacacactattccatttcccataagcacgtggcctgcggctcaggggtgtcagtcacttagccagctgtctgttgcctgacacagacatatcaagttggttcaccttaactaagtgattgagcttgattgccaaccatctggtgagtttagttaagggaattgtgatttctagaccagtctaacacggccaaatatgtacctccccaagcccccaaaacaagtgtgtctgtgggaccacattttatttgtacagttacagaattttatggctggggaggactgctttccaacttcattgctgaagtctgaatttaccccttcaattcaagctctgaaaattttatgggctgagcccaaggctaattgttccaatattagatgaagcccctgtcctcaagaagctcacagtcactcagaggtaaaaggcagtcaccacttggctctaatgtaatgtaataagtgccatggtagcggcaagaacaaagtgtgctgtgagaatccgaaggaaggatggattactctgcctgtgaggggagagggtcaggaaaggctgctcagaggaggtgatatttgagctgggtcaggtgggaaggctattccaagcgaggagaactgtgtgagcaatggcatgcatgcatttgccatatttggggaatctcggtttagagatgagaggcctcccatgggcacaggttttccagagaataaatgaaatcaagagtgtctgaggctgggaacagtggcccacgcttgtaaccccagcactttgggaggcttgcctgtgttatatgcctttggcaggtggattgcttgagcccaggagttcaagaccagcctgagtaacactgcaaagccctgtctctacaaataatagtaataataataaatcatctgcatgtggtggcacacacctgtggtcctagattcttgggcagctgaggtaggaggattgtttgagcccaggagatcaaggctgcagtgagccatgattgcaccactgcactccagcctgggtgacagagtgagaccccgtctcaaaaaaagagcatctggctgtagaaaggtttttcccaagtatgatccaagcgttaggactcagctccatcctggtcagcattcgtagatggccaagtgtgtgtcattgtggatggctcctccctgggcaccaaaggttggtatgtagccaccttcctttaaattgtggcaacagtggtggcagccaaggacagctgctttgtgggagagaggagttaaatgtgagaagatttattttggttctattaccagcggtccttttctgagtgaggcttaacaagaggcaaacgcctaatgacctcctgagtatcaccaaagtgttcaagataggcttgaaaagccaaagaagatgaaaagaaagaaagaaatcaaagggtccttcaaaagaaaagaagtagacagtaacggctataggatttgggatcactttttccctgcttggcaggttggaattgcagcttaggtatgttgaagggtagttcccctctaatggtattattgatactagactctctgttcccacagagagagctatgttggggaagaaagaaaatatttgatgtctgattcatgaacacgctaactggcccatgcattgtggcagagaagtaacagctttattttgaaaaatgtcaaccttttaaaaaaaaatcaaagaaaataacataggatttttgtcactcatggcatgccttccacatggctttgttttccaaacctggccagcctgcagtttccttcccatagtggggaggagaatgagcctcccacctggagagtgtggagccccaagaagcagcatcctctggtggtcccaacatctgcaaatagatgagacagctgactcctctctggctggacttttgtttttgccctgtgcctgtctaaccttgggcaagcaaaagatctgagagcattagggctggaaggggccttggagaacattgagcccaacctccctcccccttgtacaaatgggaaaactgaggcccacagagagggagggacttgctcatggtcacacagccatggagatagagccaagatttgaactcagggttctttcttctagtctttgcaactatgggctgcagtctctctcagcagtcccaagcagcagattagtctcctggagaggcaggggcatgctttaattgctgccaatagggaaagttatagaaaagagggacagacctacttgctgctctcctcccttaggtaaacagccttgtctatttctagtcacatttcccttccagcgagctttcctatgttatatgccttgtaagtagagaatcaatgaagttcctcagttacagaggagattcaggtggacaaagccatgttatagacctaagtccccttgtggcacaggttttgtcctcaaaccatcatactgaggcacagttcatgcatcacctcctccagggagcatttcctgatttccaagactgagttgcacaacccctcctcaccttagcctttatcaactgtctgtcatggttgactcatctgtctctttctctgggctttgaacttcttgaggacagggaccttgtcttctccatgtcccaagtggatagcacggggtccagcccaaagtagacaatcagtgttttttaaatgaccgaggactcagattcccatggtaacaaaagtttgactcttgtttcctcggtgaattgaaaaaccaaccactgtaggtagggaaatgggaaatccaaacgagttgtttgttattcactgggcaggatacttcatgggactctgctagctcaagtcctgaagagccctgctctgtggtggtatgtctgccataggcccacctgtgcaatccctggtgggtccatgggattgtttcgcttggatgtctgtgactgtagacttcaggaacaggatacaggttgttcaatagatttcagttagactgaaaggccatggctgaattctgttgtccttcacctaaacattattggagggaggcatcttcctaggcagagggagtgaggtggggattggctgattatgaggaggccagagcttcaggtcagaatgttttttctcatctaaatgtattaggttggtgcaaaagtaattgtggtttttgcccttaccttttttttttgagacggagtctcgctctgttgctggagtgcagtggcgcgattttggctcactgcaagctctgcctcctgggttcacgccattctcctgcctcagcctcccaagtagctgggactacaggcgcccgccaccacgcccggctaatttttttgtatttttagtagagacgggttttcaccgtgttagccaggatggtctcgatctcctgacctcatgatccgcctgcctcagcctcccaaagtgctgggattacaccgtgcccggccgcccttacttttaatggcaaaaaccacattaacttttgcaccaatctatagcttggttttcattctctggccttggagtaagccctacaggtttacatgcaaagatattcccattcctaaaagccgtgtaccgtaggatcctgggtcattggaggcagtatcttttacttagactcatttgctccaggaaagtgagcaaaacatctctttttttgtactgtagccaaggctgttgtaggaagcgttgtctgtcattctcaatgctgactgcacattcaaacctttttatgtaaagttgaaaattcacctaagattttaagtaagaaaaaaacagaaactgataccagagttaataagaaaaacaattgttgctcaggccctactcataccaattgcgtcagaatctcatgggtcagccttggaaacactctctagatgttttttaatatgcagccagaattgagaaccactgatctaagtagaaggtgataatgtgttctcttcttgttctcagttactttctaagggattctaaagccagtgacccttgaaaccagaactctcaggattttccccaactctgtgaaggtttgagacacaacagattttgagagaaatactcattctgctctcacctagagctttgcttcagtctaagttgtgtctgggtccacatcaagcacatgggtaagggtacaaagtatttggggaaggcaattctcttcccactatgctttataaggccccagacactcataattttgacttcgatttcattgcttgggcagagtatctagtcctttctcacagattacagaatttcaggtcttaaaaaaaaaactatcggggctgggcgcggtggctcacgcctgtaatcccagcacttcgggaggctaaggcaggcagatcctttgaggtcagaagttggagacagcctggccaatatggtgaaaccctgtttccaccaaaaatacgaaaattagctgggcacagtgatgtgctcctgtagtcccagctattcaggaggctgaggcaggaggattgcttgaacctgggaggcagaggttacagtgagccaagattgtgccactgcactccagcctgggtgacacagcaagactctgtctcaaaaaaataataataaaaaaacctgtggatattttgctcagtacctgggtgatgggatcattcttaccccaaacctcagcaattacacaatatacccaggtaacaaacctgtacatgtaacgcctgaatctaaactaaaagttaaaacaaacaaacaaaaaaacccaaatcataaaaaagttacctccaaagtacattcataatagtatagccagagcagttctaagtaattttaaacggtgagtgagagaatgtttgatacctggcttccattcattcattttctttggtctgaatgtgtagtgggcacatggtggaaacagatctttgactttggggcttttgaggtttgaggcttacagagagagccctcagtaggaggaggggtgtgtttacataaccctggggcaccctgtcaatgtattctgtgcagccaaacagatcaatagagtgaaaaaaacaattcagctgagtgaactgataggctgataggttatttgattgactgggctggtggagccactcaagaagaaactacagtgctataacttgggaggccagataaacagctgatgccaaaagcatctgcttagcaatcactggagcccagttgacacaagctattggaaccacatttgagtaaaaaagatataaagtgcactggggtaccatgactatgggtgaatcttcttcctcatcatactgtagtccttcagatctcaggggccgtgtagcttattacctccaagtttcttcttaaggagagaagagagcacagctctgtagtgactctaaagcttctcagctgtgtggacttgagcaagtgatttgacctctctgagcctcagttgcttcctccagccataggagtaaatatattatgtacttcatagggttgatgggagagttcagtgaggttagacacagaaaatgcttagaaaaatgcttgatgcatatacataggaagcatctaataaatggtagcattgatgattcttataaaatagaatgctgcaggccaggcatggtggctcatgcctgtaatccaagcactttgggaggccaaggcaggagatcacttgaggccaggagtttgagatcaacctgggcaacatggcaagacccgtttctccacacacacacacacacagacaaaattagccaagcatggcagcacacctttgctcagtacctgggtgtcacagctactcaggagggtgaggtgagagaattctttaagcccaggagattgaggctgcagtaagccatgttcacatcattgcattccagcctgggcaacagagtgagaccttgtctcaaaaaacaaacaaacaaacaaacaaaaaacgctgcaattggtgcagtggataggacacagactttggtgtcagatgatctgggttcaaattctggctctaccacttcctagctgggtgcctagggcaagtcagtataaaatctcttggtaggtcccacttccctcgccctctctcatagctgaagggtgaggtgaggtaagcctttagcaatgggcttggtatgtaagtggtcaataaatgctggtttttatgattatcaatcgccatcaatatgatagttactgggaaattgccctagttcttcagtcactcctcagtaggacgcaatttccttagtgctagtcattgcagtcccctttttttggttgtgttttggtttgccatttactcccatgtggagtgtgggatacaaaatgaaccctagatccatgccctggggcctagccttttcataaccctgccccactcattcctgtttgcttatgcagagcttcccgtcaatgaaagccccaaggtcctattgtaaggcctgctgtgaaaccaggtctcccccagcttctagctaattgatattctaaaaccttggattgcagcttgacctttatccttgtcaaatatctcttgggttttggcccatgattccagccagtcattggctctttgtatcccactttcttgattattttggttgcgttttttaattaggcgttgtgtgttgcagagacacatgatggtgcttaatcatgccaccatctccctcattgctctttgtggttttgtgagtcttgaattgacatgtgtgctcctcatttagccttcctgaaaaccctacctgctgcacctatactttcaaacatgcactgctggtcatctggaggcatttacctgaaatgttaccatggtgcctagacaggactctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaagatttggctggttacaataaggctagatgggctagatgaggatacacaacaatggctcaccccaatttggggaagtcctttttggcctttatgcaatgggctctctaaaggactagccatgtggtagcctgtctaggggtggggtacacagtgggaggagcccttattgatggtcttggggtctggaacccatttcctgctaggcaactgactcatcctgtgacttagggaagcaagccattgcccatctctgggtttcagtttccagagggtgttagattggaaggtttcttccagatttgaactttgactattttagtgacttaagagaaacagctgaatccaagtgcaaacgtctgtcttgcacctttaaaaagaaccaaaaccacattgtaggcaaacgatccccagtttgaaatagcagcttccgtctttggattgtgtcctgctgcccattctttctcagacctgcctggttccacacactggctgaccatacaagaccttttcatctcagcactagatgtgcacgtcttttttcttgactgtgctctcagaatactgggagagattttttacaatactgttactactgccatgaatagcacctaccaatgactgtgtcttgtgtgacaggcactgtgctgtatgctttgtgtacattttctcttttgatccttataatatcctatggagttggcattgttattaatcccttttacagatagagaggagggatgactcatggaagtgacacacagctagtaagttgcagacttagtactgccagatcccagggtcttaatgagtattataagtatgctttttgcatccctgggtggaacttggatgtattaataataacaacagtggcagtatctcttatacgcagtgaggtaggtgctgttatcctccattttatagaggaagacagcaaggctgagagagatgtggtaacttgcccaaaactgcataactataagaatccaagctgaaacgaatctgaggctaattgccctcaaacccatgctgttggccaggcatggtggctcatgcctgtaatcccagcactttgggatactgaggtgggcggatcacttgaggtcaggagttcgagaccagcctgaccaacatggtgaaatccaatctctactaaaaatacacaagttagccaggcatggtggcgtgcttgggatgctgaggcaggagaattgcttggacctgggaggcagaggcttcagtgagccaagatcacaccactgtactccagcttgggcaacagagcaagactctgtctcaaaaaaaaaaaaaaacaaaaccaaaaacaaaacccgtgctgtttcttctacaccatgctgcctttagggctagaacaagtcttaaagaggctgtgggtttgctttctattctctgctcccaggaactgtggcactgcttttctgaatggctttgccggcgcagctggccaggcttgggcaattcagggttcccatagtgcaagagcagcatccacccgactccatctcccagaagcatgcagtacttactgacaattgtatgcccaaagtaggtaattttgccttttcaagcacaaaaaggtaaatcaaattatacccaatatagagcagaggaaaagaaggaacaaatgaagtaggaagaaatgcattcccttctgtgactctcctcagccactgtctgtgtcactgtctataatatatactccttgcttttcatttccttgcatatcagtgatccatgttcccagtggtgtctaaaggccacctgtattcaactgttagctgccttgcatgtgcctatctctcagtttcagcagctgcttcctcagtttccctagtcttggcaggtaggagctttttacctaaccaatagaggattgccatccagtggtacatattgggaactgcatggctgaaaaaaaaaaagtcctgaatttttttccccctttctaaaggcaaacaccacccattcctcaatcctacttaagggattaactatgccctttcttctcttttttcttagtcttttgtcagctttgctgctcattagctcttatacaagaagcagagcaggagaagtaaatgcagggaaatacaaatcactgccggatttcagcacccccacacccccgctattgtgaatggtttgctgggagagaagctctaggaactgatggggttcagctcattcagaaaatcctgttctcctttggtattgatggctgaaaactctgattacatctgcagagcagtgtgaatagtaggttctaaaaggggctgatacaaaggacaattcacaacagattacgtacaagtaggtaataaacaaaaggcaaaaaatcaacttcacttgtaatcaatgaactgtaaattaaaactaacaagagaaattatttttgcatataaaattggctgagaaatgttaaaatcaaaattcccagggttgacgaagatttcgtgaaatggttgtttttctacactactgctgggagtcataaattactcagcctttatggagaacatgttgacaatgtaatcaagagaattaaaaatgtctatgcgctttgaccccatagctttgttactagatttcacataaagaattcatcagacactactgtttatgtctacaaatcttaactttccctattataatagaaaaaaacaagactctgaatgtctaaaaagtgtttcttaaactaaggcataatcataggctagaatattacatagcaatttatccaaaatcatgttcttagcaaatatttaaggatttaaggttttaggaaaacgcttatggcataatattttttaaaaaattctctcagggtacaaaactaatcatatctcctctttgtacgatataccttttttttttttttttgaaatggagtcttgctctgtcacccaggctggagtgcagtgatgtgatcttggctcactgcaacctctgccccctgggttcaagcaattatcgtgcctcagcctcaggagtagctgagattacaggcacccagcaccacacctgactaatttttgtatttttagtagaaacggagtttaaccatgttggccaggctggtctcgatctcctgacctcaagtgatccgtctgcctcggcctcccaaagtgctgcgattacaggcatgagccacaatttatagaataaaaaatgaggctaagggaatgatagtccagcttaaacacacagtcactactaagaaaatgattaaaagcctgtacattctggactcatggagttagaacttaaaaggaccttggagtacatctagtgtcagccccaccaatgccactgaaatcccctcggtgactacctgacacactggttcaggcagtctctctttaaatactgtggttaaggaacttgctcaccgcctctggcaaccgcttcttcaaagtaaatgatagtgataatcccatccctggtgcgcgtctagtgatttatagtctgtgaagcttctaaaggcacattttcctctcacgaaccctgggaggcagggagaacaagtacatttatctgcattttccagatgaggatcctgagttgaagtgactcccagtggtaaagtgacttgtgtagctggtggataagataggactgcagtccaggtttcctgactcccactctgaggcttgttccagccctccacaaaatccagggtctagtttcattcaagtatctccttttattgagtttatgttggtcttgctatagctgtgacccctcccatgatacctcatacatcgtctcttagaccttgaaagatgtgcttggatgtggggccacatgctagctagctaaggtccagagtagggtgaacatggaaagagctcagggggagaatgaagaaaccaatgagtccaccttgctgcaaattctagcagtctccacacaggaatctgcaaccatatttatgaaacgttgttttcataaactgctgcttgttcaataaggcataaaatagccagtataagatagttatttgctctacaatatcgtttctgcaacacagcttcaatgtcatagcagttactgcattttgtttagtttcttaagagatgtgacacagtagattaaccattgacatcaaaatgcagaggttcccttagagctgtcagcaatcttgttccattcttttcccacaactctgcatcccgccttgggaaagcatttgtacacttccactgcaaggtctagtcacagacccactcggatttgtcaatgtcatgggaaagcaacaggcaggaagacaactttctatgaccttgggatgctatctgtgagttaggcaaaggaagctgagattcagtccattactggttatccctgtacacggatggtccacatcccattccagggactatgaagaagggcaaggaagacacagtagagttttccttctcacagaggtggcaagagaaatacacaggaaaggaagaacaagccagaaaagacaggataggctgactcttccaagtgcagtgagagctctaagagggaggtgactcactgagggctgccggttcaggtcaggactaggtcagaaacctgctctggcctagacccaagggttggcagagaacagaaacagctcagtgggtttgagaacaggatgggcactggccacgggagccaacaccatgaggtcctgatcaaaccctgcaggcgtcttctctggtgcagaggcacctacttccaggaactcagtctcagaactcagcaggaagtcacaccagccctcccacgcctaatctgccagctgctgcagcgggcacttgcctgccctggctttggagccttcattcttgccctagtgggggcagggtatgttctaactagagaaatgccaaacacctatgcttgccccttccgctggtttgactgttttcccggaatggacctgagaaattcagtgaaatgattcaaagaaacaattagttgattccattagaaagttagtcaaactggtatttaagctgaatttattctggcagatgggcttgcaggggtagactcctgccatagttcctgaccatctctccccaccgtgttgctaaaggtgggaggaactagaagataaagggagggccccagtgggaacgaatggaaataccaaaagctttgtgcgtgtctgcttccatccagctgctaactgttgtcccactccattagcccaatcttgcccagtaagttctcatgacagcagtgcacatcccttcccaagagcaccagaaactgttgtctagcagatgttaggatacgtaaggggccaagtgagttaccacgaagggactctcaggtccatacattgatatgaagactaggtttgaagccatttttcactatgttcttcagtttgtccaggttcccaaagcccaggttattctcagtctaagatttttttgctcgactccccacagggtcgagctatgtgatctatgtcaagtggtacctcccttctgagcctcagggtctccatgtgtaaaatgagatcgttaagtcagatgagctcagtggtaccttacagctcaagcattcattctgtgaattcaggtttgtcctcttttggtccaaactgaaattgccttcatgggatgacccaagtgtcttgttcctaccaatattcttataaactcaattcttttctatctttttaattccctaccaatgtgggcatatgggtccactttgttcctttcacaaagaaaatggtctgcattgaggtttcttttcaagaggggcaaggaggaatctcgtatttatataagatactcaggcccatcacctgataccacccttccatcttaggtgtgtttgatcattcattcatgtatatatttattcattctctcattcagcaatatcaacggtgtgactacctcatgcatagtatcatggtgggcaatgcatatgcataagaatatacagcatgatcacttttgtaagatgggaggtgattcacaatgaaccctgctgccatcctgagctgtcaccctactggagtcactctgcgctactacataccacccctggcagagaccctgaaacttacaccatatcattagaaagacaagctacctgtgtttaagagtattgcaaatgatcaattcataggctaagcaatctagaatagagagtacttaaaagacgttaaacctaaaagaaaagaggaaaaattgtgcaaactaacagaagctatatgtgtgtgttttcattcctttgatgggacactcaggagactttgagtatcagacctagtgttaagagggctattcttaagacctttgattaaatcagtcaaacttggagtcagatgctttcaatgatactcttgtataattcttacccctttacctgttttacagaaagggaaactgaggccctatgtggccttcactataatgtctggttgcttagaacacagttgcagttgtccgggcacggtagctcacacctgtaatcccagcactttgggaggccgaggcgggtggatcacttgaggtcaggagttcgagaccagcctggacaacatggtgaaaccccgtctctactaaaaatacaaaaattagccgggcctggtggtgcacgcatggcatgtaatcccagctactcaggaggctgaggcaggacaatcacttgaacccaggaggtggagtttgtagtgagccaggatcgcattactgcactccactctgggtaacagagtgaaactccaactcaaaaaaataaataaataaataaataaaagcacacagttgcagtgctgcaaaattcctctttctttaagggagaagatgaatagtgctcaatcctgatatcaggaaaagtcacaaggccctgggtctccagctccaacagttctttctctgtggcgtcctcgggccaaagcccagctatatcccagctccatgtgggcatccagagaaagcagaactggagaaagccttgagaccagccttcctgtttaagctgtagtgattgacaccaggaactttcctcacacacctttatttcagattactggcctactcagacctttgcaaccttcctgaccccacaggcatgattaactgcctgaattttttgtcacgggtcggttttcccacctggtgtcttgcgtgcttttttccttggaatttcttggaatctttacacgtttttgacacctgctttgaccttctagatcctggagcttttgcccaaaaggctctgaaacatgcatcttgcctatggagcccgcatcctagcctgccttacttgggctgccttgataccatcccccatcagtgtgacaatgatgattctgggcacgtacaagcctctttcccaggaagctggagcaccaaatgacagctgtgtttgagggatggctccgttgacaactgattcagaatattgacaagacttcattatgtttttgctcttgtgtttacatctttcaagtgtgtttgaaaaatcaagaaaacaatacaatttggtttcccaaattgaaatgacaatgaaactgcctttttatttatttaatttttgttattctcatatttctctaggcctcttctcacacacaccaccagccaccaccccccatccccatctccccaccaactttctttctggaaaagacacatcccattgtagctgtactgatctctagtcacatactgtatctttgcagatctctctgtcattgctctttctgttctcattcatagatgacacagctaaagacggtatccaggcctatgcaggtttggctgaaagggccaacatggcattttcttttcctaaagatggtgctttggtttgtagctgtttgctcctgcctttctgtttttcgggaagcctgttggctttgcttgtaaagagacagcctgtaaggctatggtgattgaaaccagtcagcccagtgcaattcaattcggtggaagaacactgagtgcctattacaaccaggaatctaaaggaagggggagattcacccttaccttgggagcccatgtggggaaatgcatatcttcagagaggggaaaaggctgtgagagttcacaagtgggagtgacttggctctctcacctagttttcaccaactctgaccactttatttcacctcccattttaaaatgctatcttgtcttggcttgattgatatgttatttctgtgattttttttcctgcttttcttcgttgctaggtcttctttctccctctctctaactgggatttcttagatttcttaaagacctcatggacattcctataagtatgtgttgccaaccttctagacccaccaatcagaaaccaaactcatcatcatgccttcccgttttgttaatgaagtgccacttttttgtccaagatagaaacatcactgtcatcttgagctattccgtcaccatcctttctctgccgtctgcatattaattgcaagttttcttgattctattaagaataaagaaatttgagagctgccagtaacctaagaggtgatctagtatggagttttcattgtctcagggagtcagaggattagtagttaagctgagactagaactcaagtctaagattcctagactgttgcttttttttttacttcacatgaccctaaaatataggtaaagttcatagactttagaaagaaatgactaagttcaagtctccactcatctctaccatttgctagctttgatcgtgggtaagtagcttaatctctgtgcttcatctgtaaaatgaaatgaaaataccttatgtaaaggaatggttgttagaatcacatgagaaaatagcataaaacacttagcatcagatggactctacatgagatcacctcagttccagatctactgctaacactcttctagacctttccatgcttactgttaaatcttatctttctaatatggaacatttagactctaaagctttttgctgttctgaatcctatggtcttaactatgtaaggaattcaaattgaagtagagtttcaacatcttttgaaaaagagagtttctgcaaatgttaatacctcagattagctcaaagaaagataaaacagagagctcattagtaagtacttgtgaggtacttccaaaattctgctttgttaactttgagaggcaagcaaaagagacccgtagctagtctagacttaagccatgtccagaaagagtggctgattggtttacttgtgaggtttgggtagggggaatagtatcatactagatatcctgtttaatagcctgttcttattttcacttaacaatatatcttggtcatgtattgtcaatgagcaaataactccttatgagccctagtgtacatgcacatttagtaggggaaccctaagagattggaaaatgcatgagaggaagagatttctggaactgcagggctgtctaaaggagtgggaatatccttggagccattgagaaagggacagagacagctgacatctttctgagagtagaggacaaagggaggaaaggtagaggaagaaggttgcctaagaactcatggctctaatgtccttggtgattgcttggcctaaaacacttcaagccttacaaactgctttttaagacaaaccagtgtcatttaaaatcactgctagggatagcctttctatgtctagttaccttagattatcagagctgaaagaacttcagagatctctttaaatgtaatatgaggaaactgaggcccagagagcagaggaatagttcaaagccctcccaatggtttgatccttggtagcataatgagcagcatattagctcattttcatgctgctaataaagacatagccgagactgggtaatttataaaggaaagacatttaatggactcacagttccacatggctggggagccctcacaatcatggcagaaggtaaaggagaagcaaagtcacatattacatggcagcaggtaagagagcttgtgcagaggaactcccatttataaaaccatcaaatctagtgagacttaccaccacaacaacagcataggggaaaccagccccatgattcaattatctccacctggcctcgcctttgacaagtggggattattacaattcaaggtgagatttggatgggaacacggccaaacggtatcaagcagtatttaactggttttgtgtgtgtggagagggaacagatgaatcatttgtattattattcctatgcctaacgaaactaagtcatatgtgtacttaagacagagaaccaaaaccttgatttttctcttgtagggggtggctaaactggagttagaagcctactttgcctgacctttttagctttgataaaggcaaccttgattcatgatgcatgagcctgggtctttgaaaccaataagaaatggtttgttcattgaacgtgcaaacaaattactttccaaagactaaaatttaaactgacattaagctccaagagcatctatatttaattatacgtaaaggccagaaaacaatttgtaaccttaacatagtaaaattaaaagagaaatcccacctatgcaaataatttatttcagtgcaacactaccctttaggattgccatcgtttgcctgtattagcagtgctggctttaccaatatttccagggcggccctgaaatatgagtttagattggaaaaaaagcagtcagagtagctcccagggcaggctgatgctatagaaccacggagtgtgctggcttccccaatttccttttttttttccttttcttctgagacggagtctcactctgtcacccaggctggagtgcagtggcgcgatctccactcactgcaagctccgcctcccaggttcacaccattctcctgcctcagcctcccgagtagctgggactacaggtgcccgccaccacactcagctaattttttgtatttttagtagagacggggtttcaccgtgttagccaggatggtctcgatctcctgacctcgtgatccgcccaccttggcttcccaaagtgctgggattataggcgtgagccactgcgcctggcctgagtgtgctggcttctaacaagatttgcctcttggtaggaggaataataatgaaataccgtctatgataatatatttctctcgggatgtatcttaggggtcaaaatgtagtagaaggaacacaggcaagaaagcacagagatctgggtcctaaattggatccagagcaactcccatctccactctggccctcaggctcttcatctataaactatgaggcttggacccagtcagtgattacattggaagaaaagggagagaatgtgaaatgaagaggatgaatcaaataaaagtggcttcgttatttctgaatgctccctcaccttcctccactccttgacatacacacatgcatgcatacactagttttcccctcagttgagcatgagagtcagttcccctcagttgagcatgggagcatgagagtcaggatatctgggttctcatcccagctgtttcttgaactctctgtgtatcctaaagtaaatctcttgccctctatctctgttccccatctgtaggatgaggagagggtgttgggttttcattggtacccaccaggagtgtgtatatatgtacacacacacacagagtccatccccagctaactaaagcagggcttcccctggggcagggctctgcaggtctgtgtgtttcaatggcttcccaggtcactctgatgtgtacttctagcttagttccctggctggccagtctctgtgggccttcccagctctgccattctggaagacgaatgggcaattttaggggccttttcaggaactgtgtgtcctgctgctgtattctggtggcacagggattagctcaactgcattttcagctcaccccttccgagcagagtgatttcacaggatgggagctgtgcagagggcaggaggcacaaagaaacactctgtggagtcacaatgtggcaagccgccatgacgctgctcttaacctcccagttgttgcccacgtgggcttttcttgaactatgcaggaacctgattaaattaattgattcctggcttttcgaaaatccctctctggtgggttgcatgctgcttatcaagatgttctcgggaagctgatgccaggttaaattccttgcactgagaaggccagagccggcttgattcagacatggatatggtagaggagggagggcagcctgttgcctgcttttctttccttgtcgctttagcaaacatggagcattacaggccaaatgtgcttgctgagtggaaaccaggaggcactgagcgggtggctcagtctggaacgcacagggcgtagtgcttcttagcacagcttctgagcacagaggagactgcaacaaatgatagctgctgtgttattgtagtggcagcgcagtgtaagggaagagaagctccctgaagaagacttggatgtaaccccagctcttctgctcttcttgacttgcagatccaaaattctcagcttccttaagtttcttggtctctaaaatgaggaggctggactcaatcaattattttcaaacttggactctcagggttctgaggaggcaccctgagggctgcctcaggggtatggaaggtggaagaggaggctgagcaggcagaacccagaccctctaactgaccacctagagcctcaagaacaaactgccattcacatcatagtctatgtcaccagttctcaaacttttccatctcaggactcctttatactcttaaaaatgactgaggacctcaaagagctttggttcatgtgggatttatctattgatattgactgcattagaatttaaaactgagaaattttcaaaaatatgtattaatccatttaaaagaacaatagtacctattgcatattaacatatttttattaaaaataacctatttccaaagtaaaaaaaaataactgagtggcattgttttatattttgcaaatgtctttgatatctggctccatagatgatacatggattctcatatcagcttctacatttgatctgttgtgatatgttgtttcggttgaagtatatgaagaaaatccagcctcacacagacatatatttggaaaagagaggcccttacggactccctgaatgattctggggaccaccagtgtctttataccacactttgagaactgcttctctacctgaattgcactccctggagatgtacagtgcccatcctgctgggcaatgaatggcagctcttctctcactccctcccccttcactgtatcccctctttatttaaagcagctcagtttttctattttatataatggagatcctggaagattttatttgaaaaaaggagtctgcttctaaaagtgtttgaaattcacccaccttaatcttaggttactgaagatataaggatttggaagctgattgagatcctatcactcggatttttctcccctaaggatgcaaactcttgggctttgaggagggtcctttggcattgtgcctcagctcttcctggacagtgactggcatgtcatcttgacagtgacagtcttagcacatgaaaatgccactgaatgacttgaaagatttaatgccacttcacaatgggactgacctgcccagggagtgatacaggctgaaggtggaggggattcaatatttgttgagctgtctgatcactgaagcagagagatgggccataagggcaagtttcagtgatatacttctatgtcgtcatctttagagctagacattcatcatcattatttatttcctagatttatgtcgaactttcattccaagggacaggagccagtgttgaataccatgggatctaagtgccttcacaacccattgaagcttcctccaatttcttgtttaataaagaaggccgtgctcttctttcccttattgccagagtcattattgatttcatgttattccttttataaaatcacctcctgggttttcctaggcttggctcttatagccgagaatgttctctcctcagccttctgctgggcctgatgctgtgaatcccatctatgtgggtcaggggacaattccacagccatcttgccaacatgcccgcgttaggctgtgagcatgcgcagaagtactctcagagctgtggaggaggggaggctcccacacccgctgccttgtccttatttgttttgtttctcccaccagcctaggcattaattaagaggcccagactcaaaagcccaccgttagggtcaatcatttgggctaattgagtgtttccaatttagtggaactcttctctgaaagtaagaaataaaactgaatccctgggagaaaccggaacccttgtccattgctggtgggaatgtaaaatgttgcagctgctatggaaaacactttggcagtttctcagaaagttagagtattatatgatccggcaattctactcttaggtatatatctaagagaaatgaaaacacatgttcacatagaaacttgtacattaacattcatagcagcattaatcatgatagtgaaaaaatgaaaacaaccccaatgcccatcagtggatgaatggataaacaaaacgtgctgtgttcatacaatggaatattgtttagctgtaaaaaagactgacatgatgattggtacatgctacaacatgcatgaacctcagaaacttgatgccctaagtgaaagaagccagacaaaaaagaccacatactgtatgattccatttatatgaataatccacaatagacaaatccatagagacagaaaacagatgattgccaggagctgaggggagggtggaagggagagtgactactttacttaatgggtacaaggttttcttctagggtgatgaactagatagaggtgacagctgcacaacatgtactaaattccactgaattacacactttaaaatggttcattttgtgttacatgaatttctcctcaataaaaaattcaaaacaaatgaacaacaaaacaaaacaaaacacctgaatccgtggctgctaccctctttcgagctagtttctcttatgaatgtgtgtggaataaggaacccaagcctgggccgtgaactcttccagagtgggaaatgggcttccaataactcgtagacactcaatagttatatactattgagtatataactattatcatgtatggagatatcatatatggtttcccatattgctgtcttcactgtaggctcatggaaagcagggaccatgtcttattcacccttgaattccaagcgcctaagcaccattcccagcacataggagacaatagatgtttgctgaatgaatgaatgaatatgtttgtgactcctctttattcatctctatgcccccccccccaataatgctagtaatagttctaccacagctggtgctcagaacagatctatggatttgtcaagtgagtggggatgagattgttttagttttagtttttttttaaggttatttatttcaaatgaaccttaaagtaaacttaagttccataaagagtcatattggggttttgattagcgtttcattactattcactaaaaacacttttttcaaaaatgagatataaaaattggacaggatgtagaaaaataggagatttggcctatggagattcaaaaagagtaagagagagatctcagctttaataaggggatgagactgattagatgcattttactttaaaaaaaaattgtggatatctataaaatggaacattatccaggccatgaaatggaatgaagtactgataaatgctacaatatggatgaaccttgaaaacattatgtgagtgaaaaaaaagccagatacaaaaggtcactgttatatgattacatttatttgaaatgtccagaataggaaaatccactgagatggaaagtagatgactggtagtaggggctggaaggaatagccagataggccagggacagctaaagggtacagggtttctttggaggtgactgaagatgttcagaaatggactggtggtgatggttgcacatgtctgtgaatatactaaaacccattgtatactttaattggatgaattgcatggtatgtgagttataccttcataaagctgttagaaatttagataaatgtcagaaaagtaaagaatacaatttgaatcaaaaacaagtgtgactgtgttttgggagagatcttcatctaaaatataaaataactgcctggctagattcaaagggtttctctaggaaaagattcctttactttttattttttattattttttcatttttaattttaattttttgtgggtacatagtaggtgtatatatttctggggtacttgagatgttttggcataggcatgcaatgcataataatcacatcatggaaaatggggtatccatcccctcaagtatttatcctttgtgttacaaacagcctgattacacacctagttattttaaagggtacaattaaattattattgactatagtcaccgtgttgttgagatatcaaatactaggtcttattcattctttctatttttgtattcattaaccatccccaccttccccctacccccctccactacccttcccatcctctggtaactatccctccactttctatctttatgagttcaattgttttgatttttagatcccacaaataagtgagaacatgtgatgtttgttcttctatgcctggcttatttcccttagcataatggcccagttccacccatttgttgcaatgacacggtctcattcttttttatggctgaatagtactccattgtatataagtaccacattttctttatccatccatctgttgatggacaccttaggttgcttccagattttagctattgtgaacagtgctgcaacaaacatgggagtgcagatatcttttccatatactgatttcctttctcttgcatatatactcagcagtggaattgctggatcatatggtagctctatttttagtttttgaggaacctccaaactgttctccatggcagtcatactaatttacattcccatcggcagtgtatgagggttctcttttctccacattcttgccagcatttgttattgcctgtcttttagatataagccattttaactggggtgagatgagatcttattgtagtttttatttctctgataatcagtgatgttgagcaccttttcatatacctgtttgccatttgcatgtcttcttttgagaaatgtctgtttaaatcttttgcccattgcttaatcagattattagatttttctgtaaacttgtttgagctccttatgtattatgtttattaatcacttgtaatgtcagtagtttaaaaatattttcccttcactttattatattattatattatattatttctctcttcactttatttattatatcctttgctctgcagaagctttttaacttgatgtgagcccatttgtccattttgctttggttgcctgtgcgtgtagggtattgctcaagaaatctttgcccaaacaaatgtcctggaaactttccctaatgttttcttgtagtagttttagagtttgatgtcttagatttaagtctttaatctattttgatttgattttcatatggcaagaaataggggtctagtttcattcttttgcatatggatattcaggttttccagcaccacttattgaaaggactgtcttttccccagtgtatgttcttggcaattttatcaaaaatcagttcaatgtccatgtatggatttgtgttggggtcctctattctgttccattgacctgtctgtttttatgccagtgccatgctgttttggttgctatagctctgtagtataacttgaaatcaagtagtgtgattcctccagttttgttctttttgcttaggatagttttggctattctgggtcttttgtggttccgtagaaattttaggatgatttttttgctatttctgtgaaggatatcactgttattttgatagggattgcatcaaatctgtagattgctttggtagtatggacgttttaacaatactgattcttccaatccagggacatggaatatctttccattttttggtgtcctcttcaatttccttcatcagtgtttcatagtttttttatagagatctttttctttgactaagttgattcctagatatttgattatatttgtggctattgtaaatgggattactttttaaatttcttttttagattgttcgctgttggcatatagaaatgctactgatttttgtatgttgattttgtaattgcaattttactgaatttgtttaccagttctaatagttttttggtggagtctttaggttttaccaatataagatcatatcatctgcaaacaaggccaatttgatttcttctttttcaatttggatgccatcatttgtttctttcttttcttttcttttcttttcttttcttttctttttgaaatggagtcttgctttgtcaccaggctggagtgcagtggcacgatctcagccgcagccacgcgtgatcccaggttcacgccattctcctgcctcagcctcccaagtagctggggctacaggcgcccgccaccacacctggctaattttttttttgtatttttagtagagatggggtttcactgtgttaaccaggatggtctcaatctcctgaccttgtgatccgcctgcctcggcctcccaaagtgctgggattacaggcatgagccactgtgcttggccaaaactacaagtttcattctcttgtctgattatgctagctaggactttcagtactatattggttaacagtggtgacagcaggcatccttgtcatgttccagatcttaggggaaagactttcaatttttcctcatttagtatgatactagctgtggctctgtcatacatagcttttattatgttgagctatgttccttgtatacccagttttttgagggtttttatcatggagagattgaattttatgagatgtgttttcagcgttaattgaaatgatcatatagtttttgtccttcattctgctgatacgatgtatcacattggttgatttgtgtatgttgaaccattctagcatccacaggatatttctcacttggtcatgatgaatgatctttttaatatattgttgaattcagtttgctagtgttttgttgaggatttctgcatcaatattcattagcgatattggcctgtagttttctttttttgatgtgtctttggttttggtatcagggtaatactggcctggtagaatgagtttggaagtattccctcttcctctatttcccagaatagtttgagtaggattggtattagctcttctttaaatgtttggtagaattcagcagtgaggccatgaggtccagggcttttctttactaggagtcttttattacagctttgatctcatgacttgctattggtctgttcaggtttaggatttcctcatggttcagtcttggtaggttgtatgtgtctaggaatttgtccatttcttctggattttccaattttttggcatatacttgctcatactggccactaatgatcctttgaatttttccactatcagttggaatgtctcctttttcatttctgattttttatttatttggatcttttctcttttcccttagtaagaaaaaccaactttttggtttttttgtttgctttttgtttttttttttttgtttttttatttttaacataattttattttaatacacctatatgtttgaatatttgaaatctcaatcaccttcacagcacaatgattctacaaagcattctttcctttagcctcactgtatattttatcaaatgacatgactgttcctaattcataattgggacctaaacctaatggaaaatactatttcatgtattcaaaaatatttgtggtctttttctactatgtatatctggcattgttctcaggactggactctattagttttattatgaaaatgttaacatttctccatagagttgttttacaaaaacacctgtttttcaaaaacattctggggaacaacctgaaaacttttaaataacatttagagcatggatttattttaaaaattacctgatcccttttttaatgcatattgtgactttctttaatcatgaaaagttttcaacattattttggcatacctgaaagcttttaactgtccttaaaaaccccaactttgcaatagtaaattatttcatgcatcacaaaatagtcttataaaccaactttttgtttcactgatcttttgtattgttttcttcatttacattgcatttatttctgctctgatcttcgttatttcttttcttctactgttttgggtttggtttgctcttgtttctctggttcttttttttttttttttttttttgagacggagtctcgctgtgtctcccaggttggagtgcagtggcgcgatctccactcattgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgtttctctggttctttaagatgcattgttaggttgcttatttgaagtttttcctcttttttgcaagaagggtaataagccatatttattttaaaacataaatttaaaagtacctacatcaattattattaaattgaaccagcaatatataaaataaataatgcattgagtccaatttcagttgggttcacactagaaaacctaattagtataattcaaccacttcagcaaaaggaaagaaataaatatttcaatggatgggggaaatgaatttttattattccaaaataattcatgattttgaagaactcttagcaaataaaaattaaaatgaactttcttaacctgataagcagaatctaatgaaagcttacaacagtcaccccaaatggcaagaagttagatcattccctttgaagacaggtttttcctcttttttgatgtaggcacttatagctataaacttatctcttagtactgcttttactgtatcccataggctttgggatgttgtgcttctactatcatttgtttcaagacgtttttcaattccttcttaatttcttcattatccactcttcattcatgagcatattgtttagtttttatatatttttgtagttccccaaattcttctcattttttatttctagctttattccattgcagacagaaaagatgcttgatactatttcaggcttttaaaatgttttatggctggttttctgacctaacatatggtctatccttgagaatgatccatgtgctgaggaaaataaagtgtattctgcagccattggatgaaatgttctgtaagtatctattagatccatttagtctatagtgcagattaagtctggtgtctctttcttggttttctgtctggaagatagatccaatgctgaaagtgggtgttggaatctctgattattatcgtattgggacctatctctctctttcactctaatggtatttgctttatatatctaggtgctccagtgttgggtgcatatatatttaaaattattatatcctctttctgaattgacccctttatcattatatagtgaccttctttttctcttcttattgtttttgtcttgaaatctattttgtctgatacaagtatagctagtcctactcttttttttttttggtttccattggcatggaatatctttttccatccctttattttcagtctatttgtgtctttataagtgcaatgtgtttcttgtaggcaacaaatcattgggtcattttttttttaaataaactcagccactctatgtcttttgattgaagagtttagtccatttatattcaatgttattattgatgagtaaggacttactccttccattttgttatttattttctggttgttttggaaagatccctttaaattgggctttcctttcagcagcaattcatgtgagtttccagatcattacctacttgatgaggggctaggggcagagtagcttaaaggcagagtatgaagggcaactgccaactgttgggcagttggagattgatcagaatgtatgtcagtgggaaactaggattcgatttacacaaacccagctgcctgatgatttctgcactgcctgtaggatatatggggtgtccacattttcatgaggaggaatgagcaagcagtctaatgatgtgccacttatacaattagcaattcagcaagttcaacttcaaataagcagttctgaattcttcttcctactccaggggccgtccccactacttcagtgtctatcagcttttctgaaagaagagacaccatggctacagggaaaccatggtggggctgtgtgtggaggcaagtactgcctagtgttggatgcagactgcagctgtatcctttgcccttaggcaggaagaaactcccacagcatcatcccagctagagagtagcttggatgtcacagtcagacaggcagccccagcaaccttaggtggtacagcagtttctgtggggagattataaagccctctgtggttacgaaggagttgacaagctattctgatggctttctgcctgttttccttggatcctgaagacaagagcagtccaaagttattcctgggaagtgagaatcaggcatcagccaaggctttgtcagatctgggtttgcagatgagggctcattcaatgttccttacaattgcaaaaaaatggacatgtgaaaactcacttgtaacttgaaggggcatcatttctaattgggagatagccacagagaaacgaaggggccaaaacattgctagtgtgaaaagcacataggctttggagtcagatcaacctgcaagtcccattctttatgtcttagatgcatgaccttgtccaaggccttcacctctgagccttgatttcctcacgtgtaaaaggagataggaaagagcatcctacaggggctattcttctaattaaacaatgtccagtcctcatgcctggatctccgccactggctctcaactcacctttttcctcctatctctctagcatagattgctgcgttcattttattgtagagggaccttggtacttttaagattcctgaactggaattcacaaggtctgagagatggttttgaccctgttatgactgtgtgaccttggttgagtccctttctctctcaggacctataaaatgcagagtttgggcttgatggtctttaagggtaccttccaactttgataggtttctaaacgatgtcaaggtcaaattctgaatggcctggttcactgtgctagaggatggccctgatcatttggcaagcacaactctttcccaaggcgacattgcccttcttaccattgtagttacatgggccctgctggaatgagtcacatactctagcttcttccagtttcttcccccccttggttaacttggcttggacattttggattctgtctatatgtaatttgattgcattttcctatagataagaaatataggtataatagcaaggagcacctcaccccccactgcttcaaagagagagagagagagagagagacctgatctgtctgccaacttctctttccctgtgggtccctggcctatccactgctacctgatttatgtcctaggggagcagcatagctatggtgaagatttataccaggttttcatcttcaaatgagctactacctctgttccttgtgtattcaagtgcttggcactcatagccaagcacttgaattctggaattcaaaatgaaaaatagtcccatgagaggcctaaagagaggcaaacaggaagcacttcagagtgtgctgcagccttgtacagtaagtaggatgcagtccccagctctcagtggaggtgtgatatgcccagagagattatatacagtgatccctctccacattagtgccttgtgtaggcatggtacacaatgcattagaattagacaaggcgtaggatttggagacaggaaatattgaatattcccatctcagcgccttcacttattaactgtatgaccttgagcaaatttctctttgagcctctctgacttccctgtaaagtgagaagaatgccgcctacctcacagggttgctgtgaaggcaaaatgaaatacagttagtacagctgagtggctcatgagcttggtcccagcaccctacaactctggatttgaatccagactctaccacttatcatgcaagtccgtctgagcctcagttttctcatttaggcaatgagtatagacttttgttcaggatgaaatgagataattcctatagtgtgtggcatctggcatatagtaagcactcattaaatgttagctaatggtatgattgttattgtttgtcatttaggtaaaatttccaataattctagaaaagatattttgtgtactgtgccagatggtttggcaaacttggtccatattttatatgcttggggaaaaagcactgggtatttttttggtcctggttttgaaactacaggtaagacatgaaactgagactcttccaataaaaggatacctgtttcctcatggaaagcaagtttgcgctcacaatggtgctacaccttcatgtagacagttgtctgcagcccacaaaactgttgaagtggtcatgatatttcaaaagtagcacctccatcgggagcagcagtgttaatccagttatgaatattacacctgccaaacagaaagaatcctttagccacgggtctcaagcacagccctggatgtgtggatttgccacagtgacaaagactactagcaaggtgcatggggacaagaacagcaatggcttaaagcctttttcatggatttttgacaatgaagttaattatccagatgtttcatgtacttgaccccggacactcagatctttggaaacatctggacaatgtgggggtagttttcatatctttcatcaaaaccgttggttgtattaaattcagcaggtttcattaatcacctggtttgtgccctgttaggtattattgatcacaaggaagtcacagttttattgagaaaaattagactaacaggtttgaagtgaccaatgaaaagtaggagagctgggatatgaacatagttccatcaactcctatgcttgtgctcacttcactctagcacatggcctcttttcatttggggctggctgaaaggaagtttcagaccaaatccagtggttcccaccatgccttgacttcagcagcgacctaagctcctttgctgaaagcaggtgacatatatccaaatggaccatttcatgtgtctccattgtctgatccttttagtgacttggtggaatattccctgagaattatcttgatccttattttagcactagccaaatcattacttgttagggagtttttcgttctctgtgttttaaatgtgtaaaaatgtgaatgaagcagttatatcttgtgttggcagcttgccatccttggtctgtgtcagcataaaatattttggattccatagagtagcagccccttgcgaagctgtgtaaaagatacaatgaaaaccttccttctgatttgaaacagtgctgaaatagcatcatttgtggaccttccagacccaacgatctgaaacatggaaatgaaatgggataaaataactcccagtacacatatatatacttaccttgtaaatgaaacttttcggcctttattaacagaaagcaggccctgttatacccagaaaatttctaagagattccttattcgttctttctttcctttaagtcaaaaatactgtatgtatatgatcaaactgaaatgcatcactggaacctaccatacaaatacaggtgcttgcgtttggagaattccaaaacacatatgaaaatcattgtcaagtttcagttgaagaagtcagcctgtacctatgcacattttttttataactcaactagctcccccacatcatgagtggaaaggcttctcagaagggaaaacaagccaggttttattttatggccttcaattttgttttatttcgttttactttgtttgttcaatggcaaaacatccttttcactgctttctgaaagactaaattgtcaaataggtgctgtggtaatgttttcagaaacaatgtatcctgccatagccaaggacaagttatagacaaacccgttttccacggaaacaagaatccttcagtgtctagattgttaattagatcagcactagagggcactcttatgatgccaaaatgggaaatttttactaaaatctgctgggcaggggtgtgagagaggagatgaggagggggcagtttctgtaaggactgcagaccacagacaaacagcttagacaagacatgtgcaactgagaattgactggatcgccaacagataaaacactatttgaaaagggctgtttggcagtgttccctatcagatccacttggtttccaaaatgcagtcggtgctttggcaatacacgatccaggtataaggcattatttctcaaaatgaaagagatataagaagctctgattgttaccatgtgatgtagtaaaagcacatttaggcagaaaacaaaatgtggagagaagcataggagaatgtgtttacaacttaacagctactgagaaagaagaatttcaaatccttggggtcttttatggttgttttccccatcttttgcagcccttgctctgtgaattgttctgaagggttgtgtgattgagtctgggagagcaggtgcttgcttgtctgctgcccctaggcaggctctgatggacacagggtggatgatgtgctgtcaagtaaagggacaaatggacttggttttgtctctggcattgatgtgctctgtgatctgtggcaagtccctgccctctcaaagtctcagggtcagggaagagttgggtgacactagaggtctctaaaagatcactagaagacatatccccgagtttgtgatttatgattgcggaaataacttttgttttgttttggttttagagacagtgttactctgttgcccaagctggagtgcagtgacatgatcatggctcactgcagccttgaactcctgggctcaagccgctcctcctgcctcagcctccagagtagctgggaccacaggcacatgacaacatgcccagctatttttcgtattttttgtagagatggggtgtcactatgttatccaggttggtcttgaactcctgggctcaagagttcctcccaccttggcttcccaaagtgttgggaatacagacatgagccactgtgttctgccagaacttcccatatcagtcatttatagcagccacttgagttctgaatcgaacaagatatggtaggcaccctggggtagaaggtgactctatgctgtcagtaggatggtaccgaaatgatttgccagcacagaggggcttatttgcctgtattagtcattgctttaggtttatggctcagtccaaatataacctcagagagtgaccacactaagccgtcagtaggtcccctcaaattcgctcattatgtccaagttaagcctgatccctcacttgtgtgctaggcaccagccagaatctcaggcatgcccatgtgtccttccctgaggagccagtgtggggcaggggctctgggcacttgatgggaagagtggcacactgaagacagacttatctactctgactttggccccagtgtttgctagagaaatgcatgagtgtttttgtttaagtctctgcttgtaagaacccaggctatccttcataggaatgttcctgattgagtcaaattcattataaagtcttagaatgttattggccgggcacggtggcttatgcctgtaatcccaacactttgggaggctgaggcaggtggataacttgaggtcaggagtttgagaccagaccagcctggccaatatggcaaaaccttatctctactaaaaatacaaaaaattagccgggtgtggtggcaggcacctgtagtcccagctactcaggaggctgaggcaggagaatcgcttgatcctgggaggcagaggttgcagtgagctgagatcatgccgctgcacagcctgggcaacagagggagactccctctaaaaaaaaaatgttatcatgaacagggacctttgggaaatcagctagtccaacaccatcactgtagagatagggaaacggggagccatcttcatttgggaatggggttgcctagggtttcacagccagttaatggcagagctggcattggggtatcagttttttatttctattccaggcctctttctgttaccttgtgctatatttttctctctcctgcaatgtccattctagggaataagtgaccaatggctctgaacctaagggtttttgacatagctagaatagctccgtgtttatggattgtgtcatttaaggtagtacaagtggaaagatatgaggacacatccctatcaaaaatatgtcctgtttaaatgtcataggactggagatcaaaccaatataggatcattcctctggatctagaaggctctgaagtcttgagatgctcttgcccaaaagcaaggatcaggttggaatccttgtcagctggcagggaacgaaaggatgggagggtaggtctggaaaccaggtttagtatctcgggggagggcagacactgtgaaaagagcagtcaagacaacctcagggaacttcacagttgtgccaaaggctattccttgggaggttaaaacaaatactcaaagaatacatatttgaaagaatattctgggttccagtattctcatgccaaacataaggagctccctctcatgaggtatgcatgatttccagtggacttggcatggaacaaggaggaattaagagcggtcaaacagtagaacacagatgcaggggacaaccctctcccatatcagtgatgtggttactttccgcatggcctttaactgcacgtgtctttgagctctgcttttgaaaagctggttcctttcccagggcaacaagatggctcaggtacagggggctgcgagctgtgtggcaggcctgccgcagactcactatgcctctagacaattctctgattggtcttcctccctaggtgacagtaataatgcctaaaacgtattgtatgatgactgtggacctgacattctgctacatgatttacaggcatgatcacatctaatcctcccaagtactttaggaactacccttctagactgaaacacatgggcctacctacccatgtcgtttgctgttggtttctcctctgatagggctgtcttttcttctgattggtcagttccgataccatatctgttgttaaagatggtgatcatcaccagtgtaggcattatacttgtccccactttgttttttgctgttttttttgttttgttttgctttgttgagacagagtctcaccctgtcacctaggctgcagtgcagtggcataatctcggcttactgcaacctcctcctcccgggttcaagtgattctcctgcctcagcctcctttgtagctgggaatacaggcgcctgccaccacgccaggctaatttttgtatttttagtagagacgaggtttctccatgttggccaggctgatctcgaactcctgacctcaggtgatccatctgctccgcctcccaaagtgctgggattacaggcgtgagctaccatgccccaccttgtccccattttctaggtgaggaaatcagggctgagagattaagttgccttttcagtgtcatgcagttggtaagtgaaagagctttaggaccagattccagtctgtgtgactaatggacttatttcatggtcccacaccacctctcaggactgtgcataagcaaaaggctgaggtcaagcattttaacactttgcaagtaaaaaagaccagcagcttgttttgcatagggccttaagaaacacccaggccctttgcctggctcctccattcacctccaccagtttgagcaacagtccttagcctgggactttgggggcaccacacccctttccatttagggaaataaaatttagcatgtattaacataaggcattttttgctaggatatactactgtatttggccttcagagatcaaatgaggaaggtggcttgagatacaaaaggaagtggtgggtttctgagcagcaatagagtaggtgaagaccagaatgatggtggaagggcattctacatgggagaacgtggaaattctaaaacacgtcagctcttggtgtggcagttaaagggagggtgagcacaccagttcagtgtcagaaagcagagaggttgaatggaccatttgcttggcagctctggaacagtggtaggcagttatttatcatagagtgtactatctgctgcagatttgcaatctgacccaaacagtgttggtgtgggtttcttaacaacttccttctctctagctgttatatggaagtgtgtggctgtggaggtctctgctgttgaacagccatcaccaatatcccaggctcctggcagatgaagaacctgcatgaacagaaagagaaatgtggagggtggtggcggtgcaagagggtcaattgttcatcaattcgatttttcttgtttttctcaattaagtttccttctataatttttccatcataaagaatctgccactctatgtttcaaattaacaaagctgtttctctggacagaatgatgttcagctgcatttaaatttggccattatgattttggacatactctcatttactcataaactcttcgaaggctgtgctctgggctctgtgaactactaatagcatgttgtactgagaaaatgactagggattggtatacttctaagtaacatcaagggaaagctattagagaatgaaagaatattggaactgggggaattttagaaaccatcttgtcaagctcgttcatgtcatacagcccactgggagagtggagaagagaatttgcccaagatcaaatgagtcattggtaaaacctggattaaaaaccagggatcctgattctcagtcaagggctcttggatttttacctcatcctgggttttccaagtcttaatttggatccttcatacaaaagtgaatcgtttcactttcatttctcaagccctaagcacccaccctgagaatgtaaatgccaagcataagtgtcatggtctgaggttcctgattaggatgaatccacatctggagcttttggattcccaagtctcccgctattcccattactccagtgctatatatgtgttctcttcattttcatcttttgccttccctgcttattggatgcttagtcagttgcctaagtaccatttgagtgacatttagtcacatcttctggaacctggctcagaggaaggttattcctatggctttttctccagccagtgtctgggtcatgggcatggtaaccacagctccttttgtccttccagtgctgctgctttcccaggatgtggcttgctgagggctgatgaatcccatcttagagtgtcagccaggccagctgttaaagaacatgacagcaacaaatgagaaagactctgttgggatgtgggactacagtattatgaaactgccacttagaggcttcctgtttttacagtatttcaaggtgcaagcaagtggcattctctgggcagcaaatggcccagctgaaaagaaacctgatttacagcctgttgggagggctttccacaaggagaaattatgaatttgtaacgtcccttccaatccaaaagagaattctttctaatgcaaatgtttaatctgatgccatcgagtatgttctccatacataaacaaaggcataaataaaacagggagaaactctttcctagaattgataatatacagtatatttctgtagaactcttttccaagcagatggcctaaaaatattccacaagattgtaaactctgtagagtcagggatttttgtctgttttattcactactcagtacctctaacctcagtacctctaacaatggctagcacataatagataataaatattttttaataaaacatcatgattaaagggcctttttaaaggatttcattaaacaaccttcccaaagagagtgtgtgtgtgtatgcataaaatgggttcttaaaattaattcattctcttctaattagtatgtatcttttgttttaccttttccctatgaactttggctcacttctgatgactggccacccttttgattgatgcacctgtaacgtcttcatggatcgtcactcaatactccacctcttcccacctgggctcccaggtaaggcaatgagcttccaaaagtcttctcagtgcaatcaccaggcaaattttataaggcagtcaagaagtttacctagaaataaaaaaactcaagagacaataatagtgattaaagttaaatttgatcccgttcccatataaatcaattatttatacacttaacatcatttgagaatttctgttagtacagtgaaataaaaattatggctttggaaactgctgcatacttaactttggaattttctgatcctaggaatcaatatatggctttatgttttccttctaaaaatattttcttgtgtgtgtgtgtgtgtgtgtgtgtgtgttttgtcttttcacccaaagttgtgttgtttttgttcacaaggccaaattttgtggaagggatcatagcctctcttcactgtgtagggactctaaatcatggggtaggtcagtacattgtagattacttatttcttgcggctggagtagaagacgagcacattgggctctggatggtaagtccactaataggagtgtcttgtctaacagatttgatgttaggcctcaccaagtatatcgcttttgtttctcatgacatttgcttccccagcagtcttaacagctcagaaacagggaaagggggcttaaccgcaccagagactgataataaaagagccatgtattgcttctcaaatgatgattcaaaggctctgctgctagccatgctattaaaaaaggctctcttaactcacttctaaggcctgcaaagcgtatttgctgtaaagaaacatttctcccaagaaaatgcacaggctatatagcccacttcgggcataaaagaagtgttgctacattgtaaaattccttgttctggcataataaaaaacaaaaggctaactgagcccatttgaaccctcaaattagcaactgacctgtgtataacttcacagtctccgcctgctaataatatcagtaattcacacagtggaatgagtgttttgtgacccttaagacatacattataaaaacagctgagcatgttttttgaatggggagacattgcttactttgatggatgtcttgtgtttgggtggaagggactagagagatgatttatatatcaccttatgtgtgctttgaattttcatctttttaaagagcatcagtaaagtttaattgttctttattttccttttgttatttgtgtttcgtatattcctgataatatgaaaaatccctgccaattcctcctaggacctttcaatcagtcatttccatttcagtgatgccacagggttgggtttggtttgggttttgttttattggcttttgtttttttacctagattcccattgctctctgtgaaggggaatggaattagcatgagtgagtggtagatccatcattcccagaccacagcactccagggatctggctctcagtgcagccttgccccttttagccttctgattgggaatctccccattacttgagaggagccagtggggaacaaagtggagaagccatctatgagctgtttccctaaggtttgggaagctggagaaatatgctcttaaagcacaatggaaaacttttattattttatctcctctcctaccaagctcttgctagcgactggttttactgttcctttaacaggtggaggatttttcagattctagatgcagcaaggtaagtaacaatgtatttttagtttgactgaacccaagtaagctagaaaaaagagactctgcagttgcctgtccgtttaatttcagtacaacaaatagttaagtttttggcttggacaaattctttccagggctttttttttttttttttttttttttttttagtttaaaacagctgaaactacccaggcttggagtctcagttctgaaggctgacttagttcagaagggggatgaatgttcagggcgaccaccccagacaggtgtgcagtaggtcattagctctttttcctctttttgctgaaataggatgacacagtagagtgtgttgttgagaagaccccaaccgttggcaaagtgttctttacagtgcttcaggcacgtctgcctgtccctaggctggattgtgatttagagaacaagtaggtcagcatttccttgaagggaaatcaattatttgaaaatatcagggcttttaacgtatgtaaatacgtagacttgcatatttacaagtaatcccataggccagaggcctttttgacatgaagcctgcaggagagcaaatctaatcaaatacaagaaagttcctctctgtggggaagacggacgctgagaatgctcccagatgatgcccctgcaggcaacaactgttgctaagagctgtaccatcatattgccaccagaaccggagagtctagcaagaaccataagtcattttggaaatgtgtgctctagtcgcttggcacattgttttctaaggtcatgatgctcaccagtactgtctttggctttttgtaggcttattggctccagaaatatttactagtgcctctgttttttcttaatacccacctacaatccaccctgtgctccctggccaaataggttagcaagagcaaagactgtagctctggcatttctccacaaggacagactcccattaaaatagactacttgagccattttggggatgcccagtttagctttctgtagctgggcttccatactcccattagagcctcaatggatttacttgacagctgagaatagtaaatttagtgtttaattttgtagtcagattataatttattgagctaaatggcacagacacacatagacacctaatcacacagtattagtatgggagaacatttaaatatcatagattgggtgtgtcatggaggcaaagtaccaagttctgttactaatgaggtgacttttgtcaagcactagctccactctgagccttaatttcctcgcctgtaaaataaaatggagcggatgaccattaagacaatggtcaataacataggtaccactatccctataatagcttttatggggaagtcttgagaattttgttttctttttgctttaaaattgctagatgataggaccatctctttaaaacagttttgctgtataacaaagcaaatcctgacacactctttatttttactatggtgttgattagttggaccagattattgccagagcaactaatacctggtcttaatgagagaaaacaagaggagtacagatggtgagatgggaaagaaacggttttggtaaatatcaatggggccctttttgaattttggtgagctgaatgatgtatgaaaactatttgcaaggctagcatatttttcaaccactagtaaagcaataaaacaaataacatttttggtaatccccattgtatatgcagtttcataaatatacaagattatgattatcgctgcctcataattaacaatttgcataagtacttgctattttttagttgtctgaatagatttttgtaatccagagaaagaagggaacaatcagtggaagccatcccaaatgcctagtattattgctacacacttgcacaattaacagcgatactaattgcttcagaccagaacctcatttgtttttctaaggacagcaaaaacattaatagccagagtgcctgtcaatctctctctctttttcctatagccaactgtatcatagggtctgcagttgactgtaagcaaattattttgttggattttcagtgtatcatcttgtaatggagtttccaagtttcagttagcaatcaatgccttgaacagccagacttatttttataatattttaacaatagacctctataaagttaatgaataaaaggatgctgacatgccaatcagttctgctgctgcatttacattctactacatatttcatatctttaaaattattggcattagacctgcatataagaatcatagaaagtccaggctggaggggagctttaagatcatcccgtcacactccctcctttttcagatgagtatgattgtcagtaatttgaatcttgataacaaccaccaaatcaatgatgccacacttttttttttttgtacctttcaaacgttgggaactattatagtaagtttgaatgataactggttgtttgggaatcatatagtttcaacttattttcaaaacaactgaatcagaattttaaaaatatgccctcataaggcttacctaaacatagccataatgttgatggtatatgtgtgaaaggagatgttctatgcaaatcacctggcaatgagacactcaaccaatatcagctctctttccttcatgcatagattacctaattaacattactatagtggaaacattacatcagtgactgacagtctaggcgtttagagtcaaactgacctcgggtccaatcctggcgctgctactttccagctgtgtgacgttgggtaatttagttcatctctgttggcttcaggtagttttcttatatgtgaaatgtagccagtatataggcttgttttgaggattaaaatgagatcgtgcatatcaagtgcttagcactgttcctgtcacatagtaaacagtcgataatggtggttattaccatcgttttttggcatacccagcggcagcctcactcaatagtatatttaatcttacagtgatttggggtacttacacatacacctgtacacatgcatatttgggcacacaagttcataagatttgcatcagaaagactgctttcccaaaggttacctgtgaccaccatgtttcacaattcaatggcctcttccctggcctcagtcttcttgacctctttggagattctggcacttttgcacatattctcttgcttgaaagggttcataatctatcttgatgtcttctctacattccttaggtttcctttgttgggatctcttttccacacgtacacacacacacacacacacacacacacgcgtgcccacatcttctccctcccccactgcccctttaaatagagcaattcccaaggtcctgtcattgatctgcttctcttctgttgctatattttctccctgggtaacttcacctcctcacatagcttcacctttaacctctacactaatgattcccaaattgacctctccaacccttaattcattccggagccccaggctaactccaatttccaattgcctgctgagaatctccagggcaggatgtcctaggagactgaaagcgtagtctggcttttgtcatccttctcaggaatgcagatggaggaatctagcttcagaagtattaagggttgaaaacaaggcacaagtatggagcattagtctgagcagaagtaacagtggtctaagttagcaaagtgcttcaaactgagctttccaggggaggcataacagataaactgtgaatttctgttattatgcactggagatgtcaattggcagttggaactttaaaaggtttatattttctagggataagggaacagcttcctaagatgaaaattgagttcagtttttaggtgctggaagattggcatgtttggaagaagtgttaattaaaatcatctttcttttcttttctttttttttgagacgagtttttttcgctcttgttacccagactggagttcaatggcgcgatctcagttcactgcaacctccgcctcctgggttcaagcaattctcctgcctcagcctcccaagtagctgggatttcaggcatgtgccaccacacctggctaattttgtatttttagtagagacagagtttcactatgttggtcaggctggtcttggactcctgacctcaggtgatccacccaccttggcctcccaaagtactgggattaccggcgtgagccaccatgcctggccaaaatcgtctttctttggacacttattatcattaatcttgtttcagtgttttgtttaagaaacgcacgtgccaaggggaaagatgatgtactgaacttgaatgatgagcaggtgggaattttgtgagagcaaatgtgtgtgtagacacatacacatatgctgggtcaggtgtgcctgagattttgaatgtgtgcaaataattctatcagtgatagatttttttctttcattcattctgcagatatttacagaacatgccaagctctctgtggagcaacacagctgtgaatatagaacatatagggtctctgtccttaagtgtctaatacatttttttttgttatatgcaggtacattgacaatttaatttagtttagaaatatctgcaacatgtcacaaattgttcaatggccataatcttgctgacaatcttaatgaccaaagaggaacttaagggaaataagacagtgttaaagtgggaaaggaatgtacataaatctgaattagaaattgattacttcctttaaatttagtaaatattgaattgctttggggttttacatttcaagttggcttgccagtgttccaggccagggtaagaatgattatgtctaaccctaaaacttaattagagtaaaggaatagacaactcctggttaatgtgtgtactattgtcaggagaattagttgtaaatgagttatttctacagaaactgcaggctcagggctgatatctttagcacagaggacaatatccctttttgcagaagaatggtcccattctctaccttctcaaaatgcagtacagtcactcctgtttgagctactaccatatggcatatttgaagaccattttgtcctccaagtgggaatcatctacttgtgagttccttgacttcatggttgcatgccattctccccttcagaaatttggcatgggcctttgtctgtaagtctcaattccaagtgttcttggtcccagctgtcagtttcaaagtccccttcatggtccctctcaggtcccaaggatccctcattgcatcagtaaacctagagatctacttggatgcccagagctcctgtcagagctatgtagatggcagccaccctctgttccactatgctagcttctccttcagatctctcacggcacaaaacctctcattataatgatgtgcacattggccagtgcttctatttcctttgccttgcgtgagttagagacattctgttattctcactggaggtaagaatgattaaaaacatccttgaatttagagtctcaaatgcctttattctcatggttttcatcaatcataatataacttctctttcctttcttagatttattcattcaatatgtatctattgagcacttattatgatccaggcactgttctagacatgggggacaatacgacagacaaggtcccttctcttgtgtttcttaaagtgtgtgtgtgtgtgtgtgttggagggaaattgaaaacaaagtacacaagtaaatgaacaagattatcatagggagtggtaagtgccatgaagaaatcaaacacattggacagagaatggtcagacagttggagagtgatcagagaaggcctccctaaggaggtgaattttgctctttgcttttgttgattttgtacagacttcagttacactttgggtcctttggtttcctccatttcatgatatcctggactcggtatgcattctcattttgttgcttcttgccactgtactattaggacaacctcccttcagctagtcctgaagagtaaactaatgtagcctcctgtcaaatatgtgttccacacttttcttgtcgtagtcagtattagaattcagcatgttcacgctcttccctgttatagaatataaatggatgctaatcctttaaggatattttacttgattactcagtgcatttttgttactcaaggcaaactacctattgaaagaaaaacgcaagcattaagagttagtaagcatttggctttgcctatttctgtaaagggaaaagctattgttaaaattagtgttcaaagttaaatagatgatcctggaggttctctttagttcgaaagtagtacaattagttgttttcagagacggagccaaaatctcttttcaatatgctgtttaattttgtaaagtggatatgcaggaacattttccagtgtatcagaagtgcttagattaagcatacattttccgacaaaagctagctttacaattcttgtaaatgtcacaggaacttaaaacattgtgtcttgttttaacctctgccagctagagcagcaattcagcacagcagattcaattgtcagtttcttaaatgtgaatatctgaaagttcattgtcttttcagcttgaccacagggaatcttcaaaaaactaaaaagccaaacaccactaaaatgtttggtggtttcaaaatgctatggcataggtgttgcttgctagtgagttaggtgccaagaaaagcatgttaactcttagaaggccattcggattcttccagccatcattttgttgtcttcctcagcacctagttaaagccccaggtaggaactgaggtaggagttagaaagtttgccttccctaactcctctcacacctcccgtcctgtcccattgagctctgtgggagaagatggggaagcaggtggggtgggtttggagaaggtgcaccagaatgttgccaatatcccaagtacccttgcatctcccttctttaaaacttctgtgtcgtcacttactattccacttatcactcagatacttggctgtgttctaaatacaacaatcaactccatgactagattttgggaaagcagttttttaaaaatccagagaaaagctgagcatgattctgtggtaaaggaatcttcaggagaagaggaaccaagagagtttggaaactcctagaaatgcaactctgatttacagtcacagagattcttgacatagaaaaggagtggggtatagagaaagaagtgaggaaggcacacagcacagtgagtccttgtatgattttaattgaaaaggctgttattttctgcaggtgagaaaatagatgcacatcaaggcaatgacttatctaagtacgtgcagctaattagtggcagatgcaagagaagaacacaagtcaactgaatcctatccagtatcttgattggtaattaactaaactcgctgaatttttggcttgcttttgccgtttaattcttagcgctacgtttgttgccagcacttttaattcattatgctcaaaggactttatcaacaaaggtggacaaaatcccttagaaacaggtaaaaggaattttgttttggaggggttggggccagctgacagatagtacaggatcgcatagaggtgagagtggttggattggaaataaagcctaaaactcaagatttagcttaaaataaaatgaagaaagagaggattgcggctatagactggggatccatatttaaaggtacacatcatctctttaatgctcattcttaatgacagctgtagcccattctccatctgaagattgaaatgtcttttgtttagggttctcagtactttgagtctctttccaggcatatttgtggccttctccttgtctttctgtttttctattctgtatggtttttcatctctaatgttttccattagtttggtctcacggtcttgaccagggcactcatggcacaaccatatatatatatatatatatgatcttatgtgcacataaaatggagaacactatttaacaagttagaaactattagattatttctgttcctctttcggaactgaaagatttcctcttgacaaatggctcttctccaaaatcttaaaattgcacctcagaaaaaaatgacggtcactgtgctaccatgaagcttcctgtcccttcactttcattggcttactattcaatgagctccattgattttccagacctccattgattttctcaaccttgcctcatcagccagacactagaattacaagggagcttcatcaatatcttgtgtggtttcaaaacttttccacttttctaatttgggcaatgggtatggtacaaaccatccgtaaacggcatttggtggtgcattggtctttcttctcatggcttctacaattctaacttgatttctgctcaccacagggcacagtttgccttctcttccctgggagctcttgttcatttgtcaggagacctaaaagaaggctactatgtacagtggtggaatgtcagagtcatcctaaactggcataaataggtctttaatggcctttactgattgtttctatattgacatataaatccacatgaggctgtgtgaggagactgtgcatagtctttctcccgttttttcatatgaattgatttgacaatgtcatagatgatgcatgagacaaagtaaagtgtttcttaagctcactgctgcttgtttgcatgaaaaggaataaaagctacagggaagaaatggacattgtgtgatgctttaggcaggagccattttctgactcacaccttttagaccataatccactttctgaacctgtgcaggggaaagtggtcactgtgatattcttttgctggaaaacctcctaattaatagaggttttctgaaattcataagagatgaaatacagagtctcaaaaaacgaattagttgtaattataaatgcttgcatcttatatgagaaaatgaaatgggataagagctttttgaggaagagtctctgaaaataacacaatgttttattgttgaagagccatgtgatttaatactcagtgatcatgaaatcacatgtaaagcaatccaccaggagagtccagaaagcctcatttattcctctctatatgagcagattcagtgtctcctttacaatgctatcaaaatatgtataaataaaacaacactcttggggctgattttaaatttaacccacagtaactgtaatttaacatgagtacctgaatatttccctatttggagtcaaagtgggataactggggtaggggttggggagaggcccctagctttctgtcctacaacaatctcaagcacaggatctctgatttccccttctcatgcaggaggtattttatgtcttggcaatgggtacttttgttcactaattttcatggcctacaatcataggtcaattggctctgggtcattctggggctgagggaaaacaggtagtgtccttcaatagatttggagaaactggagggggcctcttaacttggtgattttccagtaatgtgattgaaaatgtactactacattaattaattcagtcattacagatacacttattgagcacctaccataattcagcacgattcttaatgctagagatatgacaattgaataagacaaatatagttccttctctcagggagcttatattctggtggcagatatagataatttggaggaagcaagtcaacaaaatgtgtccatattgtgatgaatgttatgaaagaattaagtggagtgctagataggggatatgtagcctttggaataacctcattgtggggcaaacttatcctttgtggatggatttgatttttggaaacatcaaaaatgatatggggccaggtcttataaatatataatggaagatcaaattgattgataaaagttttgcccccaaatgagggtatatatgtaattactgtaatatttttgagtgtcagtaaaaatatatactacactaactagtgataagcacgcccatgtttttaaaggcagtgaaagggctccagcaatgggtgttatcctttggcaagcatttaggcatctatagctaccaacagcactgtctccagttctctgcctctcctcaattctggtcaacccttgtcatcattggcaaatgtactttagctgttatattggtacataaaataaacattcagagacattccaaactatgtagtacagcagtaacatgtgaaatttgattctgtcacaattataatttagttctctcatttcattagtccaaataaagtggagtttcatttatgctattttgtatcaaataaatctgtagaatgctaatacaccacttcgatgagatacaatcaatttgagtctaggaaaggcaagaatgttataagctagaatgtcaagatgaagatgaacagacaaaggaagccatgataggagaattgaggaccccttgtgtgctccttcttgtactaacttaagtgatatctaccatgtccgtttagtgatcgttctagacatgtccccattaaaggatatctaatagagatggttttgtaaaatgagaagaagccaatgatagccatttaattacatctttagtgtgacgttagctccctgtcttgagaagcattgatattctccatgggtgtttacttgagcaactactctgccaggcactgggagtacagaggtgaattagagagagatcctgtctttatggagctcacattgaatttgggagatagaactaaccgttgtggtagaatatggttcatactaatatgtataaacgtagatacttggtacttcaaggagtctgctctaggttgagtcgttgggtcagaaactactaagggaactattctatggtttgctaaagctagtgatggggcaggtatgttcatttcttcacctcatataaatatctttggactcttggcatgattcacatgcatacactttcaatctatctgccagttttaaaggcaggtataatggtgaggtctagtttcaaaataagtagcttttataggtaatattctgtggtttcttcttgaatgtagaaccagaccgattcagaataactctcatgtgacctgttgtgaagagccggccttaatttttctttctctttttttctttttgcaacaccagctccatttctagtagcaaatctgagccaaaagcacagattcattgactgtttgcataagacactaaatagacactgaacagaggattaatgtagccctgtcttctgggagcttatagtctaaaacagacaacaaactggaaagaatatccaacacacctgatatgctcatttcccttctcatataaatccaaagaaaacagaaagtggcaagtcacattctacaggattgggaaaatcccctagagagtattttctttttgtgacttttcaagttaaaaggtattttgtatatgacatgtaatagattacagtgttatttgatgaaaatgcaagcaatgttcttcctttcttttttactatcaacaagttacattggaaggtgtggatcaaattaaaagtgaattcttgatttgccatggggaaatatgtgcagtattttaaatactctaaggtaagggtcaacttgtgggaagaagaggtatcataaaaattaatttaagaaactagccttgagatatttcctaataatcccacagggaaagcaacatctgtgtcataataaaggcgcttagtgtgacctttttgcaaaagggaatattaccgaaacatgaccaaagtttggagctgaggtactgcagtaaaataatgggagtctactaaatatttataaggatgtattcatttgtaagaaagtagtgaaacagtagaacatctgccaaaccaaggttaatttcccaaagctcatgtgtttgtgagagacacagagacaggcacaggaatagaaatgcagagataaagagacacagagagagaaagtagcaagaggctgagccagaggtggacagagaccaagaactgaaaatcagccaccctattgattaccttccaactctgtcatgaaatttactgagagaccttggtcaggtcactgctctctgggccttggtttcttcatgtgtaagatgaagggatggactagaatatgactctatagaacttaccaactccctggttctactcttagctgcaaggtaaatgaaaaggcaggcaggtgggtaggtaaagatatacacgggcaggcatggagacagacagactggccacatacatgcatacacaagtttcacaaaaatagaacaaagcccaaatcatggtagaccagtgaactgtgaatcacagagagcagcagccagatccacaaaatcgtctcatcgcttttgatactgccatggtgaaaacttggcagatttccttttacctagcacttgcccagcttcctggaggccagcattcagaccttttctgactggcttggccgaccctttcctccaccgactcagaggattagttatgtcaggatctgcaaatgacctctgatgcccaaatggaagaactcagcctactcttctaactcttaacacttgaggatgaaaaaactcacataacctaccatgcatattcttgtccaactttctgtctggatatctgtctggttgtaatgttctatggataattttaagcacgctgtgttcaccaggctttcaaaggtaaccacttttaaacttttgtgagtcttgtttgcaggggcatggaaatgaagagaataattagtacttgtcgagctcccagccagcgaatgactttagtaaggtgctaacaatgcactcaagtgagtgcagcaaaatgatgaggacttacagatggattttagtatctggtttatttcacttccattggtttttgcaagatgtaatatagtgtgatttttcttactttgactgcttataatttatcagccttccccaaaataatacccccatagtttaatctgagggcacatgagctgatagtaggtacccctttgggaaaatctgattaagcatttgtttctcaagaaactcctttggtatctgggacaccattttgaatacatctagagcttcacattttgatgctagtacattttataagaatctatgaaaagcaactccatcaaaattgtgtttccttagagaaagatagtgcattaggataacaatctgtattgcacccattaccatagtactttcttaagaggtttttgccatcactggaagccttactcttccaggacaagtgagccctgagaacacaggctagggtgggcatgatgtgtgaggatgaagaagccaggctggctgcagtcaagcttgctcttataccaagtggcggatgggtttggttgagtcattgtagctagcgagagaggatgctgaaagacacaagagaggcttggcttccacatatatctccagcgccacctcgtccctggggtccagactcctgcaactctcacaccactcctgtctctactgggaggtttagttgggatctcaaacttcacctgcccccagacaaactcctgacatttccccagaacgtggtcctctcccaatcttccccgcctcagtgagtggcatctctgtccttaccagttgctcaggggaaaatcttcaaggtatcttttgcatatctttttctcccccaggccatgtctaatccactagcaaattctgtctacttcacctgcataatatatctggaatttgaccgcctctcgccaccatcagctctgtcatcctagtccaagccgccatcatttcttacatgggcttctgtaaaagcctactagctggctcccctgcttcctttattggacccctacagtcttgtctaaccacagtgataacccttttaaaatgttaattgagatgttgtcattcctcttttcccagcccagcagtggctctccatctccttcaacaaccaaccctgcaaggttcctgcaagctccatctctgactttatattttattaccctgcctcaggcccatttttctctaatcacactggtctccttgctttaccttaaatataccaggcctcttgctgcctcagggcctttgtatttgctcctctttctacctggaatgctcttcccctagatatctgcagggctgggtccttatgttcattccagtctttcttgaaatgtcataggaataggattgccaaggagtccaattcttaaaaagaggtcactggtcttggccagcaggaagtcactgatgactttttagagggcagctgcagtcaagtggtagaagaggagccacattgtttttgaatcatctgtatcccttaccaggctgtgcaccgctcgagtctggtgctgttgtctcattcatttttgtctgtctagtaccctccacagtgcctggcaccagtaggcactcagtgtttgtgggatgagggcacgagtcttattttcaaacaattggttatgttaaaacacgttaaattgctgaatgtttgtgattgctttctcagtttttctcagggaatatgtttgaaaaacaaaatctgtgcatttattgtagacccattccctgagtattgacgggtgacatggtgctgtacatgtgatttagaggttttcagtgcacacaggttgtgggggaggctgagaccatcctcagtgtcttagggagataagaaagttcaatctctgcttgtgtatttactagctcacttcccttttaaaatcccctttctagactggaagggctatttaaattcaaaagctatccttgggttcaagcaaaatcttaatgactttagggacagatatttaacaggtggtttagatagttaacactcggctggtggtgaaaaaccacattgaaccacattgaacatggggttccctaataattttaactgagctcaaccttcatctcctttatcgcctctcctttatttaactatctactggagttcaaaacaccactgtaggaatggcttttcttcttgtatcttgccccccttccaggctctgccctctgagatctttccctagacaccagttagagaaggttggccttccctgaaactctttattcctagatccttttgacaccactagtaaatcctgctttctttgctgtctgagaattttatgaaggtcacttctgcagcatcggcctctacaccaatggctaggaagccgtggcaggactctgatcccatttctagtattgctcttaaaccagctctgcctgcaaatgtcagagttttagacctcaagccctctatctcctgaaagtaattgtgacttgtagcctatcacctgggtcagtccacagggtctgctctgcctgtcctgatatctaccatattcgtcatatgagacatttacctatgtgggagggaaaatggtatcacgagtgtggccaagaataggtagctatttctaccgggagtggaggaggtcatttcatacccctacaaaagaggatttttctgttaccccctctgctataaatcaaatacacacttaacagttatatgccatccaggctcattcaacaaacatttgccgagaaccacacagcctgggtgtaaaggagttgggggaaatagggacatgagacatggtccatatgccctcaaaaagcctgcaatccacagaaggtggaaatagtgagaaaggtacagacagagcctatgaatcagtgcaatataatcaggtctgagcaaagtggagccaagaggaagcaatttgttgttgcctgaggctgtagagaagactattcaacaggaaaggcagatgtgggttttcaaagagaagcaggattttgtggagaggagaagatggggaagtgctatcctgttagagaaagtggctttgtaaaggcccagaggcaaggaccagcatggaggatctgggaagggttgtggtgtggcatttagaaaatatgtaaggccaggttccatctcggagggtattgaaagccatgctgagacatagacctgattaagtaggcaataaggagctgcgtacggttgtcaagcaggggaaggagaaaacagctgtttcttccaaagataatagtagcttaactgtggagcaaagaagggagcgggttggcgctgtgatggataaataccatactctcaccatcactgcactgaccacactgagcaaacaactctcagtgtgaaagcggggaagtgatagtcctaagggctgtgtcacccgggcggaagaactgcagttgcatcacttgtcctgatcattgttaaactgagcgtgggctgggagctccttgttcctaggcaaaagtcctcagtaggagactgtaatcatgcctaaaattacttcattattggaaccagtgtttgatctgtgattaagagctggatgaagaaatcaagtaatcagccattgaaattgtaaccataaattgttctataaacaactaacttcccctgtctcccggactccaagcaacaaacttgaaaacagatacttttcctgttgtttcttcacccgatgggttttagccagtgcttttgagccttgcagaagtcagagggtaacacctgccagccacagtgcccctttgtccctcacatatggatcactcatgatgttgtaccttgtcagactaagacaagatacccaaggagtgtggagctgttaaaaatatgcaacttattaagatttgtctagtgagggtaaagagatttatttttaacagaactggggagaaactgcctggatttcaagataaagaatagagaaagccctcagcggttgttgccttttcaatgatgtgttagaagtagcttttgtcctgaagggttttattttgcccaaagcattcaaatactacagcccatagagacatttctgtaaaacaacattagggcttattgactttttcttgtttggggttgcgctgtgcttaaccttccagatatgtaataaatagtaacaaattttaagaaagatctaaactttgttttggggaagaccatggcagcaaccaggcaatcttgacacatgaagtaactgactgtggaaccacaacctgctttgctcctataatgcctagggacaaccagacaagagcggttaagggagttatttcatgtgatcatttttctgacgttaagaggtagcacctagtagttgctcagcaaggttcattttcctcctctgttgtcatttacagcccaaacccttagagatcataacatggaagagcccttaagggtctgcccaaacctttccattttgcaagataagtaggaaggctcacagaagttaatgacttaccctttgtcctcgactggtccttagcagaagcagagctagaatcgggtctacaatccagctgctttgccttcttcgatgggagcagtacttcatctgtctcttgggaataactccagtagcccagtgaaaacattgcctctttcacaaaaattcactttcacaagttagcatccttggcacttggcataataatgcgaccaacgataacatagataccactttatagtctgcatagtgcttttcaccataacatcttgtgttgaactcccattgttatccatggctctactggtggcattttaaaggacagtgtgttgtagactgggatcccttacccaaagaggagtttgaactccttttttaaaaagagggctgagaaaggtttcactttatgttcctgtaatttcttaaaggatttatagataaaaacattaaaatattctgggtgtaaaataaaattgtctcagaatgggaatagacttaaggtacagtgaggagatataggagacaaatcaatggaagatttaaagtcaggaataaatgctgataatggatttctagatacttctcttgaattccaaaaacacgaaaaataaactgttgttactggggtggagacaaaacagaagaagataaagagaacaggctaaggagaaaggaagaggttaagggagaaacctctgtatgaggaacaaaccaaagttgactcttttttcaaaattcctacattctctgggataaacagctaatgtttgaacataaaacagctgaatctcccagagcttcaactactttctgttttggaagttagtactttgggaaattgaagactctttccatttcctagggaagttgccaatttagggttttacatcagaggttggcaaattatgtccccaggccaaatccagtccattacatgtttgtttgtttgtttttggtatggccagtaagctaataatagtttttatattctcaaacaggtgaaaaaattaagaacaatgttttgtgacatttgaaaaatatatgcaattcgcatttcaatgtctgtaaataaagttttgttggaacacagccatgcattcatttacatgttgtgtatgactgcttttgtactgtaacagcagagtctgcaactctgaaaagatttactatctggccatttacataaagagtttgtcaaccgttgctttaagccaatcttttggtttccctgggtcacattggaagaaggataattgtcttgggctacacataaaacacacgaacacaaatgattgctgataagcttaaaaaaaaaagcgaaaaaaatctcataatgttttaagaaagcttacgaatttgtgttgggctgcattcaaagccattctgggctgcatgcagcctgcaggctgcggtttgtacaagcttgcttcaaactgaagtatcttcatgatctgaaagtgttaaataactttctctagagcccagctcttaaccagaggggagtttagacattgggataatctggttcaatataacttaattcaatgacttgtacttagaatcaagttacaaaagtggaatattatgcttcctgtctaactataaattgtattccatagaggtacgtcaaatatttcaattttctaaaatgtaatattaagcttcccagtaattcaaaatgagattaaggggaattttttttcatttgctctttgtaacaaccagcttcatataaccagcagcaaacaatggggtccccagactgtttgaggacacttttgtatcgattagctgtagttaaagcctgaatggttaagtcagcaatttgacttaaaaaaatgctgtagattctaatttataatacctctacagcaacagacttcctatcaggcagattgtggagacaagcagttgtttgtaccgatttctggctaattacttatctatttgatatggcatctcccaccaaaatgccataccaagctgtgctttccaagggcatttttgaataatgggattcaaacaggaatttaaatgttcacccgaaccttctctctcgatctgtgcactaggatgaaggagggttgattccagcttgggacagatgaccaggaggtatgggacagatgaccaggaggtaaatgaaggggttgaggatcagtattggaaggtcaggaaggacacattttacaagttgggacattcaacctatgaatcatttcttatgcagtttcaagatatattttgcattgattagctgtctttgaagcccatacagttaaggcagttttctgccttctgcctcttcactgagcacctgtattagctagagcttagatctaagaattctgtgacttgctgaaatttattctgctagctaagaggaccaagggcctttaagcttcagatttgcatcactgtctcttcaaactagattactttaatgagtacttgatatggtttggctgtgtccccacccaaatctcatcttgaattgtagtttccataatccccacttgttgtggaagggacctggtgggaggtaatttaatcatgggggtggttaaccccatgctgttctcatgatagggggtgagttctcaggaggtctgatggtttcataaggggcttttcccccttttgctcagcacttctccttgctgccaccatgcaaagaaggatgtgtttgcttccccttccaccatgcttgtaagtttcctgaggcctccccagtcatgctgaactgtgagtcaattgaacctctttcctttataaattacccagtcttgggtatgtctttattagcagcatgagaatggactaatgcagtactgtacttttgtaattttcataattgtttcttacattttgaatcaatagtttcataccattatgaccatatattttcaattacatgttattttggagaccatgtcatttttcatgggttttcatagctctcttacttttggctctgtggagcctaggagaaaggttcctgtcatccccatcccctggcttttctgctctgctaaaatcattataactagcttaaatttatatttcaggaaccttctgtaaaatcacaacagagttatcttctgatgagtctggttgctagactaaagatttgtatgaggattgtcagaaatgttggctgggcatggtggctcacgcctgtaatcccagtactttgggaggccgaggcgggtggatcacctgatgtcaggagttcgagagcagcctggcgaacatgatgaaaccccgtctctactaaaaatacaaaaattagctgggcgtggtggtgggcacctgtaatcccaactactggggaggctgaggcaggagaatcacttgcacctgggaggcagaggttgcagtgagccgagattgcgccattgcactcagcctgggggacaagagcaagactttgtctcaaaaaaaaaacaaatgttgactagtgtcttctgtttgggctggttatagacaacacagcttttgtcatgatttcttgtagggccactggtttaagttccaaatgttgcacctgaatactctagaaactatcgtttagctgataaccttgaataatttccagtcagcccttttttattccaaaggggtgtcacttaagatcaaattcattcagagaagtattgatccgccagctgccactctccattaactctcccctcccccagcggctgaaagagtgcccttcttggggccaataaatgtttatattgcccctaggtacgattgttcctccagcaagagccttcattaagcccagcaacatgataaggtaatgaggcttctgctttaacatagcagaacatatatatccaaatgagcatggttccctggctctccttttttattatcctgccttctcccaggagaaagtagtgcattgaggggaccatcaaaactcctcctcccttccccttctgctgagttccccaagacacctggtctcaactcctattccaaattgcccagagaaagagagatgataagtggacagaagacatacaggcggcatggcaaagaagctcaagactggcaaagaacgaaaagcgctgaatacaatggtcacaacagaggactcatattggtctagaagggatgcagaaagccagactggtgtggactaattatttctttatttcttctaaacattctatgactgagcttgaagggtcaaggaagatggctcattggagtgtcctagaattccatattacaattcagtagttttctttgaaagtatggaacacataatagatatatctttgtatcactagcattttgcccgtagcaggtggtaagtgggttgttattgcaacaacagtagatctgagctgtgaacttatacaataaggcctatactgccataatgagtatagcaccagaatcatcaccacattttaattataaaaaatattattgtactctgccatttcccacttataagcatcatgactctgtgaagtcaggtggcaagcttggattatttttatcctatttttcatttgtgtgaaccaaggcataccaatcacttggggggactggtgtgatggcttagaataagagctccaggttttcagctctgcatgtggcactcttctcaacaatctggatgaaatcaggagctagcatcacacactgttgctatttacaaaagcctaattaatacctctcattccctaatgagatactttttctgactccacagacaagcagagccaagcaagtgatgtcagaatgccagagtgaattattgggcttgtgtcaacccaagcagagatgaaaaatcacccctgtgaacttgctccaggagcaatcaaagggccaaagttttaattagtgagggttgtgatttacatttgcattcagcatcctaagaatctacattagtcttcaagctcctgcacttccctagttgttgtctgacactggttaggatagttaatatgcttttaaataacattatatttaatggacctttgaaagcactgacatatgaatccattttctcacctgtcagcagaactgttttcattaaagaagtcagtgaaagaccacatgctgagaggagctaaaagttggtggcagggaacatttcagcttggtatcttgtcctttcacctatatctactgtgaaaattaatgaacagttatctaggaatactaatattaggattgatttctaatcaaagggaaaatgatgtcaaagcactatagtgaataaaggaatgcaatggatttatttttaacaaacatagcagaactgacataatggaaaagggtgctgatttcttcaacatattcaacatttgcatgttgctgtattggttagtacatttgacagctgtagcatgttctcttgactctgcttggttgagagatatctttgtcctttgagagtggattgaattttgggaatcagtcaaatgtcctgagaaggtaatgatgatgtactaattggatgatcagactgggtcctatggttgggggccagaagtgaggtgtgactacacagtcatgagtgatatttctcatgtggctcataactgtctatgaagatagttcccagggaacagctctggaaatgtgaacgccagcagtatccttggaatctgtatacagcttctctgggtaacaactttgagaggaccagcatgcattgggtacaacacaggccctcgtgcgcttgctaaagatctgcttcaatactttgtcacaccgcctacactggctccacatttgccaagtaactatgagcatggttctccttccaacaatctggatggagctagcatccttcatgagtgtaaatttacaaaagtttaattaatatatcttgcttgctaatgagttattccttttgactccatagacatgcagggccaaatacatgatgtcagaattccctgagtgaattattgagcttgtgacaacctgggtcagaatgaaaaatcaccttagtatatttaatccagaagcaaataaagggccagagaattaattaatatgggttttaatttgttaaggtcttaagagggagcctctgtttgctctggtacctttttgtgtgtgtcctctttgattacaggtgaacatgcctttgggaaaagatatctacttctttactgtgctcctcggtaacctatagacaagaaagaaaaaagtgggttcttagtcttcagagagcatcaaatcattgaatttattgtttaggtgatgagccaatgccctgttcccaggaataggtttcatgaggaattgctaggaggcatagaaaaagaattgcacatagtggaagtagatgatgataaaagaaaacaagtgctagagctggacaacagagcaacaccccatgagtcctgaacaaagaactagaaagaaacccaaggaaaatcagagtgcttctttgcagcctttggctaagtctccctagctcccaaaaggatgtagacagcagataacactgctgatgagagggcaggatccagacaggtgagctgtgctagggaaggggctgccaaggaaagccccaaatgcaatggtacaaggtgatccagtgggagcaatccttcctattgtcccatgagcaggtgctttagggagccactggtccaaggcctgcattcaaattcatgcctcctggtttttcaccatctttccaggatcaggttagatcacagaaaggccgcccatttgccactttagcttagctgttactggcctaccttccaatgtggtatccccagctgctattaaaagaaatggacatgagtaaattttactgaatggaaagtatatcccaattaacttgactttttaaaatgtctctctatatacatacatatatatgtatatacatatatatacatatatgtgtgtgcgtgtatatatatatgtatatacatatatatacatatatatgtgtgtgtgtatatatatatatatatatgtatatatatgacactgtcctgtggagactgctcctacatatcctgtaaaaatcagtgcttcatagttttggcaccaggaataagtttgattctcctgacaaaatgataccttctctttaatcacaagttgagaatgctattatccagcgtgtttcttttaatgtttattgccttcgttgctgggaaactcagagctaaccccagcattcaatttcagtaatcttgctctttaagattttgagaattagtctcttatcccttctaaaatatttctactgatcttgttcttccccagggtcatattacaggtacgctttaggttaagctttctcaaaattggggtactggatgggttataaactataaaaaatagtgctctgaccctagtctgtgatggtccgaacacaccaacctgtgttcttcctggcccatgctacttgctctgacctggtgctccttgaaataaaatggatttctgttagttacagcccctatttttacactagagttgatgcttttttcctatgttagtcatgaattataatttctgtatgcccccaaatatcagaacaagtggggatggggaggcaaatagcggcatgcatttctctaatatttattcttatctctggagctggttgtataaagctgtcaagaagaaaatttccacttaaaccagaaccttccagcactaggagtgctgacctgtagcaattacgggtgctaggattgttttacttggtgtcttacttgactttcagtttgtgaccatcacttgacaggattaaaaattgcctctgttctatctgctaatttcttgaaggggacagcctattccagaagagacagtctgagcaggaaacaaaggctctgtactgtgctcagaaactaaaactagataggtcagggcccatgcctgaaagcagttggttctccacagcccattgttatccataggtcatggatacatcctggcaagcaggctgtaaaggacatgaccccttaattgaaataaaatgcccacctaggcatacaaaggatgagtagagaaagagtccttaagggaaatttttaattgtttacctcgattgattgattgattgattgattgagacagggtctcaccctgtcgcccaggctggagtgcagtggtgtggtcatagctcactgcagccttgacctacctggctcaagtgatcctctcatctcagcctctggagtagctgggcctacaggcaagtgccaccatgcccggatcattttaattattattattattatttagagacgagccctcactatgttgtccagacttgtcttgaacacctgagctcaagcgatcatcctgcatcagccacccaaagtgttgggattacaggtgtgagccaccgtgcctggcctgggaaatttttaaaaagaaacagcagaactttttgagagtaagaggggcatactccccttctggggttttatttcccccttgggcttctgaaactttaatgctgaactggcctctcacaagccacagacaaagctgagaatgtcaaaggtaactaataaactgctctgaaaaaaaaaaaaaaaagtaaacgtcattagagtggatggagtctaaaaatccataattctaagaatcccaggagaagcactgaacagctttttaaagccatttcttttgcccccaagccacaaaggattgtttatatccttttgaggcagctagctggatgcccctcttcccaattctgggattccctgagataaatactatcttgttcccttatatgccaactctactttctgctgttggaaacttctttgctacttgcagggccttctcctttcagatctgaaggtctggtctacttccccaaggcatgatgatagactgacgttcttgagccccagtgaaggttctagcctttcacagcttacattatcttcccatctcacatagaatcattctgtaaaatgtatatttctgaggtgtctggactcatacatcctccattgagagggggtctgaaaattgtttaatatagtttaacatttatggcatctcttccttgacagtgtcagtaacagagtgaagactgccattttctcaccaacgttaagggaagtcagggatagggcaggttcttcctacagtagcatctggtccaccagtactgagaacattctctgcaaggagtttgctctttatgtcatttagacattagacattttaaataataagcatgatttctacctttcatgtttttatcactggagttttctacctctccactcctccatctgctctaagccaagaagtgcctccagacagtgacatcttgcactgtgattaaagtgcttagtatagagaaatgagtggacaccaggtttgtataggtttaaagactttattaagtaagaagttgattgttttgtggctggagagaaccagaggaccattgtttgaaagctgacaacctatattacaaagaggtgacggagatgatatcatgactttcaggaagcacaggcttttggaagtgttcatcaagtgggtcgtggcataaggctgacttaaatttttttttaatgttttaatttgttgtagagacaggggtctccccatgttgctcaggctggtctcaaactcctggcctcaattgatcctcctgccttggcctcccgaattgctgggataataggcatgagccaccatgcccagcccttaaattctgattatatcagagccaagactttcttgacgttttgaagccaagttgagagcaaaacgacccatttctgattttctacataataaaggaaacaaaccaggaacaataatcaaaggtggattttttgtttctttgggaagttataaccatatttgcataaactttaaaacagttatgacatctagttgaggtactaaaacagtttctttttttaattaacttttgttgcaataaataaggccagactaacaaaaatatatccaaagccaataattctatatttgtttggcacatgttgcttccttcagcatacttcaggtcatctttgccaggaattgagaacaggttgcatgtaattacaaaggctccttggtgggatgaaggacaggatgactgacgaaataccacagctaatcagataagtgcaccagggaaaaagcaacatgtaatggctggaaacccaaaacacaagactttttttttttttttaagacagagttttgctcttgttgcccaggctggaatgcaatggcgcgatctgatcttggctcactgcaacctctgcctcccaggtttaagtgattatcctgcctcagccttcccaagtagctgggaatacaggcacccaccaccatgcccagctaatttttttatatttttagtagagacagggttttcaccatgttggccaggctggtcttgaactcctgacctcaggtgatccaccgactcagcctcccaaagtgctaggattacaggtgtgagccaccatgcccagccatcagcaaatgagtctattatgatgggaatactcatgcccccagactagatctagtttctcctttgatcccaagccttctggtgttgttctcctttgagcccactgtcccttctctggcctgtcctccttaatcttcttccaaggctattctcttctcatgctacacactctcctcatgtaatctcttctaaaggtttgaactaccatagactcccaaatctctaaagaccattcttcagctgagatctctatatccagctaagttctgcatccgtctatccaattgccaactaaacatcttacctagaggtaccaacaggcacacaaaactcaacatagctcaaaactgaacatgtcatcttcttccacatactctccccaacaaaaaaagaaggctgtgttgcgggaagtcagggaccccaaacagagggaccggctgaagccatggcagaagaacgtggattgtgaagatttcttggacatttattagttccccaaattaatacttttataatttcttatgcctgtctttactgcaatctctaaacataaattgtgaagatttcatggacacttatcacttccccaatcaatacacttgtgatttcctatgcctgtctttactttaatctcttaatcgtcatctcgtaagccgaggaggatgtatgtcacctcaggaccctgtgataattgcgttaactgcacaaattgtagagcatgtgtgtttgaacaatatgaaatctggccaccttgaaaaaagaacaggataacagcaatgtttaggaaacaagagagataaccttaaactctgaccgctggtgagccaggtggaacagagccatatttctcgtctttcaaaagcaaatgggagaaatatcgctgaattctttttctcagtaaggaacatccctgggaaagagaatacgcgcctgggggtgggtctctgaactggcccccccccaggcgtggttgtcttctatggtcgaggctgtaggggtgaaatagaccccagtctcccatagcgctcccaggcttaataggaagaggaaattcccacctaataaattttggtcagactggttgctctcaaaaccctgtctcctgataagatgttatcaatgacaatggtgcctgaaacttcattagcaattttaatttcgccccagtcctgtggtcctgtgatctcgccctgcctccatttgtcttgtgatattctattaccttgtgaagtatgtgatctttgtgaccaacaccctattcgtacactgcctccccttttgaaactccctaataaaaacttgctggttttgcggcttgtggggcatcacggaacctactgacatgtgatgtctcccccagatgcccagccttaaaatgtctctcttttgtactctgtccctttatttctcaaactggctgacgcttagggaaaatagaaaagaacctacgtgactataggggcaggttccctgataagactgccaacccttcttgtatggctgatattggcaaatggagccacaattaattcatgttacagcatctttgatcccacaccttctggccttgttctgtactccgtggtggctatggccctgtctgctatatgctagctaagttctgtcaagtcagtactgcatccttggatacttaccttgaatacatcccttctctctggaccttacttttctatttctaaggattcctctaactctatatttctaggcgtctttcccttgtctggggaggggtcaataaagagcctcactctttggctcagttaagcatcttgggtttaaccagactgtgattaaaaactcatgtgcatgaagcgaagtagattggtttaagttatacaaggtttagcgtttaacagtgattagtggatgatataaaaaagatgtgctttgtttccataaattgtcagaattttagtcttctgttttcatgcacactaaaataatgctcaattttccaaattgtaacacaatacaaagaggctgacaattgggtttcacttggaaaggaaaattaaaagtggtcaatacagatcacagaatagataatatttgcaaaggagaccctacttagaaataacacgcattcaaacaaaggtatgatgcctgaatgtgtgataactaagtagtttaaaaattgaaatagtttcatctgtccctgtaaataaacgtgaagagaaaagtacaaagtcctttggtttaaagggtcagtgtttttaacagacacatgaacgcatagtttaggggaactttcctttctaccccagaaggcattttcaatatcttgttggcatggcccttctacttgatttctaaggagccagatgcactgtttgcttttaagacaaggtctcgctctgttgcccagcctggagtgcagtggtgcaatcacagctcactgcagccttgacttcccaggctccagccattttcccaactcagcctctcaagtagctaggatgacaggcatgtgccaccacactcagctaattttgtttttgtttttgtagagacagggtattgctatgttgcccaagctggtcttggactcctgagcgcaaacaatcctcctgcctcagccacccaaagtgctgggattacaaacatgagccaccacacctagcccagatgcacttttaggtatagatgcatttggccccctagaaagtactcaagatgccaagttcagcaacaaggaaatatttgaatactcttggctttgggcacaacatggagctagagaatgggtaccccatgccccaatgtcaaaatcagcagtcttggttaagtaggaccaaccctgcctcaatgacccaacttgttcaagttctagctataaagacagaatatgacctcagctcttcctaatttcagtgcccaagctttttccacaacaccagggctgcttccagttagtatggcaacaccattctccagagttgctaattttcactggttttactctacttgagtttcctatctgtgggcactagagctaagaaatacttctgcaataggctgtcactttttagtcataaagtgtgagttaacatataatttgaacaaaaagccaaagccacatgactcctttagtaaacctctaacctagtttgcgtcagtcagtcaattcaattcagtaaacatgttagaagcccaatttaccaggtatggttttcagtcagcaggtgctgaaaaccttgtatatggcaagtgtgatcagagatattgtgaacagatgtgaatacaatttgcccttgtccttaaagaagttaatatgtaatgtgcaggcagagtggacattcttgaaaatcccataagaacatattaagtagaaagtgaaacaaagtggtaattcaccagggaggaggaaatgagcctctccaccaacacttagttcgtatcattctgtagtgtaaaatcagaatctcacctccaaatgaataggctgactgacttctctttgttctccgtgtgctaattcttgccattgcagttggctcctttggcttttcctaaaaagttcactgagaattttctggcctactctggggactccctaatgtgtaatgttcaccaactaggctccagttgtgaatttttaattatgccggatcattttcagtaaatagaacttcgggctcaactaatgctgtcagatctaatctttgtctcacctgctatggagctccactctgtggtgtttgcagtaattgccacttccccaggaaagaggagcttttgcagagatggatgtcagcagccctttgcattctcatctgccctcctcagaagccctacagcggggcactttatccagcagatttgaattttgatgtttggaaagtagagacaatggatacagctgattgttctctttcaattttcaccaagtgtgattgtctcatgcttcctgtgaggcagtagttctcaaagtgtgggccatagacaggaaacattaccgtcatctgggaacctgatagaattgtaaattctcaggtcccatcttagacctgctgaatcagaaactctgggggtccctgccacctgcatttaaaaaatactctaggttatctgatgtatgattaagtctatgagcccactattgagagagaactgtttcaaactaaggataagcataatttcgttctattttgtgaaaattctcataactcatttttctgatttacaattcttcaaaaacaaaaatcctaattttcataatggaaactcacatttacctttgctttccctaactttcccaagcataggcagttgtttcctgttttatttccctagcattttttcacacttgtttattccacttggtacattacattgttatgtagctgttaacatgcttgccttctccactagccttggggccacctgccggcgggaaccttgtcacactcatcatagtatccccaaggctacatagtaaacacacattaaagggcacagagtaaacacattcaatattttctgagtggataaattggttaacattgtataattttcaaaactaggtaatggccttaagaagtacgactggcagaataggaaactgagacccagagacattaaaggattcagttggtaagaagttgcagaggcagggctaacaacaaaagcttacctcagtatgggaaaggtgatggccacaggtccctcaaaactggcctaatacactaaactccactcaggaagcttgggatactttggctcttcaagggcaaagcccttgatttactcccagacaggttgctttctgccccaaaaccaaggatgctaagagagggtagctgaggttgccagttagtgagacacgtgcagagactgagaatcaagagggaagggaatcatgtaaaaaaaaaaaaggagattttagtactattggaggtataaattctagtactcggttaggccgtggtaaagagaaaagatgtgaactgcaagtgaagccaaggtagaaagctcaattttgctcatttgccagagtgtccttcttacaccaaggtgaaaacagcataggatgtactctgtgaggtatttgttataggaatgggctgccaatgattgccaccaatctcttggtacccagcttgccttgtcatctgtaagcaatctgggtgggctgggagaatggggagaagcagactatgggcatgggatgaagaaagccactggcctgcaccaggaacgaggccttcactttccctcattaaccttagcattaatctctacataactaagttacctgatttagatgcttttacttggacctctggcatacaagtctttgtaacgcagttgtaaatcctcatagagtggggtgggagtaaacagattctggcataggatgcttcttgaaacactccttaatcatagtggatcactgtctcatcaggcctcactgtttatctcatggctttgagtcccactttggagcaatgaccgcacatctgccttgtctttcttcttgagctccagttccatttctctaattgcctactgggacactgtccatcaataccccaactcgataggccccaaactgaatccgtcatcttctcctctagtccagatctccctcccaactactctctctttcactggcagagtaaatttgttctcagtcatccaacttgcaaaccttctcagtgactttcatttagggtttattctcattccccaaacatagtcaatccccaagttctgtcatattttcttttgccatgccaggcatagttattttccacccctataactgccattccagcccagcctctcattatatttcagatctcaattaccccaaaccatccaattccataactatggtttctgctcctcaatccctgatgtgatggagaagcccagagttagatgcgaacgcaacagttttataataccacttacaattgttagataccgttctattggcctctgatagtttgtaactacggtccatactgttggtaaagacacatgggattagtcagcttaaatgagaaaataatataatttagaaactgactcatgttctttcttgatcccaatgaggcattcagggacgtgactgtcactctctgggcaaaaacaacatgtaccaagaggtgaagagagcaaaatagcaacaaaaataaatgagcccattgctgcagtccctgatgccctgtggtgagctgctagagtgaaaagttaatggaatgggagagggcaagataatgtgagcgccctggttgccttttccaagagcttttcaattccagagtaactgtgagcttcattgtgaatggtttacctgatcagtataattccctctcctttgtagataagaagactaagacagcaagaagttaaatgccttgctggcagccaggattagaacctgggattcctgaataaatgctttgaacttatgaggctgcttctgagagatcatagttacactgggcttcatagcaataaaaatgagcttttcccttccctcagaaatcctgttattatccatagttaggcaaagggaaactagaagaggatgctaaataaaagcacatctcaatgaactgaactatctttgccaggtgattatcagaaatatagataatgagcgtaagatacttaaaggggcaaggactctaatttagacacctcgggcaaaagaagtgaaaaagtttggaacaaagaaaaccactcaggacataacctaacaagatagaaaaaaatgaaatgcgaaagtattatcagctttaattaaaggaaatcaatatttgaagaggtgtcttgctcaacaatagaacaagggcaaacatacttcagaaatgtgagtctcttagaaaagagaaaagcaagttttcatggggaaacaaccacgattgaaaaacctttcaaaagatgacgacttggtgtatctgttggagaggggcctgaagcacctgttggggaggccgactagatgagcttttatccctgggagagtctgttttaagtgcattttttcagtcagggagtgttcaggagcctagaggcatctctagggagtaaagaatagccagtatttccctcagagagacttgaaacaaaccctcaacaataaagtgggtttcatctcagttatcacttacaagaacacacattggaaaacattaaggactatacaaatgcaacagatgtgttatttcagaggcactctgcaaccatccaagcaagcttgcttgagaatcctttctaagctcacgttttttgtgatgcacatgatgaccaaccttcagtgactggagtccaattctcccagaccattcctcttcagggatggaagatatgtgacatgtgtcaccacttccttctctcaaactggtgcaagacattaatactcaatcatgacacttctttccattgagcccaaatgcagctttttcatttatttgttcaatgaatacctcttgactgcccatttaaaagtgagttggagagacagataaataataaaatataagcaacactacgagcaccacatgctaagtgcctagtaaaagatatgtagacaataaatatcatagccaaacctgttctcttgaaatacaatttcaatttcctgggaccctgaaaattaattcttaaaatttcagtactattgtagttgtatcagcacaactatttttcagggatctgagatgaattaattccgaaaagagcttacaaaggagatgcagaagtttctatatgccacccatcaaaaaagtgagtcaggtgtgttttaagccacagggttcttctcccacaattagctttgaccaaacagcaaaactcagattggagtgggtctgattgccattttggtttaagtacactggataccatttcagcatcaaatcattcaatcagaaacactgaaaatgctgaagagttgggttagttgcaattttcccacctgaatagaatgtgcataatactgcaaattgttttttcacttttgtagtgctggagacatttatggaacctgtgggaaagggttttcttgacagatggagatggacagccaaccagacagaaggagagctagcactcattaacttttcccaacagaaactcacctgtaattgttttcacaggcctttaatgaggcttggttgtgaggcactagagagaggaaagcagcttatccatagaaaaggatagctactcaggtgaggtagaggaagcctggatccatagccttggaaattgtaggacataaggtttgagattacaattcaaagacaagatgaaagtgatgagggctgacaagtagtctagagatgggcaaatcaaaagaataactactggggtagatctgtttcggttatgtaagttaggaactctaaatcaaggagcacccacccccccccaccaatctcatatatccaaaattatatctatgtgtctttgaaacaggttggatttattcttgtaaatccctgggattgcgggatgtttcagtgaccagagttcttggcaggatcttaatctttaggtctttgccccaaagatctttgaagttcccagacagtctgcagctgcagtattttctctttatttttcatgggacccttctagaaactgcagtgtccttgatatcactgctttagatctccttctctctcaaagtttcagaattatggcatcttgcccaggcttatctaactgacctggattttggtggaggaatgaagactttttctgtcaatgttaggtaaacttttctataccacagtcattagtacatctacaaaattaagctccgaggatccaagccagccacaagttcttcttgatccccctttcagatacatttcatcactgttaatggatctgttatttgcacagaacaaacatttccagttacttgattaattttacccctattcttggtgcaatgccttccctgtgtgatttattcctgagaatgtttttgttttcatttccccaatatctgtacttgggggatttggcagtaggttagaggggcccttattcctatcttttaaaggattactgctccaggaccacctcccgctagagcaccagttgacaataatgaggctgccgctgccagctgatagctttccctgatgtcctactgtgtcctgcattgagcttaaacagggtcaattataatgtaaactatagaggaccctagtgcccaaggcgcagacatgggaatttagcagtgggggattttgctttatcaaaaaaaaaaaaaaaaaaagtgaatgaatgaacttagtgactcagcacttagtgatttagtgatgacttaaatgaccacctactctgagcccagtagtgtgcatgagacacatcaaaaacatcccttgtatctgaatgcttccagccaagtttcccactgcctactgcttaagtgaggggctaggaggaggaaggctcagtggccagtgaccagggtgcaagagtgacacagagcatattagcatattgcattctttgcatcaggctatgccaaacttctggaagagacaattttgaatttgtgaggaggatagccaggatggtccctggtctcaggtccctaaggaatcctttgccaggaagtcatcgaggacggatagaggcagcaccaaatgaattcttcagtccccactcagaatgtggccacattctggtgagtctgtgagtggtacggggtaatggtccctgcactgtgcaggaatcccagcacttcattccagtggatttctgccccctcctctgggatagaatgtgtgtccactctctccagagccatccactccagcagcagagccagagctcacatgggtatctcccacttctaagagctgcttttcataccccctagacgttttttgttttgttttattcttgagacggagtctcgcactgttgcccgggctggagtgcaatcgcacaattttggctcactgcaacctccacctcccgggttcaagctattctcctgcctcagcctcccaagtagctgggattacagacgcccgccaccatgccctgggtaattttttattttttatttttgtatttttagtagagatggggttttgctatgttggccaggctggtctcgaactcctgacctcgtgatccgcctgacttggcctcccaaagtgctgggattacaggcatgagccaccgcgcccagcctagacactgactcttaagtgcttggacagttgctatctctctgacttttcctgatcagcctttttccatgcccacacacatctttattacctttgcaatcaccaggaacccatcattatctcttgttccaatcatatccatgaagtcatttgaagctgatgggtgcatggcagaatatcttttgtgacccccagcccaccccacatataaatacagctacttgcagacatctattttggagatacttaaaaggttcataaatatctgaaaagatgtttgacattttctgagacaatattctttgccactggaaggttctattatacacattaaaagcaaagatacatatttttctttcttaccttcactttttataaaaggttatgctgacgtagaacttactaacaaaaaaaaaaaaatcttcctgatgaaatcaggataaataattccacacatcttcaagtggagagaaaggctttgaattggtttccatggaaatctgaagatgaagtaaaggaataatttcaaggcagagcagctgaactgaagataatggtaaaatagtttgataaaggaaatagaataaagtaatcaagaagactccaatcaattattcctttttgtttacctttaggtgattaattcgtctgcgtttattaacctgatgagattaagcaggccttccttgtgatttatttcgtaattgtttccaaggtttgacataagctgtggagttattgaaggtggagatttaaattcaattactatgaagcaggtggtgattctcctgaaagaatatctgaattcacggacttcccatgtaacattatgagtgaaaattattaattcatctgatagtatctcccaaagacttttagaagtcatttggcatccacatacttcaccaaaagtcagcagcttcagaactgaacatgtaatgaagagaattcagtgcctggaaagaaaggattttattttaaagactagttatttttatacttttttttttaaaactagaggcccccttggggcctgggctgtggtgctatcattgatggaatccatgagctcaagctttgaatgccaaaaggatagctttctttgaacttgaccagtggttcccactctctacctttaaagggcacaactggataagatcatactttgacaggagagagagagagagagagagattggccagggggtggtggggggatatgcaggctggccttgagagtctttaaatgaagtgactaattgctttttgtctctgtggtccttgttgtgtatatgttttctattctttctgtgggtatagtaaggataaacggggttctccaaacactaacgcaggcgccaactctccgtcatccacaaagacccggaacacatctaagagtgggaagtaagtgaaaaagtgctcctgtacatctgacatagctgtcaaaaagtcaagtgctgtcctccttttgtcatttattcatattcattcaacaaagatttgtggaatgtcttctgtgtgcctcccactgggctcgtcactggggaattgaaacgagcaaggcatgtgtcagtaatattgggtgcatgaagaactagggaagagggaggagagggatggaaaagtcaggagatgactctggaaagatagcttagggctgactgtgaagggcaaggacataagtccataagggcaatgtaagagttggattacaagttttaagaattaaagcagcagcagcagcagcactgatttatgacttacaaagtccatgaaaacctgtcctgatccatacactgagtttaggcttgagttagaagaatctggtaagcttttccataaatttcctggtttaagtacatttatgttttaaccatatcactgatttatatgatatgtatattcttttcctagtaactaatatgcaccaagtcctacatgaagctgtttttttggtattaccaaaacttgtatgggctgaatatttgcgatattagattgaccttttctgggcttattccagaagacaacaccagccgatctctccctttggcttcagcaaagtgtggcaaactcaggcagtgtgatcccacgcagatgacatacctctaattagacacttccccttggaagttgcttcaaccctgtggtgaatggctcgagttctccgtaagctctctctccagggtgtggggcattgtgacacgcagaaactcagtccagaaagagcacccagcctgcatctaggagaaaatgaaagataccttcatcatgctaaaagctctaatctagcaataagatatgtcactacaagagcacagctttgcaatgaaaggtgaatttgtaatggtcatatattttatgtattcagcattggaccgtaaatgctgcactttgaatatgatcttatattcaattcccaaagtgaaagatctactggctgcctttttttccttcttttcctctgaataccatttcaggtttgcatataaagttgaatgcgggttatcttgcaaaatataaaaaacggtgttaaagacataaaactaaatctccaagcagttagaactcatttcagttatttattgctgagcaccataatcaaaatgctgtataaattatgaaggaagggaattgatgcacacattcccaggcagctgaatgttttcaaattagtcccaattcattgttaacacgcactcttagttaacagggatggcattgcagaacttcttttaactccatgcttacaacaatggcagaccctacctgggcaccctgtacctacctgtcacaccaaaaaccacagggcacaatctccatttattagtccctgatgtataattatggatgtttgtgatttgctgttgcctttccaaaggggccttcccttgtttcttttggctttgcaggagttcactgtcttactttttgagtgaagaatctccatttgagctacaaaaggagcaattggtagaatctgagttaagatgacatagagaatgcatacctaataccatacccaggttttcaacagtgggagggctgaataaatacattcttaaggagataaaaaatgatctatatctcacttgccatacttggtcacatcccaagcttctgccatggtgaagggtctctctctttgcacattttgagataggtaacttttacttgacatgtatagtgactcatagactgagctagttctgaattcttcattgtttttattggttgttagtgaaaaattacaagttctccgacatcctcttcctagatatgtgtgccagggtttcttgcactgttctcctcctcttagtcctctcccatcagttttcaggagatttttctttttttccattagtgtacattttctccttcttgggatatcattttcaacaggagcagtactgaccttctgtgcatatggtgagactatgaagggcatttttcacactttatagaacagtgcctatggatgtttaggcactgtgttctagttcagagagagttgtgattgccagttcctgctgcactgtctatgcatttccttagctttggtgtgtgtggtggtgaggaggggataggtagatgtctccaccccaaggcttttccccatggtgtattttctttcacaacaaccagcccagaggatgccatgttctgatgttatttgacctaatgacaataggatatagagcagtttttaagaatttccctatgttattttgaggccagacacaggctgggagatagaaggagggttctttccttctctgaaaagaaattcagtcttctctgtttttgaagaaaacaaaaaagcaaaagtcaagctgccccaaatatgcatcatggctaaaaataaggaatatgtgttgactgagtgttacgggccaacctgtgtcccaagcacttggtacattttgtctcattaatccttgcctaccaaaagctcatgaaacaggcactattatttctattgcacacatgaggaaattgaggctccaagaggataatgatatgcccacctgaggtatccaaatgaacaattttggtaaaaaaccttctttggcaccaatgataataatagtagtagtaattaaaatatattaagcatttactttgtgccattgcactagactctggggccatataaatataaaatactataggtgcccccaagcagttcacagtcttagtagggaggacagaggatgacaacgtggtatttaagtgctacaatccctagctgatgccagggttggggtgggaaataggtcatatggggatatcaataaaggctcctgagaagcaatccctgagctctttaattttatccatttacccttcatgtagcaaggttaggtcagagaaagaaaatgcaagtcggtcactccagaggggcagaatcctctgtgtcttggtcagaacacgttggagttgtggattaggtcaaagctaaaatgaaatgtctaattccacctttttccaactttcaatccatttggagcctactgagattcagtgtagcatgctgagtcgcttaggaaacctacagcttgaatgttgcgtcagttctggttgctctatttcattgcctggatgtgaagctgggtagccagccctctgtttcagggaggaacagatggaatgggatatgtctgagcagcagagccagactaccctggaaatgactttcagggaggtgcaagcagtttcttctatgccaacagtgagccaaattgacaagacagaaaaaaaaaaaacttcagtgcagaactgtgtcactgagatcaggaagcataggttttgcagaggttgacccatgaccaatcaggccagaccactgcatttagcctcacatatggttccctttggtaatgtgaacctgttattctggccaacacagcagaacacagtcaatccatttgctgacccattggattatccccagaaagcaagtaactgtcaaagctgggcatgtgtagtagccaccaagagcctttataatgttcatttggtattggaacattttcatactttacatgagaccaattattttgctgaacacaaggacactgagactcaagaaaggtaagtcactttccatgaggcacacacctagctactagcagagggcagcctagacacctggtcttctcatacttgtcccatgatctttccactgcaatgtatgctacagttcttctcccagagagcaagatacttcagctaattgcaccaagggaggccaggagccagatctcaggatgtccagccaggtgctcttccctctttttgtgtgggctctgccagctactgtgaaaatggagactttttggaaaaattagaatcatcctacttttaaaaaaatgtagcagtagcggtgatgaaaggaaaaagcatgtacttctcaactgcttcattttttcttctaaaataatggtatctctggttctatttggacagctacctttcctcaacagtattgttgagccatctcaagcctctaatctactccatcaatgaagcaatagagaactcatatatcactatagctattctctctcgaatcagccaaccaaagctaaggagatgtagattagataggtagatagacaaacagacacacatatatctacatctacgtatgacattcagaggcatccacttaaaaattaaattgcccaaagttgagatgatgatggaactcgatcactcctctcagtctgagatgtttttcacataggctcaggctagggaataacaaggaccaagtccagttttcaagtactagtgaaggccacaaatatggggccagggcagagcaaccaagcacagtgcctggcaaacaatactataaatgttgaattaagcactataagtgatgggttaaatgaattaagctaggggaaggagggatattaaaatggagaaaaagaaggtgtacagaaggggaatatgagatgatcaagtcaaaccctgcttactccacaaatctacttggagctgactctggtaagaccggctctaacctgcctttgccggaagtaccttatagtgaacaaacctgtttatctattcagtagtatccagataagagtagtcaagagcacatagcttcataaataaacataccagcacccctttgcttttggctggcaggagtcaaatgaaaaacttttcagctttagaaaaataaagtgaaggctgggcgtggtggctcacacctgtaatcccagcactttgggaggccgaggtgggcggaccatgaggtcaggagatcaagaccaccctgtctaacacagtgaaaccccatctctacaaaaatacaaaaaattagctgggcatggtggcacacgcctgtagtcccagctactcgggaggctgaggcaggtgaatcatttgaacccaggaggcagaggttgcagtgagctgagattgcaccactgcattctagcctgggtgacagagtgagactccgtctcaaaaaaaagaaaagaaaaaaatgaaagataaaatgaagtcttgcttgctctgtttggactcagcatggtgcattttcatgtttgacttcagctgtttctatgtccattgctggcaccagagtcctgcatattatatcgtgattatgttttttcctctaattgagacccatgtattttttctaagacattgggttgtgactgttgctaacccccactaattttgccactgtgtgtgtatgaaagtatgtgtgtgtatgaaagtatgtgtgtgtgagtgttctcttcaaaatggttgtatgttgcatgaagatagcaatccactggccaagtatttgactttgccagtaattgctgtagttttatgtgatgataatgtcaatagttccttagtttagctactagactaagtctaatatcacaaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggttgtctgcttttgccagttactgaaatgtggaagcaaaagccccagcaccataataacaatataacataataacataacataaacagtgcccatagattagatgctacaagaaatgagtaacagatccaggaagaaagagtccagccatggaaatgtttcttagcaagttcacctgcatctctgtgatggttaggatatacagtacacttcgtgacataataaatccacccccccaacccaacatatatgactttccatgctggtcatgcttctatagcttagtcaagaagagtgttctgttaatcaagccttgaaaagcaggaaccatttttctctcccttcaactgccatacaaaaatcagggaggcaatgtgctgctgctctctagaacaggggtcctcagtgactctttttctacctctgtgtcatacatggttgagaattctcacttatattgctctagcagagctcagggttctgtccagttcccaggcactgtctggaattccactcttctctctccctattgggaaagactaggaatgcaaggaagagtgatgttaaacagtatgctatttttttccacgtaataaaaagcaaatctctctctctctctctccttctctttcacttttccctccttccttccctcatctgtttgttcattgatctattaattcttccaccccatttttctggctctcaactgagctttctttgaactaccttggcaactttcttgaagatcatttgtccatatgtatttgggtctatatctggactcagtgttattccattgattgatatgtttatcgttatgccagcaccacactgtcttgattactatagctttatactagtattgcaattagatgttgtgagctctccaacttcattcttttttctttcttttttttgagataagactgtcaacccaggctggagtacagtggtgcaatcatggcccacttcaacctcccaagtaactgatacgactggcacatgccaccatgcctggctaatttttttgtagagatggggtctcactatgttgcccaggctggtctcaaacaatcctcctgccttggcctcctaaagtggtgggattacaggtgtgagccaatgcacccaaccattcttcctttataacttgttttggatgttgtacgtcctttccatttccatatgaattttagaatcggtctataaatttttgcaaaaagaaaaaagaagcctgctgggattttggcaaggattgccttgaatctgtatatcaaatttggagaaaactgacatcttaacaatattgagttaccatgaactcagggtatctatccatttatttgggttttttaaatttcactcatcagtgttttatagttttcaggatacacgcttttcctattttttttgtcagatatatccctaaatatttcacacttttggtgctatggtaaatagtattgttttatttcaatttctgattatttctaatagataacagaagtataattgatttttgtagattaatcttgtattctgcaaaacttactaagttttaggagcttttttttttttggtagattccactggatattcattggatattcaacatagatgattgttatctgtgactaaagacagatttattcttccttttcaatatggatgtctttttcttcttgccttattgcactggttaaagcctttagtacagtgttgaatagtgatatggttaggctatgtgtccccacccaaatctcatcttgaattataatccccataatccccatgtgtcaagggagagaaaaggtggaagtaattgaatcatgggggcggtttcctcgtgctgttcttgtgatagtgagttctcacaacaactgatggttttataaggggctcttacctcttcgatcagcacttcttcctccagccacgttgtgaataaggtgccttgcttccccttcaccttagaccatgattgtaagtttcctgagtcctctccagccatacagaactgtgagtagtcaattaaacctctttcctttctaaattactcagtctttggaagttctttatggcagtgtgagaacggactaatacaaatagctatgagttttttggtgtgtaaataatttctacccacttaagtctggaaaaagacacatacaataatggagagatagttgaacaatggaagcgtcctccgaagatgctattttgggaacaaatggttgatccctgcctttattgcatgtccaaagctagattcccatagcactgcacagatatatttcatcagagaaaagtagatcctattcatggggaggagggggaggtggaggagaaaaagtgaaaaacaagaagaaaaataaaccctaaagttcatagaatcatatatacttttctcattattctcattctttcattcatgttctctctctctctctcttctttgaaagaggtagtatagtataatggttaagacagcaaatgctggagcctaattactgccttaaaagcctagcattgccctcggaaggttaccggctctccctctgcatcagtttcttcacttataagaagaaactattagtagtgcatgcttcatagggttttcttgaggattaaattctttattcattcaaaaattttactgagtgcatagtaggtacaagatgctactctaggctctggggatacagcagagaacaaaacaggcaaaattccctgtccttatgcccattataatagagggatacagtcattaaacaagtaaaagacgtattattttaaaagggaataagtcataatttggaaaaagcaggggagaggtataaggaatcgtggaggcaagaaacttgtaaatttaaagtagttgagggaaacatcactaaaggtgacatttgaggaagggtttgatttatattaagtcagttaatgcatgtaaagaaatgggaatagttctttacatacagcaaaaatatagtacttttatgaattataatttattgagtactttctgtgtgtccaacactgtgcgagatgctttacatattatcttgtttaattattataataggcctataaagtaagggttattagccctttctactgaggaggaatctcaagacattggcttgtccaaagtcacatagtaggtgatagggccaatactcagatcacatctgagcttgtctcacgaggctaagttcatctaccccttctgaagacatcctgcatgcttagggactatattagactagactttgattcacaaatattagaagactggtcctgctgctggaggcctcagatgggataggattatgtagctaaaagcttctacaagggctgtggggagtggtgaaatatcaccttatctttagtatttcaacttgagaataagggcaatattgcctggcactccaataccagcacctggctctgacactttcactactatgtatgttgtgggcaagcaacctaagaatgggaagtggggaggacagaaataaaacaacgttactgggcaatagctattactccattacaaaagatgatttgggttttcaggatggtcgcttgctgaagtttaaacgaaaaaagaaaaatgaggctggactcagctcactgatgactgaactataaattttgcttggaaaatgctggcaatgctataaaattcaggccaccatctgttagtgcttgcttaaagtagcatttgcactggataattaagatgtcacatgcatttgaagcacaaatcatcagtgcatgggtgcctagcatccctggaaagattgtggatggtgaagatgttctgagaggaatatcatgttgcttgaaggatacatttatatgaaatcacaggagctagtgttttggatcacctgagtggggttgagtagaggaggagatgaggacactgagaaaactgctttcttgagttgactggatcatttaatcaaaatgatcaactggctaggcccatgcagtatggcaggcgtaataatatgtttggccatcactgtctgcaaagctcatagtgaattcagggatataaggaagaagggaggcaagtctggctaagcctaaaattcctaattaaaaaagaatttgcttgtaaagcactttataatttgcaaacagccttctcttttgttatttcatttaattaattttacccaccatcctaggaagcaggaattatatctacatcttacagactggaaaactaaggctgagggaaatagcatatttttgcccaaagccacatagatagtaagtggtagaaccatgattcaaaacagggcccttttaactctaaatcctaaagtattttttggccaaagcacaacgtgctctgatattagagtcaaataattttacatacctgaccaaaaaaaaagaaaaagaaaaaaaccatattttacaactttacaggcaggtagagaaacttacagacttcaattccaacaaagatgccagagactgccaaatatagcaagggcctggaatttttaaataataagaaataacatttattgagtgcttcctatgcaccaggccctgttcggagtgctttaaatgcatgcattatttcatttaatcctgagaactactccatgacgttgattcagggagagttcatcagtagcttagatggtgttgcccatacccaaatattgaaggttctctttggggtgatgtctgggtactttcagcagacacagcatggctggattgtggagctgagccaaggtaatgattctcccagctttggagtctaaagagtttcgctgttttggcatcaaagaccataattaatggaattaagaaggctgggcttgcttccaagtggctcttcaagagtgtccttctttctcatcatggttggggaggagatttgtgctccacgggctttaatgagatgttctgtacccaacgtctgcatgtttatcttcacttccccaatacgtgcctatggacccttcaaggatgatcaagctattttgtgccttcaccctaggcaccagggtatgttgttcagttgtgatatttgtcagaaaaatcttaggttggtgcaaaagtaattgcagtttttgccattacttttaatggcaaacaccacaattacttttgcaccaacctaatagtatgctgccactgcccactctcctagtactgctcccccttcttctgtgaaatgcaggtaatcattctcatcactcctcctggcatcaccaggaggatatgaaaacaagcaatataatgtctccaaagaccttacaaaaaataaataattacaaaaacatacttcatggtggttttcagtaactttggggggaaaaaatgcatctccatataagtaaagttgacagactcttacccctttccctgagaatgtcttcttgccatctatgtgccaggtttgcagaggttgccccttttctcccacagatcgttatgtcctttcccaaccacatgcctagtgtctcaccgactattcatttctcacttgccctccattggcagccatattttcaggggctaactacacatacccagctttgtcctaaaaacacacaccaagtctggaggccacgagtttccttacctgattatctgggtttctattcccccacttggtggtgaggaaacacatgcataatgttgttatttttttctgcttgcttgtaatttgggaggcagtgcgaccattcattactgaatgcctacaatggacaaggcatttgtgttagtcaacaggaataccaaggaaaaggcatattgtccctctcccctgcaaatgcctcctggtggggaatctctgcctgctgtagccattcttcattccaattctggcttctagcagatgaaaaaggacgaaaagaggtataaagaagccacccaggccattgagcctgagttcatagagccattgtgatgcacttaccatgtccttcctctgtgtagaccagtggttttcagtctatgttctgtacagcccttgggttctgagggaggacctcaaagcctgccatgagtgaaagtgatggggtagtctggagtggtaaatagatggggctccaggccctcactctacctcttcctgagtgactccattttaatctgttttacatattgggatctgcctagatttcattttttaaagccctgctgctgctagaatggaaaaccaaaaaccatatgttcacacttatacatgggagctaaactatgagtttgcaaaggcatacagagcaatataatggaccttgagactcaagaggccagggataaaaatctacacattagatacaatgtacactgcttgggtgatgggtgcactaaaatctcagaattcaccactgtgtaattcatccatataacacaaaactacttgtactccaaaagctattgaaataaaaataaataaataaaaataaaaaatacaaaagccccgttgctaagaaggaactgataactaccagtgtagacccagccagagaatactcagggagcaaggtttttattggaaaaccgcctttatccaccatgcctcagctccccagtgacaggcaaagcagttctggctattggacaatctcacagtcccctttctcaattctgcaagcttttttaaaaaaagaagaaaaaaagaaatgcttcctttcatatggccaaattgctctgaacagatgaaagggaccagactgacaggtgattgttccctaagattacagcctacacccaggctgaatctgaaacacttggaggaaaaaaaaatgctacaggttttgagtaatgctccccgactggcatctgctctcaagactaaatgaacacacactatttccactccatttccttaaactggcctctgtgctaggctgtaatgaaacctgtaggggaagaaagaccatttgcttggggaaaggattattttagttgcttaagccatcctctcccaaaaaataggcggatggttaggctggagtctttgtttttaatttaaatgtcattaggaggtccatgagttttcctcatatttattgtatgctatacatacacattgtagctattttatataaccctataaacaatttttaaaataaattttaaattgtctctttatattatattcactaacaaattcaaccttatcaccaacaatataatgttatcatcaggcccaaccttcatccccttcgttatactggtcttcttcttgtctataaaatgtctgcttttccataccattgcacctatcttgaataacctgtgtccttcaactacccatgtccaaacactagttcattgaaaagagctcattctttcaaaatagataagatatgtatttctatcccagctctagtaccttggacaagttaatctctttgagcctcagttttctcatttgtaaaatggggagaataactggaccttcctctctgctagaaattccttgaatgttcactgagatgacttaggcagatcttctggtacatactggtactcattaaatggaatcgttgttattacttatatttcaagacaattactgtgccccttactccatcatgtctcccttgatgcaacctgagggcatctctccctcctctgaacagcatctatttagcattgaaccagacactaagatgtgccattcatttgtttattaattcaatgagcaactatttattgtgcatttagaatgtgataggcacattaccagatgctggggcagggtgggcatagagaggtggatgtgaaagaaggaggagagaaggtggagacagcagggctgaaacagatactgctcttaagcacctaattttctagtaaagaagatattcatatacaaaaataactagaatacaaggaacaaagctatgtgctttgtaagaaaggtgcagctggagactcggctggaggactgtctccactggaagaaaaagttctggaaatgtcaactgtcttctttcttgttaactttccctttgtttgcttatctctccagcaaagttctggctgtggctccttgaggaagagtgggagtacttctttatcttccacagagcctaccaaagtacaaaatgagctctcagtgtatgcgctgatgtgagtaaagtatctgcagtatctgtagtaaagtacctgcaaagtatctgcagtaaacagaataggtatacaacacatgccagaaaagaccacctattctcttattccatcttatagcatctcataaaaagtgcatgcactgcaactcgatatgtgaaaaagttctaaaaaaaatggatacataaagaagtattcttcctccttgaactttaaagattcttgagcttattttaaacaaagagcattttgttgaggattttggtattgagccaactatagtacacattgcatttccctgaacctcatgatgttacagagaggggctaggagcacttctggggtacacttaccctacaggcacttctatttgaacctactgcttgtccctgcctttctgaatctgagaaattatacctgagagtactttttaaaaaccagttgattgaagtatgattgacatataaaaagctgcatacatttaatatttatttatatttaatgtatatatctcattgagttttggaggtaaatatacatctatgaaatcatcaccatcattaaggacataaatatatctatcatgccctaaaggtttcctcctgccccatgattattattgttttgttttttgataagaacacttacaacataagatctaccctgttagcaaattttacatataaaatcaagtattgttagccataggcactatgctgtgtagtagattcccagaacttatttatcttgtgtaattgaaagtttgtaccctttaaccatcaccacccccttgcccagcccctggtagctaccattctcctttctgcttctatgagtttgacctgattgtgcttttgatggatgttagaactatcttccttgacctggcttcagccatataagactgctgcagtgtctgttgaaagttgcatcccctaccccatctcagcacaacattctcctcctcctgttcatcttcatccctctttcaacccacagtagtcctttcattaacagagttgcttattcagtagtgcacagttcttttaaggcagattccaatgacttagggtttgtcctaattgactaagctggatgcaaaaaaccctgagagtcaaatgactgtggacatctgtccccatacctaaccctaagcaactctgacaccttgagaaagtcacctagcctctctgaatctgttttctctgctgttaaatgatggggctggctttgctgactaaagtacaaacaaatcgtgagacaagcccccgtcaccactatcaacacaaataatggagctagaaacacgagatcctttccaggtaatttaatactgctgcattttaaaagtcgtgggccgagaagatgagttttaaaaggagggaaaaagtaattcacatctcccaagatagtgtttataatggtctattaagaacacattgaaaagaaatggactaattctgtagtgttttacccaggacagcaggccagttcagtcaaagtgttttttgaatagggctataagcaaatctctttcggtgaaacctagagctgctttgcagaaagcagaaaagtggagttttcccctaatactttaaaaaatggtcacttcaccattgccaaacttcattaccactcccaggagctaaagcttcgagattaatgatcctcatcttaaagagaaggcagtgaccgctaaaagaaaaaaagaaattacaagcacatggtatttactgttctgcattctttgagaattaatgtcagtaatactgttgcaacatttttcaaaataaaggatggcgttttctaattgtctagttaaaaaaaaaatctaagtctgaatccccagagaagaaacctgagtttaaatcattaacaccacaaatctctgataattgtggcatgtttgcaagtgccttaatcaggatggtatgtcttagtggcctgttttaatttgatcacactgattaagcttctgtaagctaatatacgttgcatttccaattcaattaaatgagaatctcctggccttactagatattaccaaaatgccctgatgggtgaacactagacttggtattttcaattgctaccgactttctgattatataatctttgtattaaatgaaatcgatgaaagctcaaattaaattcagcaaactttaaggagtaaatatgttttccctgtatttttggcatactttcacctcaaggtgtggagcatgttagtcggaactcattgattacctttagtgataaattttatagggctctctcccccgtataccaattcctagaacagtctatcctgttagaaggcactgtaaatgtgggtgatgaataggcactctctctattatatatgtattatagttgtgcctttttcagctgtagataagagctatcttatgtaaatgtgattgctttgtaaatgtaaatgcctattgggtcatcgatcatcttggagatagaagaaacagaacaatagggggaggtgtgagagaaactgtctagggacagaaatgaagaaaattgctaagtgggtaacagattgaatcattagagctggagaactttgtggaggtggctaggatggaaacagcagccgcgaaactactggaagcctggcttgtgcctgcagagccctccaaaaggcttgcttccttgaggttctgaggactgactgctaaatgagaaatgggcctcttcagtgtaggtttgaagcaggaaggaactgaaaagaaaagcccaacttcattgttaggtgagcactgtgggtgcctgtcgtttgcctgcgcataacaggtttggaatctctcaaatccttcccactctcaacaacccacacaagttgtgagagtactacctaaaaacagccccttggtgtgccagtcatatgccaccccctggaggaggagggtactgaataatacctactgctgctgattcccatgccctagcagttctctcaattttttgggtggtatcaggaggcaggcaggcccagcagtgaactcaggaaccatcagggtgaaagtgcctctggaattttctcacaatctgttaggccctttttatggagtctggttttcaaaacctgctataagccaaatgtgtgactcacagagtaataaaggcctctaaatcaatttgtaagacatcttgaagttaaacaagaaggaaaggctgtttttgccccacatatttttttagatcctgcctacttccacaaaggatttgagatgacttccaaagcctttcttactcatgcctaagagtatttaagaactatttctgaaagttgaatccatgtgtaccatataaatagaggagaatgattatatggaaacacaaacagattggggctctctcactttatacaatagatcaactctggggaagtggttaaatgagggaagtatttggggcacttgctccagtcttcccttggttgtccttttacttccttctcccagcatctgcactctccaagtattgcctgcccttccaagcaaaacttccctgtcttgtattccatacctgcaaggaactttatttactttctaataaactctgctaataaatatgaaatagtgagtactagaggcttaatacatatgttagttgttctaatgttcaaaggaattcctacaatggtaggagagaaatttgaggccagaaataatgccattaagcatttatcccagctgggcatggtggctcacgcctgaactccaacactttgggaggccaaggtgggaggataatttgagaccaggagttcaagacaagcctgggcaacatagtgagacccctatctctaaaaaaaattgttttaaattagtcaggtgtggtgacatgtgcctgtagtcatagccacttgggaagctaagatgcaagaatcaggagtttgagtctgcagtgagctatggtcacaccactgcactccagcctgggcgatagagtgagacctcatctcttaaaacaaaacaaaaaagaagagagagagagagagagagagagagagagatccctcctatggatttaataatcatatcctgcattggggcaggggtgggttgaggtggaaaagggggtgtgaaagccatattatagagatgggcaccaagaccgagttttaaggaaagaaaaagaggccaagaaggatcactgaggaccccaaaggcaaacttggctgccttagaattttgctggggctgaggactctctggtttaaaaataaatatgaaagcaaagatattaaaggcaaagcacaaggatttacagagaaaatgagcagactgatttttagttgaaagatgtccacaatttatcactaagttattggtccaagctcatattccatcctatcactgttctcctgcacagtgacctccatactctaagcaaaccaaacttcctgagccgcacattgccaccccataccttggctcatactgttctctccagacacatttcctgctctacctctttgtccaaataggactgacttctcaagacttcattcctcctgatgttcaacagctgaagcagccataccttcctctgaacctccggaatgggttttctggacttctcttaggggacgctgttcatctggctttatcatgtatattcatgtccaagtcttctcttcccttcaaggctgcagacatcttggaaggagggcaagtcctctttatatctttactcctctcttcccatggactgagctggcccagaatcttgaaaaatagccaaccactgataaatgctttctagttaagagttcagactctggagtcaggaagttctggcagcaagcctcagcttgtgtttattacttcacctctctaagtcttggtttcctcatctgtaatcacctacttcggagttgtgttttttttttttttttagatagagtctcgctctgtcacccaggctggagtgcagtggcatgatctaggcttactgcaacctccgcctcctgggttcaagagattctcctgcctcagcctcccaagtagctgggattacaggtggccgccactgcgcccagctaatttttgtatttttagtagacacaaggtttcaccatattggccaggctggtctcgaactcctgacctcaggtgatccacctgcttcagcctctcaaaatactgggattacaggcgtgagccaccatgcccagcctggagttgtgatttttcaatgagataacccatgtagaatgcttagcatggtgcaagacacatggtatacattccacaattatttgttattgataccatttttcccttaaggaaaggtgcagtcttctctggctccctgtggcaataatccaactgagccattattccagaaggaaatcacattagggggcttttgggcaagggtttgctaaatgccctgactcacactatgtctacagtgacatttaccccatcaaaatgcagggaaagacaggaactggtttcaacttgaattcgatatttctgtggcccacatgctgaatgccaccaaagcctccactcccagagcagcagtttgtagagatggaatagtggcagtttttcattttccagagtccactcatccttccaagaatctcaatgcctcattgattcataatacagtgcataaagatttcatttttcctgcccacagtgatacattatggaggcaatctgttttgccactgaaaagtttgcttagtagaaaaatttggagttttgacattcaggaaattacagtcatctgtaaaacacgattgatatgccgaggctaacattttcattgcacttgcagagccagaataactatgataaaatatgtgttaccccacacacatttcaggatcttttagaaacattagctctgagaacctcctcccagggctccaggactagaatagctatccccattagttgtttgtttgccactcacaaggataatatctccattgacccaaccaagaatcagactgtaagacaaagtgatggctttcccgtaccaccaggttaaaggcatgaaagaaagtaaaaagatagagagataaagaattccaccccgttttggaattgttaaccagccacaaaaagcgcaggtataggttaggtagaactagaagctgaaggcttacaaaagagaaattagactgttctacatctgcctacaatttaaacttgttctctgtatttttacacccaaccttttttttttttttttttgtctctttccacatgcaattttcagtgttaaatgacatcaaaagcctagggctccggaactatccacttgttcaaaatttgatttcagaatgataaatacagttgttttagctgagagatgtagttgatttccactggcatactgagaaagtggtccattcagggtcagatttggccaggttgtgagcacttttcacttggtcctcatgcactgggacccacgggaagtgcacaaagtctgtggttccaaggcaaatgacaggtaccactgcttttgactttggaagtggcttagagtgaaccccattcagctctgggacagcttcttcaggcactgagaacacattctgcccaaagtgtgtaagtctgactcatgaatcaagcagtttttagaggtgtcattgaagtcctgcatgcaaccctatgcaaacaattattgccagtgcttactgaccttatattatgtgtcaaacacaattctaagtattaattcatttagttattacagccactctatgaggcaagtgatagaattatcatcttcactttatgaagaaactgaagcacagagtctgagcatctctcccaaagtcacactgctatctcataagaggtagagctggattcaaatcctcaacagaatggctgcagagctcatgctcatgatctatattatattgccttgcataaagaaattttataaaagccctctgttgtcagacatgctgcctggattatctcacaagtgccccatgcccatggtaggaaggctttcttgtcctcctaaaacacttggccaaacttcactctcctcctgtcccatggttaagcctcttgcatccaacaacttggcttcattcatttcctaccagtgtttgcacagatgctagaggagcaagaataaagccaatgggtatagggaggagaggagatggatgccaaagacacacttgggcaaagaccatgcctgcctaggagttttgggactctccagcaggggaataaggggaaaagtgatttcccagaggcatgttgaggattcacttgcttgtccccaggctgaagctttgggggtacccatattcagctttctctcctgctgctcacctctgggccttatttcagctgatctggccactgacaagggaaactaagagacagtggagcaaagaggactcatcagaatacaatgaggggacatagaggctggaggggtggagaagatagagggggagaaaggggagttatggcgtcaggacaggaaaaaaagatgaagagagaatggcaaaacaaccaggaggaggaggaagtcactgaaaaagaagaggggatgcacacagcatgaggtgggatgtggagaagactgagagaggaaggaaactgaggggaaaggctgatggagatgttctctctcctcacttctgtgatctcagtcctgtccatatgggcagtctgatatggtttggctgtgtccccactcaaatctcatcttgaattgtagctcccaaaatccccatacgtcgtgggagggacccagcagcaggtaattgaatcacaggggtgggttttccatgctgttcttgtgatagtgaataaatctcacaagatctgatggttttataaagggcagtccccctgcacacactgtcttgcctgctgccatggaaaacatgcctttgctcctcctttgccttccgccatgactgtgaggcctcctcagacatgtggaactgtgagtccattaaacctcttttctttataaattacccagtctcgggtatgtctttatcagcagcatgggaatggactaatacactctcctcaccaccagtagtcttccttgactgcctgctgggcaccactgaaaggctcttacgttgcacggtgttccaactagatggccttgctcttttccttctgtgagctccaggtacacttagagatgaggcctgtcttcttgtcctgaatttggacacatgacttttttttttttttttttttttaagagacagggtcttgctctgttattcagactagagtgcagagctgctatcatggctcactgcagcctcaacctcctgggctcaagtggtcctcccacttcagcgtcccaagtatcagggactacaggcacatgccaccacacctagcaggagggatatcttagaggtcatttagtccctcccccatgcaaatgaccaataagtcttcattgcttttgaccccgtactccttatctcctatcatcccctacgcacaggaggcagattcttaaaccaaaggaataaactttacattgtggattgctggccaactgtgttggggaggggctgtgcttcccagcactcctgaacttatgccaccccacaaggctggccctggttgcctgtcccattatggtgttgtagaaagctctccgctgtcatgcaaattaccttttaaaataaaatgaacaaagtggcatggggtagaaaaatgagtctggatatctagacttgggtttaaaacatatgtaacttgatgacttactggctgtgtgacctttcacctctctgtgcactaatatcagtgtctatgaaatggactggaactgtctatttctcagtcatggtgtaaggctctatgaagaagaagatgtgttttgttaaaaataaatatatatttgctataaagaactttttagaagtagaagagaaagagggtgctattcctttcaaaagatttggaataatagctctttaatccttgaaaatgaactgagaaatataaatacttatgattatttaaaaacctcaaaggtgacctgctcatcacctgaactgtgcttggtatgctgaaatgcagcaatgccagtctcccaaaaatgtacctgcccatatttcaactgtcagcacattctttccaccacgtagaaggtgaaggtcgacatgttctccctgcgtgcatttctagtaacaccttaactcatgaatgttaaatggaaggaggtgggataggggaacaacaggacttcaaaaatagccttggggaaatcaaatcttgctttaacttagtgtgttcatgaccgattcatggctctgaaaaggaaaaagtgtttgatcaaaactgtcaccaaaagacctcattttaaattcctctactttctttgagcagaaaggaataggtatcctgattatgactattgaagcaggctttacctgtgcataatagctggtctcctatattctgtgatttttggatggcctcctgccccatagaacttgccctactgctgcctgaaattctaccataagagggcatagcattgccccttaggggctgcccctttaaaatggaaatgcttctggtggtgctaagtacatgacactttgacaaaatgagtttttctaatgactttccttctaggtctcagattttgaacagactaagcccagagagagagtccagtgggggaaaggctggaagaagggggaggtgtaggaggaggaatggagaagcttggagggccgaggtctcccagctacaacaaaggaccaaagaaatagtaactaaggatgggatttcaggcctcagtggggtacatttggaggagaaggggcctcctttacccttacaagttgtattgtgggtgcagcagtctctcctgactggggaaatgccaacctggggacctgaggcactgcaccagccagaggtggagtcactttgggactcgtttcagggcctgtgtagtttaggggacaatgccctttgtttctgattggtgggaggaggaactgatgtgcagtgggatgggagaggataaaatggagcatcctgggtgatttcaaggcttcatgctagaaggctcatcaattaacccaccagtctgagttcccataaggtgctgggccctgtgttgagagacaggagagatatcaaatagtttggctcttaaggaatgtctagcctggtttgcaagacaaaataagagaaatggagtatgcagccatttatttgaggcttaatgtgcaacagagaaaacatgggggaaacactgaattgggagttaggaaacctgggttctggtcctagacccactgctgaccaactatatatccttgggaaagttgcctcctttgtttgaggttcagtttccttagctgcaaaatgggaattttatatcttgtcctgtatacttcataggattgagtgagaaactaactttataaaaacagtggaaaccttttcaaatttctcattgtgattaatcagccctccctccctcactcctatcttcccactttccctttttctgtccttccctccttccctccctcccccctttcttcctcccttccttccctctttctgtcctttctctctccctcgctccttcccatcttccttctttccttccttccttctctcaggcactgatatcaatgaattttcttcagatgacttttctgaaaaactattttgagaagggcaatgtcgtttagagtaattatctctggccttaaatccactttgcagtgagtcactatttctgagaattaagctcaattccagacaaaaaagcccaagccaggagggaaagctctgtaggtggctcacgcagcacgcaagcagatctctcttctcattgacatgtcctcacagtaaatgatgacttgaagaatctaagggaggttctgccctctagcatttgccttagttggaaagtcagggtcaggcatctgtcttaatgtgagcattgactttgagtccttttttatgggtttaaagtcttgcagtaaagaataagtgaacgtcaaccaaatagaggggttgcctttgcctaaagccgattcctgttcattggtcatcttaagggtgatattcaggaaagtgaacaaggagtcagagacttggttttgggtcccttctgtgccataaactggccaaatgaccctggatgagtccctatccttcacctctgggctttagcattctcattgctaaagtgattggagcaggtaacctctgagaggtctgccaaaccatctactctatgaaaaatatgagtttgtcactttcatctttcatttgtgagtggctctcattggttccattcacaggaaccttgcccttcatcggttggccagtttccacacatgggacatggctcttactcaacgagagagtaatccagagctcactgtatgcatggagggaggtgtggaacactctcaggctcccccttggttgaactgcccccaaccatgatgagtaaaatggcctcacccactttcagtgaagtaagatcccgttttgcacaagatgaggtttgtaaagtgcccctttaaaaaaaaaaagattctattctgtcaaaaattatggaatgttcatgctttcatcaaagtagagccatggcttatattttacaacacgcatagctgtctaatttcacatactgtttttctattctgtcacattttggacaaaaatgtcttttctctaggattcaggacattgcagtgtgatgtaaaattgcaatctggaggaatatactgtgcgtggagaagggatgatgagggcaactgccccgtgactccccaatactaggccactgatttcagggaaggtctcctttttgccttaaaggggaaacacagttgtccaaagtctctatgccatcaaaaagaaacctctgatgcacgaaacttatagaacgcttgtcagtttcagcattaacataaccttcaaaataattccttctgctcaatcaggatcttcatgtcttcagtcctccttcctgtacttgccccagtgtgacatcacattccttagctagagaggtgggatgggggatggatgagtttttttcaccacccagtattatcattgcaaagaaacaaggctgtgcctgttactgtatagaatgcttatttccccacacatgtagcccagccatgttattcagtaattatgccttttgcagcttgaatatctgaaggaaaaactttcccaggtgaaaggaggcatgaccctgccagcccttgaaattctgaatggcttcaattctttacagttcaaatggttaaaaagttctgttcccccacacccccccagaaaaagccagggtttgcacttcatatctctcagcaccttgaagcaatattagagctcattaaaatcaacccagggctcaagaagggaagccttcatttagggggaaaacttttcccctgtgctgctctggaaaatagcacaatgctgagagcaggcatttttcctgactaggtttcctctaacgatttctccaaagcacagttagggtacctgcctcccagacagcacatgtccagcaggcccaggtgaatgcgtgggactggctatcactagctcaaaattgccttaatatttattgacggcctaccatgtgaaaaaggcctcttacttgatttcttgtctctgtggaggtccctaaagaaatgattctgtgtgtctctggatttctcacaatctagagacatggaaagggagctggctatctggttcgggatccgtagaatacgaagtatggtctaaaatggtgtccagctatacccctgcccccaggcccctcagctctaaaatgctcagatcccagccctgcggttctgtaaggggcccacaaaaaccacagaattggatccctcatttcacatcccagcatatccaactgcctcctactcaaatgtcctgctgcattcaggccagttgtgctcctggcctgtgactcctgaggctgtgctcaggcacaaatgagaatgaacagcccagtgggtgagagcacacacattggaggctcagacacatctgtcagtgaggacacaaagaccaaatataaagaccagattttatcttcataaagactctatggttttcatgcattgtaaatgagaaaagtagaagcacagagaggttatttgcccaagatgacacagctagtaactgccagaactggaatttgaacacaggcagtctggctgtagatcagcattgtcaaatagaaatacaatgcaatggatgcacctggaggcgataaacgtaagcgaattaatgcaggaacagaaaaccaaatattgctgggtgtggtggctcatgcctgtaatcccaacactttgggaggtcgaggcgggcagatcacttgagatggtcaggagtttgagaccagcctggccaacatggtgaaacctcatctccactaaaaatacaaaaatcagctgggcattgtggtgcatgcctgtaatcccagctactcgggaggctaaggcaggagaatcacttaaacctgggaggtggaagttgcagtgagctgagatcgcaccacttcactccagcctaggagacagagcgagactgcatctccaaaaacaaacaaacaaaaacaaaaatccaagtatttcatgttctcgcttataagtgggagctaaacattgagcacacatgaacacaaacagggaaacaatagacaccatggactacttggttgggtgaggaaggggttgtgggttgaaaaactaccaattgggaactgtgctcaccacctgagtgatgggatccataccctaaacctcagcatcgtgcaatatatccatataacaagcctgcacatgtacccctgtatttgaaataaaagttgaaattcaaaaaaagaaatgtgatgcaagtcacctatgtaattttaaattttatagtatccacattaaaaatggggatacagatgaaattaattttaataatacattttatttaacccaatatatccacattattatttcaacatataatcagtataaataataattaattcatgagatattttctctacctctaagtcttggaaatcttagtatgcttgaaaacttaaatcacttcttagttcagactagccacatttcaagagctcagtagtcacatgttgctgatggctaccatattggacagtgcagctctagaacaagcccttttcatgatatacactgtgactaaaatgaaggcattaacacctatttgataggttttctgaaaaagcttctagcctagtgtctgacatactgtaggcacctgttaaatcaaaacatctattagtttcctgtgtgttttgctctttgctgatgtcagaatgccgtccacccaccccaccaccatacacgcacctagtcaaatcctttttgtccttcagaatccatcatattcctcctcttctatgaagccttccttgatgaccataatacagtcaactctcttctccccactcatttctcacttaatctctgtatgacacaattagcactgaaatatactgtgcctctatctgcccccgccccctccaattctaagcccgttgaaagctggcacccgtatacatgcaacttcctcaccatgcctacagctctaattatggcgacttctaggtcagagttgatacgttgttcatggattgattaaacttctgtcttgcaacccaaggccaagcccctcacctccagggctaaaagggcactatgtaccctctttgcacatgcctgtttctggattgagtttcatgaaagtaccagttttattactttttagttaagacctgaaacatgcagggttttatgtggatgtactaatcaatcaaaaggcaggaccaaagcaatggattcctgggacaagaggcactagggatgtttatctgaagagcaaaccatgatagtcccagtggggacacttagaaatttccccaacctcctcccatccactgtggcatggagcttatgattcttcccctctgtgcactcttgtttcagggttgggagaaggaagagaaccaacccctagctctggcagttccagatgccaatcctcaagggatggcaatttgacagaagatgtcacatagaaacactcagtaagctgagaagttccatatgtggagggaggagttcctagaaggaaagtcaggcaggaagcttgagtgtgttaatcagtggcagatctggtctccatgtgacttgggcagatcatatcccttcatgggaccccagtcccctaatctgcatgctgtagggtattttcataaaagtttcttccacctcaagaatacactgactattaatgaaccaagactcacaaaataattttagaatgcaaaaaattgggagaaaggcagtgtaatctacaaaatttttcatgatgtcaagcaattggatggattctgggtaaaggcctgcaactatgggtcataaagtttggaatttcacatcttgttaaagaactcagctttttcactatttgcaaaagcccttagagttatgtactttgaaacctactgggctttgggaaaaaggagagtgatttcttttaaaaagaagtaaatatcaccaggactcattgtgtgaagaattccaccttgagtttgaattcaaaggcattagaaatcttctttattttcaacaaaggaaaaaaatttctgctttgttaaagaaaaagaatcgcatagaaaaacatccttctgtttaatgaaagcccatttgtgctcctttgagcactccccacaatacacacagatgggtttacttttagttaatcagaggaaaagaatcaatgaatgaaggtgttactttatatacacagaactggtcctttgggtgaggtatgaagaagagcagaaaactccttcaaggagaactaatagcatgtttggtgggtgcaagaccttcagcctcttcagatttggttttgtgtctggtagatcttttgtctaataagtcttgcttgtctcatggatcactgtgctcccaagagttcaccttgctccccacctcctgtgggtagcccagaaagtctggctaagtcagcagcccacagcatgaacttcaaggggaaaggaagaggttcagcatccagatcatttaggtctttctagtgttgtgaagacaattaaatgaagtcatgtgtcacactgctctatgtaacccactgtctgcaaatgcaacagctcactcttctcactaggtaaagcatgactactaagccataaaacttgtgacaaatgtgccaaaaacaacacatctacaggcacgtctgtctgcttcaaagtagtccccttgtgaagtcccacacttcttttatgagactgctgccactgctgataacagcatttattaaactcctgtttggggactactaatatgagctacacaagaaaagcacttaaaacagcacctccagggcttaaggggtccagctccatcagaagcatgtttgcctttgattcaatttaccatacttttatttagtttgtgctcacatattaatattgtttgatttgaacgccttcctccttgctttgacccagtcatttacatgcaatgggaggatccatgtggttgctttagacttcattagccaaggaaggagaccagaccttcaacattaatgactcagtgtcatatacaaccaccccaactattggcagagttacttaggaccaccaaccacagttctttttctaccactcattgtttctccaagaacaagatgtgcaaaggctgaacttttatatatatatataaaatattttatatatattatatataaaatattatatataatatatatataaaatattatatataatattatatataaaatattatatatatattatatataatatattatatatatattatatataaaatattatatataatattatatatataaaataatatataatattatatatataaaatattatatatataaatatataatattttatatatatattttttatatatatatagcacatatatatgctacaggtataatagaatgttcactcctattgatttgggataagaatttgtttcctttcttaaattaactttttattgatcactcctatgaccttaactgctacgggttttctggccttcttctattaaaaaatgtctttgatatttatttcccctttgagtagtgcagggaaaaccttatcatggcctttcgtgaaccagtagcctcaaaggaaagtaaatgtttacagcatgatcctcagaactttgctcaagtaacattccctggactttcccttgatggaaatgggtgcccccagggtttctccaaggggtagagagaagatagggcttgcatccgggggcacagttggcttgtctacactctagataccacctgggatttctgagagacttctgatctctgaagccacatgcctaggacagtgattctcaaactcaactgtgtgtatatcagaatttctggatgggcttcccaaaatgcagattggcaagccccagcctctgagtttcagattcagtgagtggacctgagagtgtgcatttctaacaagttcctaaatgatgctgatgctgatggttctgggctcacactttaggaaccacttttttagttaactcatagaattagaagtcctgggcttgtgccctagcaccaggatggaaagaataccatttctagagtgagagagacctggattgaagcctgaacacacctacttaacttgaggcgtgacccagagtcacatcatctctgagtctcagtttcttcattctggaaaagggaataataatatatgattcacaggattgttgggagttaacgtataagtgtcaggcacagagcacccccagttcctggctatgtagttggtgtaagaaagtgtcctctttgagcagccaaatgtttacccttcatgggggttagtgagttctttcaggcctggttgagtgtgccatcctaggtaactagcagacacaaagagggtctgctaaaataacaggacttcggcccagaaatagttctctcaggtagattgattctcaagggctactggcaaggtgtgatttggggacaagtccttgcctgtctctctctgggcctcagtatccccacctttaaagtgaagggtttgacctaaatgatttactgtctcaaaggtttcctcctgttctgacgagtgtaggactctgtgacttagaacttgggcacttatttcagaatggtctattaaaaggagaataaaaaataagattcttgtttttaaccatttagttatttttaacgtccttaaactttccagccttcttttaaactgggatactgcacaaaaagtcagggacaacagctaaatataacaatgtccttcacagctacatctccttaaaatgctccattacaggtataaaatggtatatctgttatttcatagtgacatctagtggcttttccttatcaaagaataagatacgcattttcctatttgctcatcataagctctgctgcttctcctgcagaaattcattcaacaatcttttattaattgcttactttatgtcaaacattgtgctaggccctgaggatagatacatggttcttaccctcccagagctcatagtccagcggaagaggcagaaaaatcgcttgacaatcccagcacattgtgatacatgttacaatgggagaacaccagggcgtctggagcagagaagggggtgcttaactccatccagggaggtcaaggaaggtttcgcggaggagacagtctttgagttgagttttgaaagactttgccaggtaacctacaaaggataaatagaagccattcaaaagagtgggcactccatatacagaggcaaagcacctgtggagtcactgcctgggactttgatttggaaaattcagcatatagggtatagagcaaggttcctcaaccttggcattattggcatctgaggcagggtatttctttgttgtagggggactgtgcatgataggatatttagcaacatccctggacttgacttactagatgccagtaccaaccccctccccaagtcattacaaccaaaatatccccagatattgccaagtggcccagagttgggggtttggggagtggagatggaagatcactcacaattgagaaagacttgtatagagggagctcacttgagaaggctggacagaaagaaaggtggttgctggattccacaaggctgtctgtagcatgtggaggagcttggcttcatgtcatagttgatagggagccattgggagggcttaattagggaatgacaggtcaggtatgtgccatctgggggtgtggaagtggcatgggactggagacctgaagagtaggacgggatgctactgcaatgttttagtagagaagtgatgaaggcctgaccccaggcagtggtgcaaaggatggatttcagagctattagaaactggaaaggacttaagcgaatgtttagctcttagtagtgaggggagattagaggagtcaaggatggccctttggtttcttgcttggacaactctttcatttgttgctattatttcgacaattgcttatcagtgacaggaaaaagttggcctaaacttgtagacacaaagcaggttcactgtgcattgtttataaacttctatgggtttggtgagacagaacacactcataagcaacaagttacatgaagtgggtttattacttacagataggcagcaagggacaaaagaagcctaggatccactgtgagatggtttcccaagactcaagaaagctgcctgggtgaatgagtctcgattaagcatgcctcacttgcaccatagctgagagaccccaaaaggcagcctttcctgagttatatacctcaggggccatgtgactcatttagcaaagctttgaaggacatcctgcttctgagagaaaggaacaaaggctgggctgtcccaggcagttcctccctatctcaagatgttagattctccaggaaggactggaacaaggcttttgctgtttcaggcagttcctccctatctcaggatactgcactcccagcacattctacagttattcttaagaatgacaagcaagaatgaggggagtattgtgttggtccaaggccacccagagaactgtcattcagtagaaggtggtaaacctttaactgtgtagtgcctgtaaagtcaccatgggcatacagaagcaccaatcagccattcaattaacccatgtaacccaatggggagtcatggctccaatttaaaaatgtgacaccttgtcattttaattaggtgatacatttggtcacaagaaagtcctgtccaattactactaagtgaaacaggtggcgtatgattttcctggggctgaactggcctcattcagttaaaattcagtcagtccattcagcggcacccttcagtttcatgtcaacctgaagaaagatttccagcaactatcagagacttgctctcacctgcatcttgctctgttttgatcaatgcctgaatccaggcattgccaacaggaacaggaaagtatggtgaagatattgggggatataatcagaatgtagatgtcttttgacaggcttagatttcctccatcaagaagagattaaacagggccacaaatacactgcatcagttcctgacaatatagattgcgttccagcgtggcatatatgtgaaagtatgaaacaattgagcttactgtgtatcagtggtgtggtgtggccgccaaaatggtccatgtgatctgaggccacattaagagaaatggtgtcaagaatgaggaaggtgataggctgtcccttcttgttgcttgtcagatcgtgcttagcaggccatgttccaataaagtggaatgcacttgcaggcagacaacaggatagcggggccttgaagctatatagagaatagttgaaaaccatttttagcataaagaagagaagccctggggtaaatgctgtcttcgaatatctgaagccacacaagtggaattttaaaaaggtccctaaatagaccatgatggtctggaaattaccactttgtgctgaccactccgtaccttatcttcagcccaggttgctctctgagtgccagatctgttcattcaactctactcagatgtcccgcaggcacctcagtccttcctccagagctctaggaggcatccttaagtcctcctcctctttctcccccgaatcccttttgtcacttttacccgctaaatatttctctagtctgctcctccttctcttttgccttgtcttctgcagtggcctcttaactaacttcacgaatttcatcttcatatacataatgatctttctaaaacacagacctcatcatgtcattcccctgcttaaagcccttcaaagcctctctgttgcctgcagaattaactttgaatgctttaatatggcatctgtggcctttcacaaccaggtcctgggctccctctccatcttcaattcctgccactactccttcactccccgggaggttttttgatgcacgtttctcttgcacaataggctggtttatgcctctgtgcctctgctcatgctgatccttctgtctcatactcctttcctctctccttgactcatttttttttttttttttttgagatggagtctcacactctgtcacccaggctggagtgcagtggtgataccatggtgcactgcagcttctacctcctaggctcaagtgatcctctcgcctcagcctccctagtagctgagactacaggtgtgcaccaccacgcccactaatttttctattttttgcagagacagggtttcaccatgttgttcaggctggtcttgaactattgggttcaagtgatctgcccaccttggcctcccaaagtgctggaattacaggtgtgagccaccgtgcccagttgcctcatctaattcttgtttttcaaaataaagctgcagaaacccttgtcttatctttaggctaggttagaaatcagtgtgaggtgtttttttttaatcataccctgcacttgctccaagcattcatggcacacacaattgaaacactttccccgggtttccatgtcttatccctgtctgtatccccagtgcctgccatagtgccaggcacacattaggtgccaagactaagcaagtcttgacctgacctgaccactgagggaaaactggccatgtctctgtttgcccccgaccccagctgcattccccagcgtgcttctctgatattgccctaaaagctcttccttggatataatgagcatcctggattctttttctgacataacctccaaggtgttatctttacctgccttcctacttccaacacaccatgaaattcaggagacccctggaccctggacacctacccttcagcagatctttctttctttctacacatggaatatttctaagcagcatcaagtgctttcagttgaggcattctgggtccccaaggctatttgccctggaagaagggggctgttgacactcactgaatctctgcaggttttgtcatatgagtctaggtggctgttatcaccaaggcagcagtgtgtgtatgtgtgtgcccctctaacttctctgctgcagtgaaaatccctacagtgtagacactgaggctgcctacgttgggctgtccgtatttcttaagggcactaggtgaccttcaagttgaatgcatactggatccacacacccacaacatgagagaccctctctgaaagtctgtctctgtgttgccttctctctatccatgttggggtaggggtggtgcttatgaaacattgattgtgtcattaaccctggtggttgggatgtatttgctctgaaaggctaggaacaatgtttaggaaggagagctgcagacttccactgtggtgcactcttaatatttaccagaagatgtcactgtaggcttaaaccaatacaagaagttagggcaagaagacttccagctaagcatgaaggtgactccattttggggggttagaacaccgagcagcccccattacaatgcatgcctggaaaagctggttgaaaggttaatccaaatgtgtcacagaccttaataaatttctttttttttttttccaaataatcagactaattgccactaaactgttgcctcagggctagcataaaggctcaataagtatgcactgaatggatgagtactaaagctaggagtggaaggagggaacccagggctttagtagtcatctttgttggtaaaggctactggagaacaaaagctgctactctttagcagtggcttctcatagagatgaattttagtggcaccaacaagatcaggtcctagggaaagtagtgagacaagtgaaagtgctcttggccccttttccatcctcactcccagatgcttctcctgtgcccaatgcttgtttcttcctgaaaaaatatataaagtgatttattttaagaaaaaccttcctgtgattttttgcaaggcacttagaagattatccagagtttttatgtcatgaggcatgtccctagctctctccttcctcttccccaggatagttcatcaagtaagcagttaaagaagttactgagattctgctttatgccagggatgaaggccaatgtacaaagctggaatggatgggatgagggctatatagaagaataggacagagcccctgtccttgaaaacatagtttaagtggaaatataaacaattaattgtaattcagtatcacacatttttgggggaggcagtggggtggaggggtagggtctcactctattgctcaggctgaaatgcagtggcacaaccacagctcactgcaacctccgtctcctgggttcaagtgattctcgtgcctcagcctcctgagtagctaggattacgggagcgcacaaccacacctggctaatttttgtatttttaacagatggggtttcaccgtgttgtccaggctggtctcaaactccttacctcaagcaacccacccacctcagcctcccaaactgctgggattacaggcatgagccaccgtgcccagccccagtatcacaaatattttaacaaaggctaagtatagaagtgctatggcaacacagaggaagaaatgataactggcaacacagagtggggtacattttttcacaaaagagatggtacttgaactggtattgaaggatgagtagaattttccagccaaagagggaagatcatggcaggcagagcaagcaccatgtacaggatagaggcataggagatagatttcaggatgcctgaggtgatggaagccccagttgggagaaacgtttcctcaatgaacatcagccaatattcagttaagcaggtggctgagcaggttccctgtggctcctcatgtatgtgtagagaacaaccactccctcagatgggaatgaatatttcagaaaagttgcaagccattctccgggtttcctttaagaagctaaatgctaatattcaatgtttattgttgctttctttccacaatatgcccttctgtggcctcgtccttcatcttctgtacctgagtggtaacccatttctcatgaaaagcacaatgacacggttctctccttaagtatgcctgattgtatcatggacttgatgtttctggggcgtgtgcctaccatgtatggtgtgagtgtgttaacatgtggtttaaatgtttgctagtctgctatttgagcaaagaactttgtttgaagccctaaagagaagacagccatacagcaaagcctccacacttgctgacatccacgtgcccttttagtagataaggaaaagggacattttgaagctgctgatagagttaagtttcctatcctgggaatattatcataggagcaaaggtggaaaccaaggtagtagcttgcatacatgccattggcagctaccatgtctatttcagtcagtgactaaccacagcgtttattgctggaggccctgggctactctgcctatctctacattccacttccataatgtatgagccataatatgacaacagccagaatcaagagtatcatatcatacactcttttaatgagttttttaaaaacaaaaagatatgcagattagactggatattagaaaaaatgctattgcatatttaataagattcgaatttgaacccacttgtcaactccatttcactccaataaagtatgtgcttccaatgagtctccatttcatgatcactaaatggtttagagtggggggcatgaaataaagtggttgcctagttagccaatggtgtcattgggaagattttgtctttggttagagagggagaaaaagaggggaagggggaacgaacgggagtgaagcatgacaaggtcaatgtctggaatctaaccttttcatacctgttttagctgaagtatcagcaaattggttgaaaaaattagctatctctaggctagtgagactcagagaggggactgcagtacagtttacaggacaaatgccatcagatccctgtcatttttgctttgccttcctttttagccagtgaacaccacatatgccatgtacctccatgactccacttatttcgcccatatctctgactgttggtttttgtgcttcatccataggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagac

SEQ ID NO: 5045 - DNA, 331320 bp, human
ccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcgggacccgggcctaggcgggcggagggctgggaggcgcggctggcccaagccggggacctagcgcgcaccctgacgcccgggcgtttgcaccccggctgggcaggtgctgggcgcccagtagcgcacgttcgccgcgctgtggcggccacagaaaggctttccgctccggccccggactgaccgtctgtctgtccgcagggtggcctgcgtgatggttggcagagcgtgcgggggaggcggccgagcggccggaacggggccgctgggacggggcatcgtactcagtctccgcactggagagccctaaagagccgcgctctccgtgcagcgtctctggatccctgctttcttctactctgcacccgggttccgaagtctcctttcagcgctctcttcctcctttcggcgcccgcattcttccctccccccgctttcccccctatttcgtctatttgccttgttctccctctttctctcttgtgtcctagatgttgtctgctcctgtttgctcgctgtttccttctttccattcccctctctcgcttttattctttttctctcttaccctttctgtttttctcttcttgccggacttttatcacctcgctccttccccgctctggctctggtcttcccgggcgactgggtgtccctctgtcgctattttccgacatccaaggagagctcatggttcccaggcttgcttatcactactggctgcatgagaggcatccgtggctctttgggagtggcggggggcaccccgcggaccgaagggcgggctgggatggtgccctggaccccatgtggggttcagtcaccaggagcctctcctgatttacaaaaaatatttaaaaagcttgagccccagcatggggcgctgccagcccatgttctgtgagcctgggctgatgcggtaaaagctgatttattaatagtctgtagccagaagcaagggtattttcctccctccagacgcgatgtccagttgctagaggtcatgcagtactgtaaagtgggtggtggtggggtgggggaagtgagtgctatggggtgcagttagtccagccagggctactgtttcgcaagtctccttaaaacaaatctgggctgaagcagggagtccagggggtgcacaaggtgagtttcatggcctggaggcctctggatggggtctctgggccggcaaggacatgtctgtgtcccatccccatcccccgggtgcacttggtaccctggacaaggggatgctttgcaggtgactgttagaacgcaacaaccagtgtggatttttctgtccaactgcagcaaatagagccctagagccctctgactttcagattaccattgagatttaaggggaacatcaccccctggctctcctcttcactctctcttctctcagtttacactgtcctttctcaaatgctggaattgtgtcagaatctgccaaacttgtatttcctttccaatactaacaaattttttcttccaccccaagaaaaccttagccccaggacctcaatccattggtacaattgtgtaagtcattgtcacaacaatattctggtgtttaataagttcccaaacaatttggcaatattgaaaagaatttctcatactgacagaccttgtaggtgtattgagaggtggtaatatttaaaaagctcttctgggcaaaagtagaattccacagccatgactatagcagagaagtgaaaacaaggtcttggtcaccatgaaagccatggccttgtctggagttccatggggcacatgtgcctttactgatccttttgaacatgtaggtcagagtatgatgtctataaacacacattattaatgtggtctagattatctgtttggtggctactgtcctctggcagattccttcccgcattctccagaagataaccagaacccctcaaagcctcttggattgtcccaaattgaagcaaaattatttgaaatgacataggattttcttggttattaaaagggtgatactacagtagcatctagtctaatcaaagagcaaccatgttctaaaaagtcacagttactggattttacggtgtttgcaaaaatgaaataaaacttgctagagaaatgcattgctacctcaagggcacctttttatttcattcattcctgcccacctccagaaatattcactttgaagaatagggatagcctaggggttccagaatttctctggatgttgacagatcccctaggaggttgcaggaccagttctgtgagttctgataatctgtaagagctaaggtgtgcatgtgtgtgtgagaatgagagagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctttaaaaaaaatcagaaattggatttcatccatctgtctgccagtatgttgtttgcagtcactcagggtcctgctcattttagaatttctgagaccatttttgaaagtgtatccaaacattgttgctcacaagctgttaaaagtcccaaattctgcaggcttttcttaggccaaatttcctctgtttgtagccaactctagtgtgccatttgttctgtagagggaattcagaactgggcccaaagaaatagcactagcccccttcttcatcactaagtatcatgctggccagcatgcacagaatggggttgagaggtcagggtccatggctatacaagtcaaagaatctgatcatattcatgttgtaccctagacttttagcatctctaaaattttcagtttggatgagtgattgggccgggggtaccacacccattgggagaagaacagatttctacatccctgaggtgttttattcaccaggggtaggtcttgtggctagattgcagaggggcctttcattgccatattgggaatccctgcaaagctgagcaggatgggagcaggctgaggcatctggaagagtaattaattatcatctcaaatccagtagcatatcattgatgggaaaggactaaaaagtgtttgtttagatggagaaaagctttttttggtcattctatttttttttaattgtgggaaaagctttcttttattcccatttgtttttaaaaggtggctctattttgaaagagctgtaactatagagtgtgtgtacctgatcatgcctcacaagcccacgctttccctctttcttctccttgattttgcagtgaggcaaaatgacacaacaggcttgtgatataggctgaggcattaagcagaatggactgttacagccagtggtcagtactggtcgtgtggttcatcaggctctaagctgttgggctcagttttacttagctgaggatacatttcttcagctgtctttgagagctgtggtaccatcttagctatttcatagaagagggggagaaatctaccattacaatatctgtagaattccagtagtattaattagcatctttgcatggatgtcgaacatggtgttggagtccttacaaagctgtaagttctcaggtagtacaaaaggctattcagaattaacatcacttaataataattttagatcagtgctatggggcaattaaaatgctagagcttgtctttcatggatatcagtcatcaactgaggtagtatgtaatgacattaaaagaatagccatccgtttttttctgtcattcattaagcaagattttgtgaaactgttcattatattccagggaagagacatcattctctgtctcacagagcttatggtagaacagaacaatttagtactttagatatttaattaaaaaatggattttgtttgaaaacaatttgaaaatcaataatgtctttaaaatgtcatacatttaccagaatatacaaaaaatagacaaaagtccatctgttatgttgtagtttgggtctaatcggcaaagcagatggagtaactattatgtctctggcatggtgctagcagttgtggggagattagagccaagaagaaaccaaaaaagccaagataaccatcttcagcctcaagtccataaagattagcatgtgaagtgcaggactatgtcatgtagacaggtgctgggagaggaaatttagattttggacaggcccttttccttcccttggtctcagtgtcttatctataaaattggagatttaaatgacatgctttccagggccctttcctttctaaagtatgaggaacaggccagaaaaaggagacatccttttgagaaggcctctgggagtaggagagttgtattaagaagaaaggaggcattgtgggtgggcacggagtcctcatgaccttttgaggtccagcaacctcacctaggcaggtctggccagacccgaaaggttcatgcttggagtaataatggttagggaagtagatggggttaggctccactgtggaggacttgaatggcaatgaggaaccccagtaagtatgagaagctcttggatggaaagagtgcaaaaacaccatgaaagtaaataaaggtcggagtctaggtaaagctatctccctgatatctagtctggaatgtaggtggtaccagccaccaaaacagagaggttgagaaggggatctggttcgggctggagagtactaagaagtcatgactggttcctgttgcctagatttctagtggacaggacttataaggaggtgacaactggggctctggggcaggttagggctccatcgtacattatatgtgggaatctgtggacccagttaatctgaattcacaattggcgttgttatttaagtgatagctgcaattcacatatgggactcttagccaaggaaaaggatgtttgaataaaggaaaaaagatcaatagttatgattacataagaataagatatgcttatctgtcaaaaaaaagccaaaacgaaaaggtttcaaactggtaataatatgcacaattacaacagacacaaagttgaaatctttactgtacaaagaactctcacgagctgattagagaatcaaaggacatgaccagacaatttacaacataggacccccaactagtttgcagacatggaaaaactgttttatttcactggtactaaagaaatgcacatttaaacatagaatactttttttgcctctctaaccctgattaaaacaaacaaacaaacaaagcaaaacccaacatatatcaccaccaaacaaaaaaagtagacagtgctgacaagggcatggtaaatatcaaaattctcatacattgtcagtgggaatgtaacttgaatgatctttttggaaataaatagtgtaaacacagaatataaaaatatttatttctatgacccataatttcttttctgggattttgcagaaaaacatacttttatacatgctttcattcattcactcatttatttattgattcagcaaatatttattgagtatctggtatccctgtgctatgtgctggggttaccgggaagaaccaggtagatgtggtccctgccttcgtaggagtgggaaagatagacagaaaacaaattatcaattacttaaaattatatgaagtgccatgggggaaaagtacaggatgctatgagaacacatactaggagactaactggagttatcataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagagaaaaagagatagaaaattatggacccagtacgactacaattatattaaagaaaaaaagatagcgagcgagcgagcgagagaaatcatctcctacccctcccaaatctaagcataaaagacagagactggaagaaaaaaataatagaatataaatagatctattagtgatttattttcttattctgcttttctgaaggttttgagttttctttgagtctacattacttatataataacaataagcattaacaatttttaaaataatgttttactaagctgtgattaattgcacacaggtctacttttttggttcctggctggttatttcattagcctcttgatatcctgggagcctttaatgaggagagtagcctcagccctaataaaccctcaccctgaaaggcagaggtgatgagtcagacattggctgctgattttcgataactgacttttatcatattcccacacaatgcatggaactctttttataccagtatggtatagagctacttgagtgaattgctattgtttctttctcatttataaattataaattttaatttataaattatatggaacaggaagttaatagtggtacacagttggaaatataaagcttattctgctcagccagagccatccgagatagtctggactttggatctccatgagcttctttcttagtgagttgacaccagggctgatggtctggctggaagagttaaaatcttggggttggtaaagggctatagttctaaacatccataactgggagcttagatcagttagtgtatgtgttgctctcgtccagcagaaaaggagagttcactttgctaagcagcgccccctagagaagtttcactgcataagagtattacccccagttaaccataaataaagttgattagaaatgtcattgtccaactattccaatatctgagggaccactctatgcacatatagtgaggtgcataatcttattgttgaaactccactgaaactacaccgtaggtacaagttgttttgacagtgtaaagaatgtccctcacagttgaaaagctaatattaacattctgtgacacatgaaatgaggtatttagtcactgagtttaaaaagagatgtatggatgggaatttccccctttccattaaaggataatgaataatccacttaatggcgtatgtcctctaaaacagtgtccttgtaagcttagataaatatttgtctaaactttagtaaaatatttattggcaaaagagcttttctcatttactaggtattgaactttgcagattattcagttggtcttattgcatcccatttgttatttctgccattttgcctctaaaaactgtgctgaagactttgacacatttcagagcattacactaaataaatctgtcttgcacattccactgtgctttttctggaatattataaatattcaaatataggcacacacgccgattcaaaatacaatttaatacatgcaaattgtgcataaattccatatttataacttggcaatagtttcgaacttgttatcctatgatataaatgtatcaaataggagctcatgggaattatcaataaatgtatttttctgattaaactgtgggctctttttcagtcacaatttaagcttcaattctgagttatattataagagaataatttgcacttcatttactctgaattgtcaagaatcttgttcttccccaatgtaagtgtctgcaaagaggacttcttattcagtttgattgctttttaaattttactagtggagatgccctagtgagtctgagagaattggtctgtttcttatgaagagtttagttctaatgagttgcttccatgcactgttctgtgcgaatacagagcaattgaaatgtgcggtgtattgatttacctcaaatggattaggcctgtgtgcaccattccttgcattaattgactttctcccataactgtactaataactgcaaatcttcagtatagtattagcttcaatttactcataaagatccttgggtttttgctaacttactacaggagagtcaatgcaagcaagagtatttagaaattgactagggggaccaagttacatcatacaacccagaaatacttttaaagggctctttgatcatggcagccaactcttcagttattacaataaataggagttgactaaactcaccagttaagacctagattatcacaatggatgaaaataaaaaatccagctatatgctgtgtataagagacaaaggtaaaacataagaacataaagcacacaaaaaggattggaataggtacactatgcaaacactagccagaagtaaactgatgtggctatgttgatatcagacaaaacagactttaaggtagaaccattattgggcataaacagatcactgtgtaatgattaacagttcagtttttttttcagataacaattctaaacttgcatatgcttaataccataagtttgaaacgtataaagcaaaagttggcagagctaaaagcagaaattataaaatctgattttttttcagaaattgataggtaaaatgaacaaaaaatgaataaggatacagaggatttgaacaacatgattaacaaactcaatataatgggtatatatatatacacacacacatatacatatacatctaaaatacacacatacacacacatacacgcacacacacacacatatatatatataaaatctgcacccaattggaagaatacacacacaagtgcatatgaaacacttttgaaaatagaccatatactgagccctaaaattactcttgaaaaacttcagtgaatgaattatcttgtagaccatactatctgatcatatgcagtgcttagacattgggtgttgtgttaaacctgagtgcgtgtgaaggaacgttagtagtttgctatatttgtaagtattaccaatccttcaccgaccacataacatttcttaattgacatacaaaagtgaagaactccaagacttaggtagtttgacccaggtaacttggccttattttccaagaagatctattactattttggggtacctattgagacaggtcctgtgcaaggagcatattatatattttctcatttaattctcacgacaaccctctgaggtagattttttaatatatactttaagttctagggtacatgtgcacaacgtgcaggtttattacatatgtatacatgtgccatgttggtgtgctgcacccattaactcatcatttacattaggtacatctcctaatgctatccctcccgcctcccctcaccccatgacaggccccagtgtgtgatgttccccaccctgtgtccaagtgttgtcattgttcaattcccacctatgaatgagaacatgcggtgtttggttttctgtccttgggatagtttgctgagaatgatggtttccagcttcatccatgttcctacaaaggacatgaactcatcctttttatggctgcatagtattccatggcatatatgtgccaaattttcttagtccagtctatcaatgatggacatttgggttggttccaagactttgctattgtgaatagtgtcacaataaatgtgtgcatgtgtctttatagcagcatgatttataatcctttgggtatatacccagtaatgggatggctgggtcaaacggtatttctagttctagatccttgaggaatcaccacactgtcttccacaatggttgaactagtttacagacccaccaacagtgtaaaagtgttcctatttctccacatcctctccaacacctgttgtttcctgaaattttaatgatcgccattctaactggtgtgagatggtatctcattgtggttttgatttgcatttctctgaaggccagtgacgatgagcattttttcatttcttttttaattattacactttaagtgctagggtacatgtgcacaacgtgcaggtttgttacatatgtatacatgtgccatgttggtgtgctgcacccattaactcatcatttacattaggtatatctcctaatgctatccctcccccctccccccaccccacaacaatccccagtgtgtgatgccccccttcctgtgtccaagtgttcttgttgttcaattaccacctatgagtgatgtgatgtttggttttttgtccttgggatactttgctgagaatgatggtttccagcttcatccatgtccctgcaaaggacatgaactcatcattttttatggctgcatagtattccatggtgtatatgtgccacattttcttaatccagtctgtcatcattggacatttgggttggttccaggtctttgctattgtgactaatgccgcaataaatatatgtgtgcatgtgtctttatggcagcatgatttataatcctttgggtatatacccagtaatgggatggctgcgtcaaatggtatttctagttctagatccctgaggaatcgccacactgacttccacaatggttgaaccagtttacagtcccagcaacagtgtaaaagtgttcctgtttctccacatcctctccagcacctgttgtttcttgactttttaatgatcgccattctaactggtgtgagatggtatctcattgtggttttgatttgcatttctctgatggccagtgatgatgagcattttttcatgtgtcttttggctgcataaatgtcttcttttaagaagtgcctgttcatatcctttgcccacttgttgatgggtttgtttgtttttttcttgtaaatctgtttgagttctttgtagattctggatattagccctttgtcagatggctagattgcaaaaattttcccccattctgtaggttgcctgttcactctgatggtagtttcttttgctgtgcagacgctcttgagtttaattagatatcatttgtgaattttggcttttgttgtcattgcttttggtgttttagacatgaagtccttgcccatgcctatgtcctgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggcagcagtaccatgctgttttggttactgtagccttgtagtatagtttgaagtcaggtagcgtgatgcctccagctttgttcttttggcttaggattgacttggcaatgtgagctcttttttggttccatatgaactttaaagtagttttttccaattctgtgaagaaagtcattggtagcttgatggggatggcattgaatctataaattaccttgggcagtacggccgttttcacaatattgattcttcctatccatgagcatggaatgttcttccatttgtttgtgtcctcttgtttcatcgagcagtggtttgtagttctccttgaagaggtccttcacttcccttgtaagttggattcctaggtattttattctctttgaggcagttgtgaatgggagttcactcatgatttggctctctgtatgttattggtgtataagaatgcttgtgatttttgcacattgattttgtatcctgagactttgctgaagttgcttatcagcttaaggaggttttgggctgagacgatggggttttctagatatatagtcatgtcatctgcaaacagggacaatttgacttcctcttttcccaattgaataccctttatttccttctcctgcctgattgccctggccagaacttccaacactatgttgaataggagtggtgagagagggcatccctgtcttgtgccagttttcaaagggaatgcttccagtttttgcccattcagtatgattttggctgtgggtttgtcataaatagctgttattattttgagatacgtcccatcaatacctaatttattgagagtttttagcatgaagggctattgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgaggatttttgcatcaatgttcatcatggatattggtctaaatttcgctttttttgtgtgtctctgccaggctttggtatcaggatgatgctggcctcataaaatgagttagggaggattccctctttttctattgattggaatagtttcagaaggaatggtaccagctcctctttgtacgtctgaggtagatgttttaaaaccccatttaaagatgagaaaacagaactggacaagatacataacctcctaaatcttcacagctacacagtattggagctggcatttaaaatcaactgggatatttggcctgtctggtatattttaatgtctactaaattctcagacaaatctccaaaaacctttttcttttctgtggctaagtctatacaagctaagtggaatggagacctgaagtaactatctggagataccaagatccaacatattagcttgtttttaaaaaaacaccttttaaaaatttaataaaagtcactctttcaaggtgaactctgcagctcttttttcccgtcttaaagatttagatgccgaagttatttcaaatactttttacattgaagatttacacataagtatgatgttttaatggaaatgaaaaaaggcgctagagaaaagattcaggttttcttttttcaaataagaaaaatgaggaccttaactgtattttaatttctacccccttgtagactgcatttttggtacatacactatgcaaaatttgtaagaggccaaagaatcttgctccttttagaatgttggcatttgtctcattagcagttagttgcattgctttgaccaattgtgacctgtttctataaatgaccattgctttttgctgcatttggtaagtgtagacacagcctttggagggtaatataaatgagttcaggcagggcatctcttgtaatctgggaacagaggagccagtgaaataaagatgctttctttcaaaaaccaagggaggagtcctagatgaaatgaatcctgaaggctattcttattttgggggctcatcatgaagataataagaatccattttgttgctgaaataaccaaataagagtggcacattcccataggagtgaccattctcttccttttggaaggggcagctttagaaaagtgccattatgcaaagctgaaggccataaaaaagtgccattaaagagaatgcaaattagcatgggcctaccagcctggcaggcattattaatgttggaggtaaagaaattaggttgaaggtatggaagaaccataaaaaaacaaccagaggccagtgtgacattgggctgatggccacttaagctgatgcctcatggctgagactttgctaagtggaagattaactgacaaaacagcttgaaggttgacgaactatttgagctcattgccagatactctagaggcaaaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcgaccacaaaattcagctcttctgatttgctaggatctgactccaggatgcagtactttctggttaacagagggggctcttgtatgcagtaaacctcccaagatggagagatgtggtatcagctattttcattatagccatcttaggagtgtgaagttgtatctcattgtggtattgatttgcatttttctgatggctaatgatgttaaacattttttcatgtgcctattgcccatttgagtatcttctctggagaaatatctatacaggttgtttgacattcttaattgtgttatttctttttctttttaatattaattggttttttttaaacatattctaggttcaagtctcttataagatatacgctttgcaaacattttacccccattcagtggttgttgcttcactttcttgaaggtacccattgaagcaggaaagttttaaattttggtgaagtccaatttaatttttttctttgtcacttctgaaggctttgcctagtgttcacaaaaatttactcctatatctgcttttaagagttttatagtttaaccttttacagtaaggtcaatgatctatttcaggttaatttttgtgcatattgtgaaaaaggagacacacccataagattggtataactttatccttttttatttaggtaatatttgtcccagaatcctttgttgaagactgtttttctttattcattttccttggtaccattatacaaaaccggttgatcataaatgtttggatttatttctggattctattttacttgtctataaagctatctttaatcaagtgacacacagtcttgactactgttgctttgtagctagttttgaaagcaggaagtgcgaatcttttatttattttttctttctctagattgttttggctattcttggcaccttgaatttcattgtgaattttagcatcagcttatcaatatccacaaagaagccggctgggatttttttagggattgtattaaatctgtagatcaattttggggagtattgccatatggacaatattgtttttcaattcaaaaacatgggctatttttccatttgtttaggtcttctttaaattctttcagtgctaattttgaagcctttagattgtaagttttgaatttattttgttaaatttatttaaaagtattttactcttttgatattattgtaaattgaatttttttcatttttggattgttcattgctactatataaaaagatagttttttttgtttgtttgttttgcaacggagtctctgtcggccaggctggagtgcggtggtgcaatctcggctcactgcaacctctgccccccatgttcaagcaattctcctgcctcagcctcctgagtagctgggattacaggtgcacgccaccatgcccggctaatttttgtatttttagtagagatggggtttcaccatgttggccagtctggtctcaaactcctgacctcaagtcatctgcccgccttggcctcccagagtgctgggattacaggcatgagccactgtgcccggccagttaatttttaaatattgatcttgtatgctgcagccttgctgaattcatttttaagttctaatagtttttcagagtatccctcaagattttctgtatacaaatgatagagtttggatgtgtgttccccacaatctcatgttgaaatgtaatccctaatgttggaggtggggcctggtgggaggtgtttggattatgggagcagatctctcatgaaaggctcagtgccctccctgtgataatgaggtcacatgacatctgtttgcttaaaagagtctagcacttccacctctctctcttgctccctctcttgccatgtgacacactggcttcccttcaccttccaccatgattctaagcttcctgaggcccttgccagaagcagaagccaacactatgctagctgtacagcctgcagaactgtaagccagataaacttcttttttatgttacccagtctcagacattcctttatagcaacacaaatggactaatacaacatgcttatgctatctgtaaatagacactttaatttcttactattcagtgttgatgaattttatttccttttcctgccttacttccttggctaaaatctccagtaaaatgtgaactggaagtggctataatgaacttctttatcttgtttttgatctcaggggaaagcattcagtctttcattattattattattattattatttgagacaaggtctcactgtcattcaggttgggatgcagtggcatgatcacagctcactgcaccctcaacctcctggggcttgaggaaacctcccacctcagccttccaagtaggaagaactataggcaaggatcactatgcctgactaatttttaaattctgtgtagagatggggtcttgctatgttgcccaggctggtcttggactcctgggctcaagtggtgtactgcctcagtctcccaaagtgttgggataacaggtgtgagccactgttctctgcccagtctatcactattaaatatgtgagctctaggtgtcttttatcagattgaggaagttctcttattcctagtttgatgagtgtttctttaaaaaaaaaacaatgaatggatattggattttgtcatgattattctgcatctcttgagataattgtgtttttttctctttattttttatttatttgtttttttttttttgagacagggtttccctttgttgcccagggtggagtgcagtggcatgatcatggctcactgaagcttcaacttcctgggctcaagcaatccccccacctcagcctcttgaatagctgggactacaggtgtgcatcactattcccagataattttattttttattgtagagatggggtctcactatgttgtccaggctggtctcaaactcctgcgctcaggaggtcctcctgccttggcctcctacatgctgggattacaggtgtgagtcaccacaccctacctctttattctattgatatagtgttttacattaatttactcacaggtagtaagccaacctcgcattctcttgacaaatcctacttagtcatggtgcataatctttttttatatattgctggattgcttagattttcttctagtattttcatagtttcaggtcttaggtttaagtctttaatcttgagttgatttttgcacatgatgagggctaagggtccagttttattcttctgcatgtggctatcaaattttcccagcacaagttattgaagagggtgcccttttcccaatatatattcttagtgcctttgttgaaaatcagttagatgtaaatacacagattttttttctgggttctctactctgttccattggtctatgtatctgtttttacagcaatgtcatgttgttgtggttactataactttctagtataatttgaagtcatgtagtgtcttgcctccagcgttgtcctttttgctcagtattgcttcggctgttcagggtcttctgtagtttcatacaaatttcagaatttgttttttctatttctatgaagaatgttattggtattttgacagggattgcattgaatctgtagattgctttgggtagtgtggacattttaacaatattaattctttcaatctatgagcatgtgatgtctttccttttttgtgtcttcttcaatttcttcagagttttattgtttttattttacttccttgattaaatttattccttgttattttatttttttgtagctgctataaatggaattactttcttgatttccttttcagctagtttgttaatggtgtatcaaaacactgttgacttttgtatgttgatttttgtgtcctgcaactttactaaattcattaaatagttctaagatatttttgatggagtttttagggttttctatatataagacaatgtcatctgcaaacagagacaatttgactttctctttttcaatttggatgcattttctttcttttttttttttctttctcaacttttattttaggttcaagtgtacatgcgcaggtttgttagatgggtaaattgcatgtcactggggtttggtgtacaaatgatttcatgacccaggtagtgggcatagtatctgacaagtagtttttcaaccctcatcctcctcccagtctccaccctcaagtaggccctggtttctattgttcctctctttgtatctaagtgtactcagtgtttagctctcacttataagtaaggacatgcaatatttggttttctgttcctgtgttaatttgcttagaataaatggcctccagctgtatctatattcataggagacattggtctatagttttcctgtgatgtctttgtctgaatttggtattagagtaacactagtctcacagaatgtgttgagagatattttctccttttctatttttttaaagagtttgtgaaagcttggtgttaattctttttaaatttttggtgtaattcactagagaaacatatgggcctgggcttttctctgtggtaagttaaaattatttatttgatcactttactttttatagttcaattgagttttttatttctttgtgagttaatttcagtagtttattgtctttctggtaacttgtgtgttctttccaagttatccagtttattggcatgcagctgttcatagcattaccttataattcaatttattgttaaaggatagtattaatgtcccctctttcattcctgattttaataattgagtcttttctctttttgttcagtataagttctgtttatcaattttgttgatctcttcaaagaatccatttttgttttcatggaatttattattctttttcaactctcaattccctagaatctataatatttcttttcttctgcttgctttatgtttagtgtgttcttcccttttcagtatcttatgatataaagttatattagtgatttgaaaattttcaaattatagttgtaaatgcctatattttcaaaaagaaaatatttcaaatcgcttcatcccataagctttgatatgttttgtttcatcccataggttttggtatgtttggtttcattttcatttgtatcaaacaattttctgatttcctttgtgattttttccttgacttattggttattttgcagtgtgatgtttaatttttcacgtttgtcaatttcccaaatttccttctgtaaatgatttataatttcattccactgtgattggagaacatacattgtatgattcaactattttaaatatattgagacttcatgaccagtctgggcaacatggcgaaactctatttctaccaaaaatacaaaaaattagctgactgtggtggtgcacacctgcagtcccagctactctggaggctgaggtgggaggatcacttgagtcctgggaggtggaggttgcagtgagctgagattgtgccactgcactgaagcctaggtgacagagtaagaccctagctggaaaaaaaaatatgttgagacacatcttgtggcctaacatatgctctatcctggagaatgtctgtgtgcatctgagaagactattttgctgttggtggtggagtgttctatagatgttgctaaaacttggtagtttattgtgctgtttagacttctatttctccattgatctttttctagttgttccaccattatttaaattgggataatgaagtctccaattattattattgaattatctgtttttccctttggtcctgtcagtttttacttcatgtgttttagggatctgttgttagctgcatatatatttataattgttttgttttcttgatgcattgtttctttatcattataaaacttctttctttagtaattttgtaatatttattttctctgatattagtatagccattccatatttcttgtggttcttgtttccatgatatcttttctcttctttttcctctccaatgatttctatctttttctatctataatgtgtgtttcttgtagacagcaaatagctggatcttgtttggtttttatttcattctggcagtctgtgccttttgattggattgtttcatccatctacatttaacaatattaatgatatagcttgatccatcttattttgattttccatatatctcatgtcttttttgttcccctattgctcctgtactgctttgtcttatattaagttaatgctttccagtgtaacattttaattcccttaatgattttctactgtattttgttgttattttctcaatgtattctctagggcttaatctatgtatattaaattatcagaatctacttcatatttatagtaacttaattacaataagctctttaagtgttttcctagatagctctgtttcttcttctctctttttgtgctgttattgttataaattttacatctatacatgttacaaactcagcagcacattgttataattattacttaatgaaattttatgtcttctaaagaaggtaagagaagtgagagaacaagtatatttattgagtttcttataaaccaccttatgtaccattactggttctgtttgtttgtttctgtgcatttaagttaccattttgtatttcctcactccagtacagccttgctccaacacatttcttttggtttgttattgtcatatgttaaatgtatatattttatggtcccaacaatacaattatatacctatttttttattgcttttcaaagtttgttatgagaaaaggggagtaaatatgcatttatactgtattttgttattattacattattattttattattacattattatcttcaaatgagctgattttttctttcatgtggacttgaattaccacctggtcccacttgctttcagccggagaatttttctttattatttcttgtaatgcaggactgttagcatgagattgtctcatgctaacatgagatactttgttttctgtgaatgtctttatattgctttcggttttgaaaatacttttgctggatatacaattcttaattattggtttcttttcctaagcatgttgaatgccatcccactgcctttgtcctctattgtgtctgatgagaagttagctgtcagtgttattgaggttcctctgtgtgatgggtcacttttctcttactgcttttaagaatttctctttctctttttaacatttttagtatggtatgtctgtgttaggatctctttttggttatcctacttgcagttcattgagctacttgcacgtgtagattaatttttcttccagcttagagaaagtattagccattaagatttttttttcttttctgtttctttctctttctggtactcttccattaggtgtattctggtgtgctttttggtgtcccatatttctctgaggttctgtccatttttataccttctttctctctctgttttcagattgcgtaatgtctactgaaatatcttcaaggttgctgattatttatcctgccagctcaaattgtctgcggaagccttgtagtaatttttttttaaattgagacagaatctcgctctgtcacccaggctggagtgcactggtgcgatctcggctcactgcaacctccgtctcctgggttcaagcagttctcccacctcagcctcccgaatagctgggattacagacgcatgccaccatgcctggccaatttttgtatttttagtagagagggggtttcaccatgttggccaggctggtctccatactcctggcctcaagtgatctgcctacctaggccccccaaagtactgggattacaggtgtgagccactgcacccagcccttgcagtaaatttgtaatttcaattattcttttcaatttcagagtgttcattagtttcatttttataatgtctatattatataacatagacattatattatagaaaatatatatagaaaaatatattatatataaatatatattatagaatatagaatatatatagaatagaatatatattctattctaaatacagaaatatatagaaaaatattatatattatataatatagacataatatccttttatggatattatatatttaatgagacattgtcattataccttcctttacttctttaagtatggttttcattagtttcaacactatttctaaaggctactttgaattctttgttaagtctgacatctgggctctgtcacagatagatcccattgcttgcctttttctcttgtgtatgggtcacgcctttctacgtcttttcgtgtctcataatattttgttggaaactggaccttttgaaactctggataatgattctcctccaccttcactgggttgtgtatttgttgctgtttgcttatttattctgggacttgtctgaactattttactaaaacctatttctcccctgtgtgaatcctttgatgtcagagggctgtcttgggcatgtgcagagtcacagtgggataacagttttagcagggatttctttgggtctttccctgatatttctgttaaacagtctgtctctgttgttatcatgtctatctgttggactccactaattgttgggtgattgctgtattgtttttgacagtgtcctggggcatcaattgctccacagtctgatcagatttggacacttttgctggggtattttttttttttttttgaggtggagtcttgctctgtcacccaggctgaagtgcagtggcgcaatctcggttcactgcaagctccgcctcccgggttcacgccattctcctgcctcagcctcctgagtagctgggactacaggcgcccaccaccacgcccggctaattttttgtatttttagtagagacggggtttcactgtgttagccaggatggtctcgatctcctgaccttgtgatccgcccaccttcggctcccaaagtgctgggattacaggcgtgagccacctcgcctggccttgctggggtattttttgaggccagtctttgagatttgttctaaccccaaaagggctcttctttgctggttctttttctggttatctaatgttagctttcctatgatttagcttgtcactgttacacatcctcttaaatgcttaccaccaagatttccatttttttctcagaggacctttagggttttactttcccttatgctataataaaaagtcagttcctttggggagagctttggaactctctgttttatggcttgcctttctgttggtgtacagtgtctgagccattgctttggagttggaggcaaggacaggggtcttgtttctctcaaaatgacactgcttcttttctagctgggtattcatggagtcagtatcctctggtcttctcagtttgcctctcctgatatggagcttctttgctgatagcgagctacaccagtggtgactggggggtccagtgttgttgctctgctatgcctgaagtacagtctccatcctataactggagacattgttgaggaagggagcccctgtcttcttggccatgcttgcctggagtttagcctttgcaacaaagagctgatgttgatgagaattctggaggccttggtctcctggggagatacatagctcttgactgggagctaggaattgtgggtatctcctctttttgtccacacccacctgtactggtcctgctgtgtgaaggggagggagtagatcatggctcaagtgctacagactctccctctttctaccaaaggttagtagacttccttgaataaatctttccttatttgctatatgcattaagaacatttccagagacagtaaatggctgctttagaattttcaccggtatggttgttttactggggagaggcctgcagagctaagtcacaattttcttggttttaggtatgatggatgatttttttttattggctccaagacatattatacattatgttcagggatgctgggtcctatttaaatcttttattttagcaagcagtctccctgtttaggtttagcatataggtcttggcctactttttttgtctgtggttccactgtgagtttaattttcacagcatttgtgttgttatttaggtctcctctgtttatttagtattattggacttttcactggtctctcttagtgctgcctaaggaagccaaggactttccccaagccaagcccttgggtgtcttttggtgggggagggttgtattgagatcctcctaatagtattatccagcctggtgtctcaggtttggggaggaaattcttgggtccatggggactaacaggcctcttagacccatatacttgctgcagttgtctcttttggtagctcttccagcctgcctcaatgtctctggtcaggggaggagagtgtcaggccaatagggacaaagagcctttccagtggctgggcgcagtagctcatgcctgtaatcccaacactttgggaggccgaggtgggtggatcaccagaagtcaggagtttgagaccagcctggccagcatgacgaaaccctttctctacaaaattaaaatacaaaattagccaggcttggtggcacatgtctgtaatcccagctactgaggaggctgaagcatgagaatcacttgaacctggaaggtggaggttgcagtgagccgagatcatgccaatgcactctagcctggacgacagagcaaggctccatctaaaacaaaacaaaacaaaacaaaacaacaacaacaacaacgaaaaaagcaaagcgaaaaaaaaaagcttcccagaatgggctacttgccacaattgggtctcttttattggttctgcccacccaccttgatgcctctgggaaagggaagagagtcttaggctcatggggacaaaggagcatcctatatctagctgttaggtataactgagtccctttttcaatctccgtctgcttatcctgatgtctctgggggaagaggggtcttgagtcctcgggggacttcctgaaataagtctcctagctgtggttaggtcctgtttgcttaatttggttttgtggaccttttgcatatccttgttgtttttctctctagtttttctatcagttttccagagaggaggtcgaagtttctaactataactgtggatttgtctatttctccttttagttccatcagttttcactttatatattttgcatttctgttgtttgttacacacacatttagaatggctgtgtgttcttggttgattgacccttttatcattatgtaatgtccccctacattcttggtaattttgtgttccaaagtctactttatctaatattagtatagctacttattgctttattttaattgatgcctacatgatatatctttctatttttcagtgccttcttttgcttgttttatgtattatgtcaggctggagtacagtggctattcataggtctgatcacagctcactgcagcctcaaattactggcctcaagtgatccttccacctcagcctcccaagtaggtaggacggtaggctcacaccatggcacctggcttgtcatgtgtgttttctgtaaaatctagaattagttggaggaatagagagaaatgtgtatactctgtcttgtccagaaccagaaatctagttcacctatttctgttttcttgaatgatctgggttggctttttaagtctttgaggctccgtgttgcactcacctaattttagctcaataagatcatgttactgagtctactactctgtacatcaagggctgtagtggctcaattttttttttcaaagatcaaattttcaaagtccatatatttttatcaaatatgcccttagccttttgttgctttggttgcatctgtccctccactgcctttgtaggcatttggttttggagagttgcaatgatgtatgatctgcaaatctccatctgctgcctgccactgactcagcatgaatagaaacaaaaattgactataaactggttgacaccaagatagacctaataacatggcttatttgtatgaagttggactctgctattaattcattcagtatgaagtgcttactgtgtgccaggatctgtgttaggtcctggggttacagagctagcagtgccataggtactgattttggagagttcatagactactgagaggagacaatcaaatagggtattcggtgctatgataaaggtgagcacaggttgctgtgacaatagagaacaagggtactcaaattagggtaggctctgttgatggaagtgacacctgagttgagtccctgatatagtttggatatttgtctctgcccaaatctcatgttgaaatgtaatccacaataattggaggtggggcccggtgggaggtatttggatcatggaggcagatccctcatgaatgccttgggccatccacttggtgataagggagctctcactctgaattcacatgagatctggtcatttgaaagtgtgtggcagctgggcgaagtggcacatgcctgtaatcccagcattttgggaggctgaggtgggagtttgaggccagaagtttgagaccagcctgaccaacatggtgaaactccatctctactaaaactacaaaaattagccaagcatggtggtgtgtgcctgtaatcccagctacttgagaggctgaggcaggagaatcgcttgaacccaggaggtgcagtgagccaagattgccccactgcactccagcctgggcaacagagtgagactccgtctcaaaaaaaaaaaaaaaaagtgtgtggcaactactcttgaccactgtctctctcctcctcctgcttttgccatgtgacatgcctgctaccctttcaccttccaccatgattggaatcttcctgaggcctccccaaaagccaagcagatgctaacactctgtttcttgtgcagcctacagaaccatgagctaattaaacctcttttctttataaattacccagtctctggcatttctttctctttttcttttttcttttcttttcttttttttttttttttctgagacagggtttcactctatagcccaggctggagtgtaatgttgtgttctcttatcactgcaacccctgtctcccaggcacaagcgatcctcccctctcagcctccagagtagctggaactacaggcacatgcctggctaattttttgtatttttggtagacacggggttttgccatgttgctcgggctggtctcaaactcaagcatttctttatagcaatgcaagtatggtccaatgcagtccccaaggatccataaccagtcaaggattgggggaaaccttaggaagcagcatgagtaaagggagtttcaagaggaagtgttgcttgtacttatgggctagaatgagatctgtgacctcagaatttgatagaaaccaggacacctagagcccagtaggatatgcgacatattttggactttagtctgagagcagtgagaaggcattgggactttttaagtagaggagtcatttaatttgatttgtgtttttactgaattcctctggcttctgtgtgaaggggctggagagtggcaagaacatggcagtgagttagaaggctgcagggagcagcccagggagacagggttgtggcttggcttggggaagtgattgtggggatgcagagaggtgaatggattcaggaggtttaggaggaagaacagaaagaatgctgcgagtaaaagatatagatggtagggatgagagtgaggaagcaaggaagtttctgccaaggattctgccttgagaagactggagaagctgtgataagcagggcagtgggagagagtctttgtttacatgtggaatttggggagactgtggagtcgccatgttgagatgcccacgggcagtggatctgtggatgggggggctcagtactgcagacatagactgggagggttttttgtttgttcgttttgttttgtttttgagacggagtccccctccgtcacccaagctggagtgcattggtgcgatctcagtttactgcaacctccacctcctgggttcaagtgattctcctgcctcggcctcccgagtagctgggattacaggcacacaccaccatgcccagctaatttttctatttttagtagacataggttttctccatgttggccagactggtctagaactcctggcctcaagtgatccacccgccttggcctcccaaagtgctaggattataggtgtgagctactgcgctcagccagactgggagttttgaggtgctttgtctcatttatctcacttaaaataatttcaaaatatgttaaaaggaaatgttatttgcaatgcatagacaggttttcctcgctagttgctgaggataaaatccaaacaactggacctaaacagacaggattggaagaggctgttctggaccaaatgggatgctaaaccttagaatggattgacaagagaaggccatgcagaatggtgagaaggccctacttacctcagcccagcttcaaggccctaagtgagggatacctggaatgcctctgaagactggcatttggatgcccattccttcccattgcagttgccaagcccaagagcagtggagaacaactgtaccttcttgtcatgaagtgtgtacaccggaaaaaagtaaatgcttgtattttctttttcctctctttcttttctatatacagctctccaaaaacgcagatttctctagatcacagttgttcgtggagaagtgagagtgacaattttagagtaaaaaatttaatattgtgggaattatctctaaccagtcaaattactaatgaagatatttattcttgggaatctagaatcagctatttaagctttctaggatctggagtcacacagacttgagttcacatgatggctctttcacttaccaatcatgagactttgggttaatcactgcatctacttctgaccttcagtttcctcatttgtaaaaggagaatgctacctcatgggactgttttgaggcccaaatactgtatgtaagtgagagggctttataacgtataagttgctctttaaatgttatttaatcattatttagcttctggtttcattctattaataacattttaaagtgttattagaaaaattgtaagattcttgctaatattaaaatatgttgctttatttaaaagtaactcctaattcatgcccacctaataataaagaatatcattaggtggctgtaaacaaaaaaatcaaacagttctttctttcctctatacactcacacacttctggtcatcaaaatgtgtgaatttttccgacagagaccaatactccgacactagctgggtgtcttacaattcaattcagttctgaaactaaccagcattagtgcaggccccatagattaagagctcagtcccacaagtctgccccctccccttcagacatctatctcaagtcccaggttgtcacctgtacttctggctgtaaatcaaggtttccacgaccccctccttgggtttgacaatttgctaggacagctcacagaactcaaggaacacttgcttacatttactggtttattatttaagaaaggatacaataaaggatacagatgaacagccagatgccaaggtacataaggaaaggtatgtggggagggatgcagagcctcttgtcacctccatgtgttcaccaatatggaagcattctaaaccctgtctttttggggttttgtggaggcttcattaggcaggactgattaaatcatttgtcattggtaataattcagtctctctttttatcttttgttttgagacagggtctcaccctatcacctaggctggagtgcagtggcgcgatcacagctcactgcaacgtctgcctcctgggttcaagtaatcgtcccacttccacctcctgagtagctgggaccacaggcgcacggtctcactttcttttccaggctggtctcgaactcccaggctcaagcaatcctcccacctcagcctcctgagtcactgggactgctggcacacaccacgacacacggctaatttttgtttttcctagaggcggcatttcgccatgttgcccaggctggtctggagctcctgagctcaagcgatctgcctacctcagcctcccacaaagtcctgggattatggacgtaagccaccatgccccgtcaacaactcaatcttaaacccctctccctttcctagaggtggtggggctggtctggctgaaagtttcaaccctctaatcacatggttggttcccttggcaaccagccttcatcctgaggctatccaggagcccccagccatcagtcattcattagcacacaaaacatctatcacttcagagattccaacagtttttggaggaatgaaaatcaaaatatatatttcttattataaatcacaataccacagtgattattggtatgtatgcttttaattttaggctaagcgaggattgattctattcaatttttccctcaggcttataggaacacatttaagggcatctgttgatgactcattaactgtttcaaacctaaaatgtgtcaaatgctgtgactttgcaactattgttgctcttccctttagcacgaaatactttaatgatctcaagacatttatattatcagatttttgcatatattcactaaaatttggttttattaatggtctcgatgtgtcccataaatattcctggtttccaacttgagctggatttattaggaagaggcaaaatttagcttatgtgccatacctgaaggaagttacgtatcgtagcttgtgatgctgtgggacagctaaagaacaagcctttacctggtgacagattttaactggggaatagttattgtaaaaaatattttcattttttttagactacaagatatgcgggctagcattggatgcttgaaaggaaaattacatttttgctgaaatccaggcaatgcaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaaaataaaatgctgagacctaccccccaaccatctaaatggacttcctcctcgaccaaggcactcttaaaatttaacttgaaagactggttcaagtcatgacaggttgtggcagtgggacatgcctcatgattacctctctggcattaacatcaacacagaccttaagtctgataagaagcatttacaatctgttctcttggaatcttcctacctggagacttcctctgcacaataagaactttggtcttcataatcctttatcttaacccaaacatttcctttctattgatcctaggcctttatttagataaactcaaccagttgtcaaccagaatttttttttttttttttttttttgagacagagtccagctccgtcacccagactggagtgccctactgcaatcttggctcactgcaacctatgcctcccaggctcaagcgattctcatgtctcagcgtcccaactagctgggattaaaggtgtgtgctaccacgcccggctaatttttgtatttttagtagagacagggttttgccatgttgggtagactggtctcaaattcctggcctcaagtgatccacccgccaaggcctcccaaagtgttgggattacaggcgtgagccacagaaaaattttaaacctacctataaagccggaagctctccccttcaagttgttccgcctttctgaaccgaaccaatatatttcttaaatgtatttcattgaaatcccatgcctccctaaaatgtatacaaccaagctgcaccgcgaccaccttgggcacatggtctcaagacctcctgagggttgtgtcatgggccgtggtcactcctatttggctcaaaataaatcacttcaaatatcttacagagtttaactcttttcattgacactctgccaaaaggagccctgaaatgttggtcagatttggataaggaccatggccatgtggcttaaatggcatttgctcgcttgttggtaatgagttgcatttgaagaggtggaataaatggagacaaccggcatcattgggcacctgtggacaaagaaaagcctttttggttgagccaaggtgatactatccacatctgcctaggaagttgtttttttgtttggagtagctgggactacaggtgcccgccaccacacctggctaatttgtttggttttgtatttttagtagagacggggtttcaccatgttagccaggatggtctcgatctcctgacctcgtgatccgcctgcctcggcctcccaaaatgctgggattacaggcgtgagccaccatgcccggccctgcttaggaagttttttgaaagagtgtttatttgtgaaaatgaaggtgcttctttatgtctatagctttctggctttactcctttcagagatttgacttgtaaggcaatagatagaaatgatagctcatcagcatctaatgagccaaattacttactccataaaatattatcctactttctaactccaaccatacaatttgaaggaaagaagcccaggggtcccgattaagccattgacatgtctggctgaaggatgatatgggcttctcattgactgagccaacaacatgacctgcccaggcgggatccgggctgactcctaactccaggatgaaagcaggaaggtaaacagtctttgggtaatttactcaaattgtagccagtgaatacctcaagcatggcactcaccatgctgtagtgtaattgcctggcttttgtttttgttttattttgttttacctgatgggagctctctaatacttcaaacatggcacttaccatgctgtagtgtaattgcctggtttttgtttctgttttcttttgttttaccagatgggagactatgtctttcatgtctgtcttcccagtgtctttgtccgcagtaatcaattattgtatgttgaataagcaaaattataatttttaagcaccataaattcaacctgccaaaagccaaatccaattttttgtctttcaggggatggcacaatagccagcttttcaggaacctgagtgttttccaaaccagcacttttcaaacttaactatgcacatgaatcactaagttttgtgaaaatgaagattctgattcagtaggtcaggggtggggcatgagattctgcatttttaacaatctcccaggtgaggctgatgctgttggtctgcagactacaccttaagtagtaaaggtctagaccctggtctctaccttatctccaaaatttaatccatcaccaagtcatgttgtctccatctcctttgtcccaactcatgtctgtttctgttgccaccactttagctgaagccttcatcatttcactgcagagattattgcaatagctttcatgtagtctacctgctctttattctccactccactgtctatactgcagccaagatgatatctctcaaatacacctttgggcatgtcaatccattgttaaggggctttcaatgtaggataaagtaacagaccttctgtggttagattgcctttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctgtcctgggaatgggatgcagtgccttgggtggtttcaggagattgacacacttccaggaccaggcattttcatttccaccttaaagaaggagcctgctgtgctttctgagacctactgtatctgggatggccagacttcaggagacaagaagaggaaggcatcctatccttttggtgggtggatggacgggccgaatctatctcagaaatttttaatttttacttccatgtcactttccagtcttcagccagccccccaccgtctacctcccactgctggagtgtggcttcattcaggggagaatgctgagctctgttgacatttggtagaatttgttttcttccctctttaatttagcaactaatcacgggggttgttctttgttcatctttccagggttttccgtacgctgactaatgcttacagctggctctctctggagagaagtgctgggaagatcaatcaaatgaaatcttaaagggtaaatcaggttttcaaatgtgttcaggcagctttaaatcgtttcagtgagaagaagtgcttacaagggcagaaatttgcccagcgaaatgcctcccaatggcaacagaacaatcacaccttggatggctgctttgtagcctgagtgtccagttcttctgagatttccaatggccatttacaactcaagagtgagggacaaaatgaagtgcatttgacttgaaggaattcactaatgcaagatcaaagttgtaaaaactgtaccttaatatgctctatcaaagggctgtatgcagatgttaagaaagggaagctgcacaaaatatcccttttcaataatttcacattttctttagtttttcagctcctataaatctcaagaaataattaacatgaaacctatattatgtttcaggaaaaactccagagagtctttcttaggcttttggaagtcagtgatgctgttttctgtcttcttagagaagtcctaaaatggaaaaattttatcatggaaattgacccattcagagcagagagtttatgtgactttatggtacaggaaatttgaaaatcgcatctcatcttttattttctattgtcatgttaaactatggttgtgcctatgggattaagtgaatattctagccacttgcattaaatgattagccagtcttttcatagtgacagttggttgtatgtgctgctagtcctgcagcggtctagtctgctagtggttaactatggagaattggtcagaggagtccctccccctattatacacatctcattaaagactctctgccactgccaaaccagaaaaggcaacttatttcacgattcattaaagaaaacataattgggaaggtaattttgtaaagtcatcatcaaacatagtccaccacccagtaggaattatcctctcattatctctttttctagatagtcattgacattgttcccctctgttagcatgaataattaaggactgagcataaagaagtggtgtggacctatggtcaatctgaaggtgtcatcagaagagttagcagggctttcttgccttcagcaggccatttattctgagctaacctgccaattgtatttagaacagggaccattaacagggtgactgtttggctggctgtcagtaggctgtggggctttttccagagcaaatagagaagccagctgggcttcactaagaccacccaggaagagagatcatgtcccacctgatcacattccaagcaggtagcaaatgggctccagttgaattgtacttctgaaggctttctgaaggggtaggggaaaatacctcccatcttagaaattatggctgctagtgtccagtttaaaaaatttctggccctcagcaccaagtgtcttagctttttgtccatctatagctgtcagaaagacacgctttgtcttcctggcaaaactgcctctcaaggtctatgccatcattatggcttggtttaatcaagctaccagggttgcccctgtgtctctcatctggctcttccagaagggacagtttgggaaactttcagagattctgaagatttcatagggggagaccacacttaaggaataagaccctccacacattgcagtgagagtgacatgttcattgccaccaaaagaagcccctctgttaaaacaaacctgattccaaacagagctaaggttgcttgggggctccgtattgtaaggcctatgggcatgcaatgaaataggagttgatgtggactctgaaccctgaagaagcagtttaaatcactagcactgctgtttattagctgggaaattttgggcaatctatttcagttgtcaggtcttcagtttcatcatctctaaaatggggaggacagtgcctgtctttttacactcctggacttgtgttgaggagatcatggataaagtgtgttgcacacagtaagggtagttatcatggttattaaccacactgcagctaattgggctctagctaccccatttgtccctggtcaggcaggcccaggactttcttaagcttttctcaccttaaagcggaaacacattccctctcctgtggggtcacgtggctctgtttaaatgtggctctaaatgagatgtgtgccttttgacaggtcaccttgtaaagatacacagcatttccaaccatgtaaaggtggctctaacttcttgaaatcctctctttgagaactgcctttagagctggtcattttagtcacaaaagaaacatctttcaacagggtcttttttttttttttgagagggagtctccacccaggctggagtgcagtggtgcagtctttgctcactgcaacttccggttcccgggttcaagcgattctcctgcctcagcctcccaagtagctgggactacaggcacacaccaccatgccccgctaattttttgtgtttttagtagagacatgatttcatcatgttggccaaactggtctcaaactcctggcctcaagtgatccgcccgcctcagccttccaaagtggtgggaatacaggtgtaagccaccatgcccagcctcaacatggtcatgttttgaatatgcttggacagaaccttgccaccatttctcatagtcatgtgtatggtatttaaaccatagaatgtcagatttgtaatgccccctagaaatcttctagtccagtagttttcaaactatgttccccagatctcaactgtttggagaagggacatcaaggtcagggaaaatccaaagcaccatatgttcttgatgctaagatgccattagttgtagtttgcaccatcaattaatactggcatttcaggaatattaaaagaatgtatgcagtcattctaagacccatccttattttagatatgaacttcaattaaatacagtattagggttctctggaggaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtcccagactccaaaagctgaagaatccggagtctgatgttcaggggcaggaagcatccagcacaggagaaagatgaaagctggaagactaggaagtcagctaattccaccttcttcttcctgctttgttctagccacgctggcagccagttggatagtgctcacccagattgagggtgggtctacccataacactctgctgactcaaatgttaatctcctatggcaacaccctcacaaacatatccaggaacaatactttgcatccgtaatccaatcaagttgacacttaatattaaccatcacactgtccatcatcaaattaaagaaatataatgttttctgttaaacagtataattttacacaattgggtaagcactgtttcattgctattttatagattgggctaatgcctatggtttcatgtcacagatttctgctcctacagagtttgaaaattgacctaatctaacccatttcttctgtagaggtccagacaggagaaggtcatacagatagttagcagcagggctggggctagaactcaggcttcttgactgccactccagttctcttcacaatgttacagtaccttttgtctacagccatattgcataccagcccagctttcctttgccatgacttggtttgcatgcaggaattgtaaacccatcttattaaaagttaccaatgataggctgggcccagtggctcacgtctgtaatcccagcactttgggaggccgaggcaggtggatcacgaggtcaggagttcgagaccagcctgaccaatgtggtgaaaccctgtctctactaaaaatacaaaaaaaaaaaatagccgggcgtggtggcacacacctgtaatcccagctactcggggggctgaggcaggagaatagcttgaacctgggaggtggaggttgcagtgagctgagattgcaccattgcactctggcctgggcaacagagagagactctctctcaaaaaaaaaaaaaagttaccaatgataagaacattttatgttactatagcccttaacattttacagaacaattttatattctccttttccttacatctttaccacagcttgttaggtggagcaaggaggatatcatcatcatcattattatcatcattattaagacaatcacctccattttatggatgagaaaactgatacccagggaggataagcaattggctcaagatcatgcagacagttaacagaactgagaagaccatccgtgggtcctgatttactcattcaatgttgttacacattaaagcaaaacataaatctaaagatacgtcttgaggaaagagttattcactagaagcttgcaagaacatcattttattgctgaaagcagctcaccttcaccagggacgttgagtcattgatatcccagaaaccccgtgtcattgggtgatttcaactacaagttggtgccatagcctgagccctgagccctgagccctgaggatggccttatactgagcattgggtgttttatcataacagagacagttaaggtttaacaatgggctaatggccgatggcagtgcttcctgcactgctagtgagagtgccaaaccaaggaggagctgaggaacagtccagtggctaatgtggggattagctgctgctttgggtaatctgtgtccagttcaggctggttacaggagagcctcaaggactcatttcacttggctgcttcttgacctgcaattttgcatgctgcatgctgcaattttccctttgaaaatacatctttccttttaaaaatgtggtgacatgtgacttctctgaagtttaaatgtttgatcatttttaagctggcacaaaaatggttataaatcttaatacttaaaaatgtaaaaggaaagcataaaccctaccaacttgtttggtcccttttgtgtgtttgagagagcaagcccagctcagcaggccctttggatgtccgctgaggttcagaaagcaatgatctagtcgcatcaagatattgaatcttctgaattctggccttgtgccccccaggtcagggctgttgtgttggttagatggctgcccaaaaaatggtcctgccatgcccctgagtttccctcttgtgaatgaatagaaagtttccatctacagagttggcaagctctgtgctgttaatttcacttagttaaaaggaaaaaaataactaaacacacaattattagtaaaccaccctgcagacaagtttaggattctaaagaacatttggtggttaggcttaaatgctgtaggctatgattacccttaattctgcacacagacaggcttcagagccagaagttacatgatttggtcttgtcagatgaggtcccctttttgccttattcacagggagattatggaggtggtaattgtcagtggattccaaaactccctggtcaatttaagcatttatatgtgggtttaataaaatgatgatataatacagaaagcacactgtcagggaaggaagtaactattagcaacatcatgacaccttaatctttttctccctctgggagagcagaatgggttaaacagaaggtttgcttttattattgaagcacaaaaaatcacatttttgtctaagttgtttagtcagtgagttttgtgtaattcaatggaaataattccatagtaacttagtaagtcagtattgaaaaggctgggtgaaaggacagcattttagagcaggcagtgggaagcctgagggagcaggagagggggagaggggctggttaatcagccgtcatatgccaggacaatatataatcctgtttgatttggtggaacaggccctttatgggtaacatattccccaatcccaaatcaggaactgtgaactcattttacttgctataacctcaatcctcataggactggggcttataaattgtggttgactaagtggggagggctgagttgtggaagatgccacctaagggtagtggggacaagcacttcaccaggaaaatcagtgacagaggatttttcagtgtaactttgccagctggagacctctgcagccagcgatggccatgcctggatctcactcaggccctgggcttgccacaggaggcaccctgctcacttggcccagggggctgtgcttggcttgcactcctgcccagatcccacacttgccacaggatccacactcagcctgcagctgggccgggcatgctgcaaccagcttcccccttgtgtgctgacatctggatgaggggaacacagtggcatctgaacagggatgccaacaacctcaaagccccagagggggtgttacagtgtgctaacagttgttttagtcccaccatccacagcctgagcaaacaggggtgtgttaacagctctttcagtcctgttgccctgctccagcccgcagccccagggctaggctggccctgctgctgcttcctggagcatgaagtggctgcctggcactggcggagggcagagggctacagttttacagccttctttgtacccacgtttggcaggttctgagttcttgtcccacatccaagaagaatgagggtacgttgacaactgaagtgtgaggagagttttattgcatggcagctctcagtagagaggggactcgagaggccagccctcgagtggtggtcccaaagtgtggctgagtccggggtttttatggactcggaaggggatgcacgctgattggtttgtgagtattcaaaaaaggctaaaacaagggcaccactcaaaggtgggcacgacagtataaaaagccaattagggaagggtaggtatatgtaaaataggtgaagggtggggatcaattaaaggaaagcatgccagatgggaagagaggttctcaattttgtccatggatttatctaggacttgtagcttggctttcaagctttaaactgtctatggtttgaaggtggggttttatcagggacttgcccctgtctgcctaagacttgtctgccttctgctgctatgagcagtacacagaggcaggagcaaaagcagaatagagccccatctgagccatgagttgggagattttacaatgggtcagtaaaagggacaaaatttatcaaatggaagagcacaaagatgagcatttggatttgtcaggaaagttccaagagaaatgttagcacaatcacagagggttaaattctgtaccatgaactacagatgaccctgactcctttgttggttataaaatacctttctagctccatataaagcaggatgccacagcctacatgtattaaatcatgcattgtattgagttgaattgaatggtatttgggagagggaggggatagcccaagtggtcccaggttaggaccaacactggggcagctgtgatcttgggacagaaatgtgaaaacacagactgtccagatgcagaacaggtgactttcatcaaatccagtccctccaatgaacataagaggaaactgatgccccatgaggggaagcaacttgtttcaggtcacctaccaggttagttgcagaacagacctaaagggtaggctacctaattttcaatttagtgtttgcttctctttaggctttattgttactttgcaatggagatcatacagatatgggtcaggagactcaagaggacaagtgatttgccccaggctacactagtgagcggcagtagccagtgtttgtctgattccagagtctgtggacgtaactacagggatatatgatagagtgttttgtggttggaggaggagagaattccttaagagtgtgtgctcatgaggccaggtgtggtggctgacgcctgtaatcccagcactttgggaggccgagacaggcagatcacgaggtcaggagatcgcaaccatcctggctaacacagtgaaaccctgtctctactaaaaatacaaaaaattagccaggcgtggtggcgggcacctgtagtcccagctactcaggaggctgaggcaggagaatggcgtgaacctgggaggtggagcttgcagtgagccgagatgggccactgcactccagcctggacaacagagcgagactccgtctcaaaaaaaaaaaaaaaaaagagtgtgtgctcacgaaaggcagctctaaagaggtcacatttaaactgaaatctaagggatcatgggaaagaattagccatagcaaagccaggggaagtccaggctgaagtaatcacaattgcaaagaccctgaggttgatttgtccctgggataaatgtccttgcctgatgatgtgcttgcctaagtcctttttttagaggtaattctttgacagacccattgctgtctggaactcccaatggacaattactgctttgttggtgtatctaattcaagagttagcagcagaggctcatgtcatgaaacttcccttcaagcttgtttgtctgctgagtttttggtaggagcaggatgggatcaggatggttagggggccaggagcggtgggaaggaaatgagttaggaatggtcttttatgtgcccatgagaccaggctactggtaaaatactgataaatatttcccctctaagttttttttttttttttgagatagcgtctcgctctgtcacccaggctggagtgcagtgctgcaatctcagctcaatgcaacctctgcctcccgagttcaagtgattctcctgcctcagcctccctggtagctgggattacaggcatgtgccaccacacccggctaatttttgtatttttagtagagacggggtttcaccatgttggccaggctggtctcaaactcctgacctcaagtgaaccacccgcctcggcctcccaaagtgttgggattacaagcgtgagctaccacacccagccccttctaagatttttaacatatgtcatgctgcaggattcctattccattagaggcttgtatttaccgaggcaaatggacgaaaggcaaggaaccagtactagaaatataaaaccatccctgtgttggatacgccctggaacaaaggaatataaggccaggattttactttctgccctggaactgacttccctttgactctgcaagttttactttcctgctttatgtctgataggcataaaatgcctaccattcttctttctaatacaattgtaatttcatcaatgggattagtgaaggcactaacaaaatctaaattctccatagtactgatcatcagggtgttctttagtagtgacttaaagaaaatcatgctctttgaaagaatatatataagttgcctttacattgctcactgagaaaagataatggagcccaaatctaggcttcttgttcctcgcctcccttttttttcctgggtgatcatacttttcaaggttatgttctttcatattcagtgttgaccatgcaaaactggtgaacaagaattggttctgggatgatttgttccagctataaagtagaaagcattttactaaaataggatgcttagatttgtttggatctacagtttattcttaactaaaattccaggaactgttggtaacagtctagattcatggcaaccagtttttacaagaattagaaagaaacgaataaaatgttctcattataaggttcaggaccgaatttgaaggctttcaggattccagatggcaaatggtagagcgaacgtgaaaatattagaaatttatgctcaatgatcatcatcttctgtccagtgaagaatgtagtttaagcaggatgggtgcgggcgtctgatgtcctcatttatttccacctctgtagctatttaagtgatgatcattcttggtggtggttaaattatgatgcacgaaatactatctccctaaggaccttgctacaggacagaggtgattacaagaaattgttgctgctgatgtaatgtttcgtataccaagattaaaccacaagatgaagtaatgtacattttttgcctttgaaatgcagctggagggaaaccagggtaagaactattgccaaatgaaatataatgccccaggaaaaatataagatactgtaaatgtaaaatcattacaaaactgaccatctgggtcatatattaaaccacagctttcaatttgttatggtttgaggaatgacttcacagtgtgtaccccttcctccgtaccttcctcagcctcaggaaagcattctattttcatgagtgtagaaaaaaaagtaatcttaaagttttgtttttaaaaaagagttccaatcaatagctcttaataaaggcacagtgtttgcttacttctttgcatttagtcctactatatagtcttgtgttgctaattccactttagctgtggcaaatataccagtgtgtagccaccgggccatgaggtaaattgaatccgtgtggagctgacagttgaaaaacctctgtctgcctcagttcaggaaacaagagcgtgttcaactcactttgggaaacccccaggcattaaaattttggcattttcatgttttgagagaactgaggagtagccctgttttgataatcatttaaaaatattttacttaattagagcagaatttgctcaggcagaaaatcacatttatatggtagccaggctgtaacacctcatagctacccattgtctctaatcagaaatgacagcctggtgactggctccatgctgggtgaagtccagcaaactgcaggccctgtaagtgcctaatcccaaacctgggcttccagtggagttggtttttttttttttttttttttttcagtggagttcttcaatgggtctggctttgaaatacttctatcctttctagtttaggaaagcaatggcacaagaaacccatatataagtcagctacttttttgatgtgtaattcacataccatacaatttcccatttaaaggctaaaattcagtggtttttagtatatttacgaagttgtacatccaaaaccacaatcaattttagaatattataattccccagaaaagaaacccctcactctttagccttcactcctagtctccccattcctcacacctctaggcaactactaatctactttctgtttctagagatttgtgcattctgataatttcacataaatggacaaatgcagtgtgtggtcctttgtgactgtcttcttggttcaacatgttgtagcatcaagcagcaattcatttcattttattgctgaataacattccattgcatgaatgcacaatttatttattcattcattggttgatggacattcagattgttttcagtttttaactattgtgaataatgctgctatgatttgtgtacaactctttgtgcagacatttgttttcatttctcatggagtagaattgctgggtcatgtgataactctgtgtttaatcatttgaggaattgtcaggctgttttccaatgtacctgcaccattttatatttacaccagcaatgtatgagggtttcagtttctccacatcctttccaacacttgttataatctgtctttttcaaatagctgtcttagcaggtttgtgaagggttacctcactgaagttttgatttgcattttcctaatgattaattatattgatcatctttatctgcttaatttctatttgtatattttatatagagaaatatctattcagattctttgcttatttgaaaattggattacttgtcttaagttattgagttataattgttctttatatagtctaggtacaagtcttttatcagtgacaggatttgcaaaaacttcctcccattctgtgagttttctttcttgatgttctttgaagcatgaaagtttaaaattttgatgatttccagtttatgtgttttttcttttgttgtttgtgtttttggcatcatagctaagaagtcattgcctatccaaggacatgaagatttacaactgtgttttcttctaagagttttattgttttagctcttacatttctgtctccgatcgatttcaagttaatttttgaatatggcataaagtaggggtccatctttgtccatttgcatgtggacgtcgacttgacccagaatcatttgctgaaaaggctattgttaacagttccctccctgccccatagcagccatgcatggggcaacttccagtgaggtgagtatgaggttgtggcaagcaggcctcagtgatggtggcatgatgaccatgctctggggcttcatctgtaatgacccgttcagtttcaacagcattaacttggagacacttacagaaacttacaagattcctttttacttacaatatcttgccagagtattttatcattgcagaggcatctagtggaaagttaatggattgtattgtgggtaaagcagaaggttcagtagctagggaagaatggcaccgttatgccacagctctttctgttgcccaaaatttccatatcttggtttggctgttaaactcatagagttgttggaggaaatttcagaaaggcacaagacaagggtgcctttggttggccctttaataatttactgtacccctagatagcacagggaaacaagtgtcttagtccatttatgttgctataaaggaaactgaagctgggtaatttataaagaaaagaggttttatttggcttatggttctgtaggcagtacaagaaatgtggtgctggcatctgcttctgggatgacctcagaaagcttccactaatggcagaaggcaagggagagcagacatcacattgtgtgagagaggaagagagtagagagggagtgctgggctctgtttctgaatcacttcttggctgggcatggcggctcatgcctgtaatcccagcactttgggaggccgaggtgggcagatcacctgaggtcaggagttcaagatcagcctggccatcatggtaaaaccctgtgtctattaaaaatataaaaattaactgggcgtggtgggtgcctgtaattccagctactcgggaggctgaggcaggagaattgcttgaacccgggaggcagaggttgcagtgagccactccagtctgggcaacagagtgagactccatctcaaaaaacaaaaagaaaaaaaaatcacttcttgagggacctgctagagtgagaactcagtcattatcatgaggatagcaccaagcccattcacgagggatctaccctcatggcccaaacacctcccatcaggccccacctctaacactggggatgaaatttcaacatgagattggaaggggcaaatattcaaactgtatcagtgagaaaaataaaataatatgagaattgagaaagaagcaaaacttttatgttgcatagatatgattgtacaaatagaaaatccacaattattcttatggatttattacaataaatgtttagaattaacaatgtttaagaagttggatataaattcagtacaaaaatcaattgcatttcaatatacaaaaaataacatttagagaaatatgtcatttgcagtgttaccaaaaaacattaagtgtttaggaaaaacctaacaaaagccatgcaagacctctttgaagtttataaagctttattgagaagcattcaacatgagctagctaagtgggcagatagactgcacttgtagattagatgacgtgatattataaaactggtaattctccccaaattgatccacagatccagtgtaattgcaatcaaaacctcaagtatttttgtgggatttgttaatctgattcctttttttttgaaacagtgtcttcctttgtcacccaggctggaatgcagtggcatgatctcggctcactgtagcctcaacctcccagactcaagtgatcctcccacctgagcctcctgagtagctgggactgcaggcctacaccaccacacctggctaattaaaaacattttttcatagacacagtgtcccactatgttgcctaggctgttaagctgattcttaaacttgtgaggtaacggaaatagctaaattaagacaaaatattcttttaattttttttaatatagagatggggtctccctgtgttgcccaggctggtctcaaattccttggctcaagtgatcctcccacctcagctgacaaggtattcttaaacaacaaaatgggcatacttgcccctccaaatgtcaggctataataaataagactttgtgttagcgttgtagtagttgtccagaccagtggaacagaatttgagaaacagatccaggaatacatggaatttgacatttcttagaggagaaattgcagatcagtggtgaaagaattgacttttcaaagtgtggtagaacaatttgacagccatgtgtggaaaaatttttcccagattactaccttatcatatgcacaaaaaataaattccagatttatgaaaaatctaggtgtgaaaagtaaagctaaaatgctctttaaagatagataatataggagagtgtctccatgacctcaggatagaaaataacttcttcaacaagccattgaagcaataactgtaaaggaaaagttcatatattcagtttcattgaagtgaagtcattttgttcttcaaaagatgtcataaggatcataacaagaccaaccacaagttggaagaagatatttgcaaaagcattacaacagtgtttgttggttatctggaatacatagagaagaactatagctgggaaaaataaataaataaataaatatgggaaagaccattaagtactatacaaaaagagaagagtaaatgggcaataaacaaaaactgcatttggccttattagtaatcaaaaatgcatattaaaatcacgatgcggcaccattataccatgagattggcaaaactaaaaatgtccaaagcaccaagccttggtactgtggggatggagttttactcaattctgtgagtgtaagctggtacaagcaggttagaaaacagtttggggccggctgtggttgctcacacctgtaatctcagcactttgggaggccaatgtgggaggattgcttgagaccaggagtttgagaccagcctgggccacatagcgagatctctgtctttacaaaaaaaaaaaaaatagctgggcctggtggtgtgggcctgtagtcccagctgctaaggaggctgaggtgggagggtgccttgagcccaggagttcgaggttgtgccactgcattacggcctgagcgagagtgagaccctgtctctatacacacacacacacacacacacacacaaagagaaaaaaaagaaaataaaaaaggaaagaaggaaacagtttgacactctaataaagtggaagatatgcatactcttttgacccaggaatgacctcataactgttgaccttagatattgcactatgagacgcaaaatgagaatattcatagtttttaatagtaaaagccggaaacttttaacaataggactatgggcaacttatgatatattcatacaatggaatgctaaacaacacacgaggctaagtttcacaatattaactgagaagggcaaatcaaaaaaatttaaaatataactccatttatatgaagttcataaacaggagaaactaaactatattaggtggtaaattagatattacttggcaatgcctaatttctttccatctatattaggtagtaatacctaatttattgctacttaatattgctatattaggtagcaagcagcaagaagataatgatcacaaaagtgaagaagtggagacctcttggtgagggaggggaagttgatgactagagggacctgagggaggctacctttgggccatggccacatgggtgcttactgcagtctttaatttgtacatatggatgagaacattgtatgtatgctatgactaatctataaaatgagcatatcaattactgcaacataacatatagtaatttttaaaaaccaagtaacagaattgtggttaaaaactacttttttgagtttatcttttaagaaactatatattatagattgtgaaatattagcatgaaaacaagaaagtcatgtttttatgctgcaaaataatggtcacaaatcctatgtaataaaaattgatattgtgatgtaaaacaaaggctattattttctcactggatttttccccactgttttagcacccttgttgacaatcattgactaaaaatatgaggatctggactcttaattgtatttatctatacttatgccaacaccatattttattgtcttgattaatgttttgaaattgagaagtgagtcctccaactttgttctggttttcatgattgttttggatattctgggtcttttatagttctatgtgaattttatgatcaactcattgatttctgcaaagaaaagtaagattttgatagggattacattgcatctgtagatcaattaggggagtattgtcatgttaacaatatcaagttttctgattcatgcacatgggatgttttcccatttatttaggtcctctttaatttctttctgcaatgtattttagttttcagagtataaattttaggcttattttattaaatttattcctaagtatttaatttctagcgatgctattgtaaatggaacagtgttcttaatttcatttttggtttgtccattgctactatatagatataaaattattgttggatattggtcatgtatcctgcaaccttattaaaattgtttattagttctaataaatgtttactttattccttaggattttctatatacaagatcatgtcatctgcaaatagttttacatcctcttttccaactggggtgcctgtatttccttatcttgcctaattggcctacctaaaacttccagtacaatgttgaataaaagtggctagaaaaattatccttgtcttgtttctgatctcaaggggaaagtatcattctttcaccatggagtctgatgttagttgtgggttttttctagttattctttatcaggttgaggaagtccattctccttttttctttaagctattgattatcaggatggatttaggtggtcttgctgctttggaaattgtagacttccttcttaaagcctgctccattttatccttctaagatatgcatgattttggaaagactacaagcttcccagttagaggagggccttcttgtttttcaccctacatacaatgagcctccttgttggatgccaaagtaaggtctttacatccttcattccctacagaccaggcttcttaaattatcaggccacaggtaacaaatatatttcatctcctgtaccaattctgatgttttggtagtagctgcccgaaggattgttaagaaggaatctgaggccaggcacagtctcagtgctgtcattaattagtgttatctggcctggtgcactggctcaggcctgtaatcccaacactttgggaagccaaggctggcagattgtttgagctcaggagtttgagacctgcctgggcaacatggtgaaaccccgcctctaccaaaaaatacaaaagctagctgggcatggtggcacacgcctgtggtcccagctactcaggaggctgaggtgggaggattgcttgagcccaggaggtggaggctgtagtgagccgagatcacacaactgcactccagcctgggttaaagagcaagagcctgtctcaaaaaaaaaaaaaaaaatgagtgatatgtgtcactggtctggtagtagggaaggctgcaaattgatacaacttctggattagactgtgcctgtgcctcaaccaattccagtggcctttttctcagtgccctccgtactccttcaacaacattaaatcttatggtccatacccctttgtaccaccctctcttctttagatctctgttacaaagcaatattctgggtctcctgtaaagtctctggccttccctcccccgacttttcccctcaacatatctctctagctttctcaactgagcctttgatcctgtgtactgtttgcttgggatattttgcccttcttttacatctctccttgctgaaaattgtgccattcttcaaggtccatctcaaatctgcttccctggttttccccatacctgagagactgttctgcccttaaactgccaaggcataggatatttgggtaccatacctagaattgttttccttcatgtacttttctgagttcctgcccagtactgaaaatatgaaattttttaagtccaggcagggactttatattcttagcatatgactccctgcttttactatggtggatgctcaataaatgtttggtccttttaaactctttgcttgctgtctattggaatgattatttttaagatttcatgttatttctattataggctcattagtaatgctctttattttgtgtttttcctggtgtttattccaggacatacaatatataacaatttagtattagtacacatatataactaggttatatattgctgcatgacaacctgtcttcgaatttagtggcttaaaacaacaaacatttattatctaatagttttagtgagttaggaatctaggcatggctttgctgggttctctggctcaaggtctctcacaaggctgcaatcaagatgttggctggggctgcagtcatttcttctgaaggcttgattgagggaggatgcaattctaagctcatgcatgtggttgttggaaggattcagttccttgtagtctgttggactgaaggcctcagttcatcactgactgtcagctggaaacccccatcagttccttgccccatggaactctgcatagggcaatttgccacatagcatctattttcatcagagaaagtgaaagataataagagagggtgaacaagagagaaggcagagtctttttttttgtaccataatcttggaagtgacatcttagtacttttgcgctattccatttgttatgagtcattatatccatcacccattcaaagggcaggtattacacaatgacatgaataacagatgttgtggatcattggaagtcatcttagaggctgcctaccataacatccttctaacttttaatattctaccttgaaataataatataccattttagatggtatattattcatgtgaaaacctataacaatatattttaattttcctcttctcagcctttgaactacctttctcatcatttttctacatatgttataccacatatagtacaatatagtattatttaattaatttatttattagagatagggtcttgctatgttgcctaggctgtttttgaactcttggcctcaagcagtcctcccacttcagcctccaaaagtgctaggattataggcatgagccactatatctggcctattatttttgatttaaataattatcttttaaagagattttacaaatgagaaaccaatatttaatatttatgcacatttttatcatttacagtgttcttcattcctttttgtagctccagcatcccatctggtgttattttccttgtgatgaaagaactttattatttcttatagtgttggtctccttgcaatgaattctccctcaaaaaaggaaaaagaaataagaagtgtaagaattgatagggaagatataaaactatcattacttgcagttggtatgatcatctgcagaagaaaaacaagataatggatagaaaaaatgataaaaactaataagaaaatgcagcaacttataaaaatcaatagcgtttctctgtaccgatgataactgatccaaaaacagctggacttctggcagtaattttctcagactgctcccttatttcacctaatttttgaaagacagttttttttttctgtaaatagaatgataaggtgtcagttttttctttcaatacttcaaagatgtcacactattgtttttggtttgcatagcttctgatgagaagtatgccatcatttttatctttgttcctttgaacaactttcacattttttcagtacttagataatgatttgctatggtgtggttttttccttttatttttggcttacagtccattgaaatttttagacttgcgcatttatagttttcataaaatttgcaaaacttttggtcctttttcttcgaatattttggtacttcattgaaccctgtggtgtttcccatagctaactgatgctctgttctgtttgtctcagtcttttttctctatgtatttcattttgaccagtttctattgctgtgtctttaggttcattcatcttttcttccgcagtgtctattgtactagaaatcccagcctatgtatttttcattacagatactgtatgtttcatgtctagatgtttgatttgagtctttcctgtaccctccatgtttctacttaacatgcccagtctttcctctagctcccctattaaatgggagcatatatataatgactatattttaatgtccttatatgttaagtctataatttgtgtcatcttagtttgtttctgttgattgatttttctccatttaagagttgtatctttctaattctttgcatgtctgataatttttgattggatgttggacattatggattttatattgttgggtgctttattttatcatatttctttaaatactattaaactttgaaccagcatgcagttaattggaatcagtttgatccttttgaggcttgatttttatgctttcttagggtagtatcaacgtagcctttagcctgcagctaattttatttcactaccaagacaatacacttttcagggctctaattattgccccatatatcacaaggtctttccattctgctggtaggaacacaaactgttcctgtgtctttgtgagcttctggggactggccctcctactttttctttttttagcaattcttttattggtcttgggtagtttcctcccatacgtatgccaatcagtactcagccaaagacataaagggatccatctgaagacctccagagctctctcctatgtagctctcttctctctggaactttttcccacaagttttaattattttggcctccctcttccctgatttctgtcttctcaatgcaggaaatcactgggctgtttgcactgcatcgtggaaagcctctccagtcagtaagctagggaagatttaggggtgcctcacttgttccccttctctgagggctagcaatcttgtactgactgttgtctagtgtctgaaagccatttttttttcatgtattttgtccagttttttagttgtttaatctgattgcttttactccatcatggttggaagcaaaagttgttaatacgtttttgtgatgccagactgaactttcattgtttggctattcaagggctaactcttcagcttattaaaatgcagagaagcttatatatatatatatatatatatataaccttatgttgataaagagagcatatatgacaggacacctttttttcaaactgagtagttagtagaagcatctagaagagaaaacatttggttttctaaactattaggaagatattaagccatttagggcagtgttccccaatcattttggcaccagggaacagtttcgtagaagacaatttttccacggacagggggaggtgggggatggtttcgggatgaaactgttccacctcagatcatcaagcattagattctcatgaggagcgcaacctagatccgttgcatgcagagttcacaatagggttggcactcctataagaatctaatgacgccactgatctgacaggaggcggagctcaggcagtaatgcttgctggcccgctgctcaccacctgctgtgcagcctggttcctaacaagccatggaccagtacccattcgtggcccagggatggggacttctgatttataactttgagtcactcaggctaacagcatcatggttaaggggatatttagcaacagaaataaagtgacttttctgagagtatgcaatgactccattcgccctaggtccaaaatgatgagaattgaaacacatatgttactaagattgtaaatggaagagggcggagggaggtggtgaacatcagcatagggcagaagttgtcacatccacactttcttgtatgtcccctattcctggagctgccttccctatttttttgcatgtctaaagagcaagtcatatcactgatctctgaataataaaagttaccatttattcagtgcttattatgttccttgcactgtgctaagtttatatattatctttcactgaatcctcacatctgcctatgaggtgggtgctattactattaccattttatagatgaggaaattcagatatagagaggtttaattatgtacttaaaggctatacagattagtgattggctgagctaggactagaacccaggctttttgactccatactctgtacttttgccttcatgtctccacctgagttgggatttcctgttcttccaaatcaatctcggcattatttagcactgaccacgattctttgcatcccttgcccccgctccccccgcccccagcacctccaagtatctattttaggcgactccagctcaggaagagcctcgatgttactcggcaacaggtatctctcaacctctaaaatgttccaccttctgatagaattccaccttatagttttgtcatgttgcttccttcaacactagatggtggacttcctcattgtctcctgattagaccttaatcactgctgcctttaaatgtcatgttccttcaaagctcaagacttagttggctctttcagttagtctttcctgatggatcacatgctgtcgaaatccttctaatgctttgaattatcagcatttaccttggatttggttagatggtctttctgactttctctgagattctctggtactttgaatctctttctagatgtttatgacatagcacccctatattcatattataacctgctcaaaattcccaatcatagaatatttactgagttcctaatatgagcaaaacactgattttaacattgcccttctcttttgagacaatcagtgtttccactgtttaatttttaattttttgtgggtacatagtagatatatgtatttatggggtatgtgagatattttaatacaggcatgtaatacgtaataatcacatcatgtaaaatggggtatccatcccctcaagcatttaccctttgagttacaaacaatccaattacactctttaagttattttataatgtgcatttaagttattattgactctagtcaccttattgtgctatcaaatagtaggtcttactcattcttttttttttttttttgagacggagtctggctctgtagcccaggatggagtgcagtggcacaatcttggctcactacaagctccgcctcctgggtttatgacattctcccacctcagcctcccgagtagctgggactacaggtgttcaccaccacgcctgggtaatttttttgtatttttagtagagacgaggttttaccgtgttagccaggatggtctcgatctcctgacctcgtgatccacccgcctccgcctcccaaagtgctgggattacaggcatgagccaacactcccggctcattctttctaactattgtttttgtacccattaaccatcctcacccatccccagtcccccacttcccttcccagcctctggtaatcatccttctactctctgtctccttgagttcaactgttttgacttttagatcccacaaataagtgagaacatatgatgtttgtctttctatgcttggattaattcacttaacataaagtctttaaactcttcatgtttattattcctccaattatttaatatgaagatctgcctggtgacagtattggagtgacgctcctatagaaccaaaagaggcacctgagttgcagttttcatcaaagtcatgtagtatacaccataggcattcagagtcactgtcagtccattgataagatgtaaggcaacagattagaacccacagcccagtgtcagcaagcagaagtgatgattgataccagtgagaggaaatagatgaactaacaagtatggccagctgccagatagttgtttatatgtcagtatcatcattgagcatcacattatcataacctagtacagtaatagatattcctaaagactgagacaaaatgcatataaagccctcatctaatgcctgacacgcataaagcacagaataaagtgtgtgtctatgtatatacattttatatatacacacaaatatacaaatgaaaaggctaaattataatcattgtattttatatatatcatatatatgtgtatatgtatgtatatcattatatacattgtaccttatagaagagaagtatacatgacattttagaatgatttccgtggaagtagctagaattaaaaaatatttttcgtttattgagaagtactttcagttatcacagtgcaacactgctttctgtaatgaggctagaaaaatgaggagccattgtatttaataaaataagaattttttctgtctccatggtaagattaacgaacacacttcaacataaagtaatacaattgctaccttcttcctggtggcatgctccctgtgttaaatttaagtgacagtaaaacgtaatgagttagaggagaaaaattttaatttattcgtttatttgaatagggaaacccaagagatcagtgatagaatttgaactgcgagacaaaaagaaagaagaggttttagttttgtagctaaaattaaggtggtggcacttgaagtgaaatttaaaaatacacattcacttagttttcttggccatattctgcttctcatgtgaaactggacttcctgccttttagccttgtattctgtccctttggaaactgtatcatcttttaaaaatgaagtacgtgactttcgtaatgatcttttatattataaaaataggccgggctcagtggctcatgcctgtaatcccagcattttgggaggccgaggctggtggatcacttgaggtcaggagctcgagaccagcctggccaacatggtgaaaccctgtctctacaaaaatacaaaaattagtcggacatggtggcacatgcctgtaatcccagctactcaggaggctgaagcaggagaatcacttgaaccccagaggcagaggttgcagtgagctgagattgtgccactgcactccagcctgggcaacagaacaagactccatctcagaaaagaaaataacatcaaaataaataacataacataacataacataacataacataacataacataacataacataacataacaataggaatttcaaaaaatctgaaacccgggcctggcacagtggctcacacctgtaattccagcactttgggaggctgagacgggtggatcacctgacgtcaggagtttgtgactagcctgaccaacatggtgaaaccccatctctactaaaaatacaaaaatcagccgggcgtggtggcgcatgctgtaatcccagctactcaggaggctgaggtacaagaatcgcttgaacccaggaggtagaggttgcagtgagctgagattgcgccattgcaatccagactgggcaacaagaacaaaacttcgtctctctccccacctccccccccacaaaaaaaaaaaaaacctgaaacccatcatgactatatcatgatgctgtagcctcaaaatggacttcacaagttcacctgtgattccctcaaaagcacttgagttttgatttgctgattgccagaagtgtatttgaacagtcccactttatatggagccccaagcatattaaatggagattccagataattagtgagctctggatgaagctcctgggatgcagtggggaaaaaactggatctggagtgttaaggtttgggctctgggcctgactttttcccttatcatttggaaattaggctcaggattgtgtattggggaaacacagcaagctgtatgcctatagtaaatagacaccctgtttagtggcattcaatagacctcaatgccatattcattcttccccaaccctatctgtcttggcttcaggcagatcttggcatagggcaccctcatcctcccccactgccacctagctcctgggtgaatgtctcccagcctgggaagagttctgttgaacttcatgaacaatgctgtctgcctagcattggagctcataccctgagactttgccttagtcctctcctttgtgcccagaggcatacatttgagagacagtcaatagagccttagacccctaactttgcacatataagtcctatgaaccatctgggccactcactctgcttagagcaattgcacactgctccctctcctttccttccatttacatctacagggagatttttagtttactaagccctggtaaatgacagttactaagatgtaatacaaatcttaacagtgggaacagtgactactgtttatcacgtgaatactataagtcaagcacaacaaccctttgtggtgctgctagagttaaggaggcatcctcagaggttgaggaatgtgcccaacctcagatgctagcaaatggtagagctttgttcagagtccaggtcctcattctaccacatctcactgcctctttatgttctgatgtctctactgtgtatatcaatgcttctcaaacgcagtatgtacacagttggccctctatatccgtgggttccacatttatggattcaacctaccacagacagaaaatatttcaaataaaaagcaataaaacataacaatacaacaataaaaataagacaaattttaaaagcaatacagtgtaataactgtttatatagcatttacatttattggatacgagaagcactctagagatgacttaaagcatatgggggatgtgtagaggttatacacaaatactttgccattttatttatttgtgtgtttgggtttctttttaagatggagtctcactctgtcacccaggctggagtgcagtggcacaatctcggctcactgcaacttccacctcccaggttcagatgattctcctgcctcagcttccggggtagctgggattacagacatgcacacccacgcccaactaatttttgtatttttagtagagacggggtttcaccatattggccaggctggtatcgaactcctgacctcaagtgatcaggctgctttggcctcccaaaatgctgggattacaggcgtgagccaccatgcccagcctgtgttgccattttatatcaggctcttgaacatttgtggattttggtaccacagggggtcttggaacattgcaatactctatgaatactgagggacgactgtatacatatcacctgggaatcttgggaaatgcagattctgatcttgtacctctggcatgaggccttgattctgtgtttctatcaagttccaaggtgctgctgctgctactgatccatggaccacattttgagtagcaagagtgtgcactatcagaaatacaaggggagtcaagaatcttataaccggattggacatttttaacaaaaatactgttgaaaatttacaggataaatttttgaacattttgaaagaacaaaatgttttatcaactagaactttgcttcattttcaatatggtcttcaaaaacaaaaacaaaaaatcaaaaccacaatgagataccatctcacaccagttagaatggcgatcatcaaaaagtcaggaaacaacaggtgctgaagaggatgtggagaaataggaacacttttacactgttgctgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttgttgtggcactattcacaataggaaagacttggaaccaacccaaatgtccaacaatgatagactggattaagaaaatgtggcacatatacaccgtggaatactatgcagccataaaaaatgaggagttcatgtcctttgtagggacatggatgaaactggaaatcattattgtcagtaaactatcgcaaggacaaaaaatcaaacaccgcatgttctcactcataggtgggaattgaacaatgagaacacatggacacaggaaggggaacatcacactctggggcctgttgtggggtggggggagtgtggagggatagcattaggagatatacctaatgctaaatgacgagttaatgggtgcagcacaccagcatggcacatgtatacatatgtaactaacctgcacattgtgcacatgtaccctaaaacttaaagtagaataataataaaaaaaaaaataaaaaaaacttttgttctttcagttaacatttttttttttttggtaaacatttggataaggaaacctgcttatccaaatgtttaccaaaacagtatcatccagatgatgacagttttgccccacttgctgaattcagcttcacattgctgacactctaagcaggggtctttgaatgtgcttcgggagattcacacttctcctccccatgatcatatacacagtcattcatatatgtttctttgtacatgttctgaggaagaatcggaactgttcatcacattctccttggacttgcaaaccagtgctccaggagaaaggtgcactccttctaatggttctggaattccccatcaccaaatccttgaccaagaagaatacatagtaatatatgcaatttatttgtatcaggtgctatgagttctcaggctgctgactacataattgaagcccttggaaaatgccagttgaatgctataattaggtaaaaataaatgcactaggccttttagataactttccagatgattgtcagccaaagcccaggcagaagtagtccctaatttccctagagctgaaagtcagtgaccttcagcttcccttttccacccttgtgattgtcattagggctgtgcatgtagcaccctcagccagcaatacggtagaagtgaggctcatcgttacttacctaggtctctgcattttcaatatctatctgcaaaatgagcttgatcaatatttaattattagtcaccaggaggtaattagagttacagaaaccaaaaagaatacatatagatgagctcaaggtgttctgagcacaccaaaccattctgacgattcaacatggaaacagctctgatcccaataatagccatagaagcctacctttaaaacccatccctgctcatttttattaggttggtgcacaagtaattgcgggttttgccattacttttaatggcaaaaactgcaattacttatgcaccaacctaatgcatttccatcattttcatagacctgagcacttatgagccatggccttgtagtcagactgcatggattcaaatcccaattattccacttaatagttgtatgaccttggtacattattgtcctctctagtctcagtttcttcttcctgcaacataagaataatgatgctaataataatagtgatagatagtactgctctcatggggtagttttcagattaaatgaaatgatctatgtcaagcacacagccaaatgactggcacatagcaagtactcactaaatgctaactgttgttattactttctaggccaaaaacaatatgtcctctttaacaggagcattgggtacaaagagttactgttgcctatgaaccttaactctttcagttagtggaggagaaattaaaaatctttgtgttatctattctgttcccttggtctttgtgcctatttttatactagtaccatgttgttttggtgactgtagccttgtagtatagtttgaagtcaggcaatgtgatgcctccagatatgttctttttgcttagtcttgctttggctatgtgggctaattttaggattgttttttctagttctgtaaagaatgatggtggcatttatctatcatcgtctttccttccacccagaacatcagagctagttgctacttacttccacattgcctctctgtttctccaccttcctagctttgatgatctgcatttctgctccattgtacttccctcacatacccactaccaaggtcacatatttaaccttacactttcgtatgtggatccactcctaagacctcaacctctgactacattcatcttggactacatacatctcttcctttctcacctcagaatctgctcttggtattcccaggactcattgatcttcataccgttccctttgacccagtatagaagcttctccctactttcagccacttccccccttctcttgccatggattcacactctcctgtatcctgcacaccattgccagtcatttcaacagatgactcataattccaaaatccctcaacaccataatcttatatcattcttgatttaatccccagcataatctctctgctcttgaagtaccaagtgttggtggaaaaagttgcaaaatgatgctcattgggtacacagatcagtagtactttctgatcttagctgggccctccctactgcttgaatgctctcttggatgctcttgtattcctctcttgccatcttctcagagaggcaggatggcacagcagttaatagcccaagcacaggcaactgatgagacttagacgctgaaatcctgggtctgctacttgctgcctgtatgattgggaaaattgatctaatcttaggctttagttttcttcacctgtaaattgggattgctcctcaccttaggggattgcttgtgaataccaaatgagatcatatatggaaagcacttataacacagtgaatggcacacgaagtacaaacacacacacacacacatgcacacaagcacatacacatcagctctattgaggtatgaattatataccataaaatctaccaattgtggcaggacacgttggctcacacctgtaatcccagcgctttgggaggccaaggagggcagatcacttgagcccaagagttcacgaccagcccaagcaacatggtgaaaccctgtctctacaaaaaatagaaaaattagcaggacatggtggtgcgtgcctgtaatccagctactcgggaggctgaggcatgagaattgcttgagcccaggaggcggaggttgcagtgagctgtgatcatgctgttgcactccagcctgggcaactgtaatgaaactctgatatggtttggctgtgtccccacccaaatttcatcttgaattgtaactctcataattcccacgtgtcgtgggagggacctggtgggagataattgaatcatgggggcgggtatttcttgtgctgttcttgtgacagtgaataagtctcatgagatctgatggttttataaatgggagttcccctgcacaagctctttattgcctgccaccatgtaagatgtccctttgttcttcctttgtcttccaccatgattgtgcggcctccccagccatgtggaactaagagtccattattaatctttataaattacccagtctcgggaatgtctttattaacagcatgagaacagacgaatacaaactctttcttaaaaaaaatctaccaactgtaattgtacaatttaatgattttagaatatttatacagttgtgcaattgtcataatctagttttagaacacttccattaccccacaaaattccaatgtgcctgtttacaaacaggcaattgtagtcaattgccattttcactcttgacctctggcaaccactgagtgaaccactttctataattttgctttttcttgacattcacataaatggagccatataacatgtagtcttttgcatctgacttctttcacacattataatattttgggggtttgtgcatgtggcatcatgtatcagtactttattccttttgatggccaaataatattccattttgtggctataccacattttgtgtgtccattcatcagtagatggatatttgaattgtttcctcagtgtttccaattgtgaataatgttgctatgaatatttgtatacagctctttgtgtggaaatatattttcattcctcttagatctgtacctaggagtggaattgctgggttatatggtaagtgtgtgtttaatttttaagaaactgccaaagaatgttttaaagtgtcagtaccattataccttctcaatagcaatatatgagattccagtttcaccacattctcaacaatacttgttagtgtctatcttttattacagtcactctagtgaatgtacagtggttctccttttgcttttaatttaatttccctgatgtctaatgacaattgatggcatatacttattaaacattcacagatctcctttgatgaaatgcctattcaaatattttgcttataattggtttatgttctcattattgagttgtaagagctctttatatagtatagatacaagtcctttatcagttctgcccataatgaattctctcagactttgtttatctgggaatagccttattttgccttcattttcaaaggacagttttactgcatgtagaattattggttaccttttttcatctttcagcattttttttttttgagacagagtcttgctctgtcaccaaggctggagtgcagtggcctaatctcagctcactgcaacctctgttcccaggttcaagcaattctcctgcctcagcctcctgagtagctgggactacaggtgtgtgccactacgctcagctaatttttgtatttttagtagagacggggtttcatcatgttggtcaggctggtctcaaactcctgacctcaagtgatctgccctccttggcctcccaaagtgctgggattacaggcgtgagccaccatgcctggccctctcagcattttgaatgttactccactacctacagcctccattgtttcagacaaaaagagcattaattgtattgatgctctactgtacataagaggcttttttctgttgtttctttctagatttttctatcctgtcttctcttttttgtttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtggtgaacatatttataagaggtcttttgaagttctcatccagcaagtccaatatatggggacatccagaaactttattgattgctttgtttttcctgagcacatctcacttttctgtttctctctaattttttgttcaaaactcacattttacataatatattgtagcaactatggattctggtgtttttcctctgatggttggtgttgttgctgtttttctttgtttgtttgtttgtttggtagtttctttgtttattaacttgcctgatctaaatatgtgaattatgtctcccacatcgtgtgtagcccccgatgtctgtgctcagtttttaaattcttgttttttatttttaagcatggctttctattggttcttttctctgtctgtgtagtttagtgtacagaggctgtgaccaaacatcttgtgccattaaggctactatcttctgttggtgggtctgtgtttggtagagttgctcattcagggtttaagctattttcaagtctgccctggctattactttctactgggccatcttacatcatatgtgttctctgtaagttttagttgttatgattattatgactgtatattctttcctctcagcagttgtaccaaaggcttttttgctctccagtagctctcctttctagcttcttcaatctcagcaggtgaccctccttcttgctttctgaaaagatgtcggccacacagtatagaacccatgacttccgatttcattttttttattgagatataatttacctaaggtaaaattcaccattcagagtacacagctctgtgtgactgttagtataatcacaaagatgtacaactaccatcactgtctgattccagaatgttttcatcacccagaaataaaccctgtgcccattagcaatctcttctcatttctgtttcccaccaactcctggataccagaagttgtagcatgaatcattgcttcattccttttcattgctgaataatagtccattataagggtagatcatatttggtttatctgtttatcacttgatggacattggattggttccacattttttctgttgtggataatgctgctatgaacttttgcatacaaattttagtgcagacatctttttggttctcttgggtttacacctccccactttatattttatttaatgtaaagtatatattataataatgttgttacttacttctcattgttgaagaattaccttctacgccatgaagaattcttaaattttattcccactctctatcaccacttgcaggaccttgctccaacaatatcactcctcatcagtatctctcttcttgctcccacagtatctctccttaccagtcatttcatcttctcctctgagtccatgctgttagtctacaaacatgatctgatatgtttgatcccaagccttcagttacctttaacacttcccatcattcttcttatctaattggttgccaaatctggccaattttatcttcaaattaattttgaaaattattttgtactcctcttccacattcctaccagtcaaatcactctctatgccccagattagacacagttactcttttctctatagcactttgtactttgtgatggcacttagtgtcttgtggaatagtcatttttgttttagttgtaatttgttaatttcctcctggctgcaagaataatcttttattcttactcattcttgcatccccagagcagcctagcattggatcagagcaaaggagtagcactcaaaacatcataacatctgcagattgtggtttaatttggactttcaaatttattatttctcatggtctctctcctttccatccttcatctctctccctccttctcttactaccattgtatataaaactaatttctatttatatgtatcttgaatggtgtaaggtcagagataaccagtttcacacatgtttgtgtctttccacagtgtcagacttttattgatgctatttcaatcacaaaatccatgagccacatggagttcccaaggaggcaattctccttcgtacttcccattcactcggaagtcagagccatgccacagaggcacaagccactccataagtcagtcaatattgcaaaccacacaaaacagtacatttcatctatatatatatgttacagattgaacattccacaacaaacaaattaacatttaacatcaagagaaagaggataggaaaaggggttaatgaaccagtctaggaagacagatatagacaaaaagaatgtcctggtctggaccagctggtttgtcaattttgcaaggaaaagtctcatgtgggcagagcctttggtggcagatgctgggtgcttatcacgagtgaaagcaagacggtgtcagttaagacagccatttggagctgctgaagtcctgctccttttatggccacagagtcctctggtgaggactgatagtggaaaagtatgcctatgtccttatctggttggttgcagtctttatttattaagcaaaacatcttgaccctcttaaaaaagtgccctatgaaatgtaagatggagtctttttctaagatggagttacttatgttaagggcgctctgtacaatatatgcttgacatatgttaggcactcaataaaaagctgttggttaacgcaataaaaaatggtaaaggagatatcaccaccgattccacagaaatacaaactaccatcagagaatactataaacacctctacacaaataaaccaaaaatctagaagaaatggataaattcttggacacatacaccctcccaagactaaaccaggaagaagttgaatccctgaatagaccaataacaggctctgaaattgaggcaataattaatagcctaccagccaaaaaaagtccaggaccagacagattcacagctgaattctaccagaggtacaaggaggagctggtaccattccttctgaaactattccaatcagtagaaaaagagggaatcctccctaactcattttatgaggccaacatcatcctgataccaaagcctggcagagacacaacaaaaaaaaagagaattttagaccaatatccctgatgaacattgatgcaaaaatcctcaataaaatactggcaaaccgaatccagcagcacatcaaaaagcttatccaccatgatcaactgggcttcatccctggtatgcaaggctggttcaacatatgcaaatcaatgaacgtaatccagcatataaacagtcccaaagacaaaaaccacatgattatctcagtagatgcagaaaaggcctttgacaaaattcaacagcccttcatgctaaaaactctcaataaattaggtattgatgggatgtatctcaaaataataagaactatttatgacaatcccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcgtctcagcccaaaatgtccttaagctcataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcaaggaaataaaagaggacacaaacaaatggaagagcattctatgctcatggataggaagaatcaatattgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaggctggaggcatcacgctacctgacatcaaactatactacaaggctacagtaaccaaaacagcatggtactggtaccaaaacagagatatagaccaatggaacagaacagggccctcagaaataataccacacatctacaaccatctgatctttgacaaacctgacaaaaaccagaaatggggaagggattccctatttaataaatgctgttgggaaaactggctagccatatgtagaaagctgaaactggatcccttccttacaccttatacaaaaattaattcaagatggattaaagacatacatgttagacctaaaaccataaaaaccctagaagaaaacctagacaataccattcaggacataagcatgggcaaggacttcatgactaaaacaccaaaagcaatgacaacaaaagccaaaattgacaaatgggatctaattaaactcaagagcttctgcacagcaaaagaaactaccatcagagtgaacaggcaacctacagaataggagaaaatttttgcaatctacccatctgacaaagggctaatatccagaatctacaaagaactcaacaaatttacaagaaaaacaaacaaccccatcaacaagtaggcaaagtatatgaacagacacttctcaaaagaagacatttatgcagccaaaaaacacatgaaaaaatgctcatcatcactggccatcagagaaatgcaaatgaaaaccacaatgagataccatctcacaccagttagaatggcgatcattaaaaagtcaggaaacaacaggtgctggagaggatgtggagaaataggaatacttttacactgttggtgggactgtaaactagttcaaccattgtggaagacagtgtggcgagtcctcagggatctagaactagaaataccatttgacccagccatcccattactgggtatatacccaaaggattataaatcgtgctgctataaagacacatgcacatgtatgtttattgtggcactattcacaatagcaaagacttggaaccaacccaaatgtccaacaatgatagactggattaagaaaatgtggcacatacacaccatggaatactatgcagccataaaaaatgatgagtgcatgtcctttgtagggacatggatgaagctggaaaccatcattctcagcaaactatcgcaaggacagaaaccaaacactgcatgttctcactcataggtgggaattgaacaatgagtacacttggacacaggaagaggaacatcacacatgagggcctgttgtggggtggggggaggggggagggatagcattaggagatatacctaatgtaaatgatgagttaatgggtgcagcacaccaacatggcacatgtatacatatgtaacaaagctgcacgttgtgcacatgtaccctggaacttaaagtatagtaataaaaaaaaaaagaaaaaaaaagttgttggttaaatagtctctgctaaatttgcgacacatcttcccagataagattcttctctccgaacctttttttttttcctttttttttttacacagagtctcactctgccatccaggctggagtgtagtggctcgctgcaacttctgcctcccaggttcaagtgattctcctgcctcagcctcccaagtagctgggactacaggtgcatgccaccacgcccagctaatttttgtatttttaggagagacagtgtttcaccatgttgaccaggctggtctcgaactcctgacctcagttgatccacccaccttgacctcccaaagtgctaggattacgggcatgagccaccgcacctggcctctctgaacttttttaccagtatttattttaattttggttgggggcagtagagagatgcagaaaaggaaaggaaggcatgaaactgcttgagaaatacatcagtgaataaaagttttttaacatttgtggtgtaatgacaaatcctggagaagttttagttcacacctggagtattccagcagaagttggatgccagccgctaggcattcattctgcagaggggcttctctgttaggtacaaggttgggttcaagtaccttctgaagtctagctcagtgtattttttggagtgtagtatactaacaggcaagaacaagaagtggaggagatgtgccaggggaggaatagtgatgacgttgtaggtgctcagctcccagatgatgggaaaagtgtttcatggcctcacacatcttttgggttttttgttgactgtctcccccattactcaatgagctgctacagcatagggaatgaatcttcaacttgtatttccagtacccagaacagaggcttgtactaagaaggcattcaattggtatgtaatggattagaataagttgaattgaagattgaactgaagtcaaaatctgatttctaaggttccttctggcctgaaaattcagactcctctgatttcaaccataacagcctggctaagcctccttgagagaaaccctgtgcttccttagtttaaccacctctttgtggttgaatagtataggttttcaatcaagtcctaggagggtgtcagtttcttgttgtacttaccaggatgtgataggatttcaaacaaggcccaaaagaatgtattttcaggagttgagatgtagccacactttctacatttacaatggcctgaaatgggttacagtttagaacaagctttcttctttatgatgcacaggatttctatgatgggtggctgttaggcaatgagtgtgatgggggagcattttcaatcttagctcaccttagcacaccttagcacaggactctagttacagggtcataattccccatgaggttagcccctgtagtatcagctactttgtatgtgatttaagccagtactgattattctcctgcttagggagaagcggtagaaggcccttggaactgtgagttttgcattccaacttgctaattcaacatagatcctaattccttaaatgcttgtaattagaaattctcgtgaactgtattggtttttgtcaagcaatctgtttggggaacttgaccaactggggcactgctggctagggtgaaatttatttaatttgtttttatgacattcttcatcttggaaatggggttttcaaatattgctttcccaggcatcattacttatttgctggtttttatttcaggattgggactagctcagggtgccagggaagcgttttgtggtgctctatattagagtcgtaatatccaagaaaattgtctgattgtatgtggtatcttggatgtggtaccttatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaatctctgttcactttagaattcacattgaacatgagctgatccaattgctacagccttggcagtgatagaggcaggagacagccaaatccctaggcagatagggaaaggtccccggagaatctccgacctgccccacaagtgttgacaccagatgttttgtgcagataagggaacctgcacagggggcttgcctgggcatgcccacagcatactggaggcccactgggggaatgggatggagccactaggagttcacaccttatgcaggggtggagcctggcctcatcagttcttgtgtggtggccctggtattcaattgtgagggggaaacctgcttggaggacccctctccttactgagagctttcttttcacttaataaattctgccctcttcaccctttaatgtgtctgcatgcctaattcttcctagtcatgagacgagaacctggatttaactgagccagggagcagaaactcctgcatcagtagcaattttacaactgtttattaaggaatacatcttgcccgaggaggttttatattgtatccctcaaatggctattttcccctcctccgtttaaatatttttactcaagtggtttccttcttttggaatgccagtcaactccatctcctacttgatttccaagaccgtctcctccaagatgcctctcctgtctcccctttccatacaatagaatttatgggtttatcactgttagtaccaagggcttcatcatctgctctcttatgttccctgcttgtcaaggtgtagcttattgtagggttcaatgagctgctagccactgtcccatttgactagcagatgcttgagaaaagcaagtacacagtttggattcgatcctacagtgtcttacatagttcttggcacctgcatgtttgctctaggaacaaccttccttattataccgagctgatccttttgggcagcattcattgagtcaaatggcctgtgtgaaacggggtctgaccctaagtggacagagctgagaggttagagctgaaggactcaagccccagacttgctacagattagtagggtgacttccagttacttcagttttctgagtgtagtttcctcattttaagctttgtaaatattaatatctggcatacataatttgaaaaaatgctgtaaggattagaagaacgaatatacgtgcaaacctttaagaaattataagtgcaaacacacgtagtacatttccatttttagagcttcatttttttcttatctgtaaaatagacatgtaaatgcctacctttcttattgggttattgtgaggattaagtagaataacatatgtggaagtgcttagcaaataggaggtgtttaataaatgttgcctggatatgaattcccctctcgggactgtcctgatgtgaggcttttccagcccttgggggatgtgcatttaaatcaggctgcttgtaccttggattaggcaacttaaaaaaagtgtagccttgttagttccaacttctcagctataaaatgcagagtaattaaatttgctagtaaatgtttccaggcctttgaatggcagccaataaaaaggactaaatattattcttttagaattcatgtccttgatgtagaggaaatatcatatttacttacacatactcctgccttggctttttagaagaaaactaagaaaaatgttttcccctctacatttcccacttgaaggtgttatctgtattgaaacagcaatgacagctgccagcaaaggagtgtgatttttctttgccaaggtaaaccaagggttaacatcaaggagtgttggggcccctgctggtgggctggaaccagagctaattccttagcagtcactcactcttctgcctcttcagctgtctctcacccccctcccaccataaaggagtgggtgttccttcaggactgtgcactcgcctccctccctctatccctctttttcccacccacacatacttcccagaacctctccaccctgtggctgatttatctttcctgggaccaaaggcaataaagcctcaaaactaaaacttgcaaggaaagacaatcctaatggtaaacacctaacccgcaatgctgattacttgaaaataagctgttattctgtctccagatcacaaatagcctcacttaaagctctacccctgaaagaactactgaaagattcaggaaggtcaggagatccagattccaattaacttagcacctgatgcctgtgtaactctggatgggtctcagttctctagtagttgaggactggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacctgcattttggaagagaggtatttcaggatcttctcattactgaagcctctcattgtaggaccatggtcatttttaaatctcccacattgaaatgaccagttggcaaaaaccttcaattacaaaatctcttccaaagaggctgagttttttttttttcttggatcacttcacatccttttgaataccctgaggcagtatttttatgggctaacagcaaacagagtgtcgtgtagaaccaagtgtgtcccttcactttctccaccccctgcaaagtttgtgatcttcaaagcatgctggattttaaaataaaacatctacttctagtccaagcctttggctgtagactttgggcttaagtgtgtttttccacagaggtgttacatccccatttctatcagctaaggaaaatgaattcattcaaggtctcccctgccattcatcgaggctccccaagaggagctttccagaaagatctgtgccaattgtaaacttacaagatcctcagcccataacaaaatgcccagacaccttggctctgctgacacaggctgagagagataaaggaaacagctggctgaggtcctgacttttttttcacatttttttcactttttttttcacaaaggcccgctagcctttgcagactggggactttaagattgttcactacccatccagcagggctgggcatacagataccaaagctccatctccagagacgtgaactctaaccaaggatcctcaaaccacttaaatcatgaacctgaaccttgaaatgaagcaaacattacatttaaactcccatgtttaaaatcagtttgcccttttcgctcactctttactctgggggatgcataaacaccttgggtgcctgctgtgacaatcaagttggcaatacatgccacctgctggaaccatagtctccaatctgaactccttccccagctacctgtttcctgtcacaggccttggcattccctgtagcttcattgcttacctcatagaatcatgcttctcattagagagtattcaacagcttcttgtcactggggggtgcacttcatttcctctactcttggacttctgctctacttggacttcatactcttggctgtctctgaggtagaggcagagagaacatccctgactctctgctgcccattttctgccatgggccgccccccccttccagaggaggaggtgttggggaacctctcccacatggcagaacaaccactcaagtctggggaggtctttggcagtcatcttgggccagatgttgtgctagaccaagactgagctgggatttgggttttctattctcacatagccagttggaaagggtggaaacacatgtgggggtcccaaggaaccatgagagacttctcatcattactgcggagtttgactatgatctggcatcctgggctgttgtgtggaggtctctatcatgaccgacctctttggcttctcttgtgccctaaggaaggtgttttttttgctagttttgttttatgtttttagactgagtcttgctcttttgccaggctggagtgcagtggcatgatctccactcactgcaacctcggcctcccgggttcaagcaattctcctgcctcagcctcctgagtagctgggactacaggtgtgtgccaccacacccagctaattttcgtatttttagtagagacggggtttcaccatgttggccaggatggcctcaatctcttgacctcgtgatccgcctgcctcagcctcccaaagtgctgagattacaggagtgagccaccatgcccagccggaaggtgttttaaaattgaaacaaagttgcatagttggttgtgttaattgattcaaaatctttcttttttgcaggggcagctctaggccaaattcttcttgcaagtttttatggatcacatgtttgtctaaagtacacacagatcattcccaaggccagagcaggaatgctctggaagtgccctctctgatctagggcaagcctgtagtttcagggttatcgatagacctcgcggagggcagtgtacaaggcctctggctgcatgaagagaaatctggtgtgtgggactgctctcagaagcagagaggtgtagaaggctgtcaaatgcataaagacaatgtctcttcacttggaggacaatttgtctgccaaggggacggtgagatttggcttcatctcttaagaacctgcattgagggctgctcacaatttcacccgaggtccagggcaattctctcctctccagatcccatatctagtgcttgttgctgctcattcagtatatggatacttctattcttaacaagttcataagtttgtttaaccgatgactgctcatgtctttaaagccattcattcattcatccattcattctctccctcccttgtcaatcaacaaatgtgttttgaaattaagtctatgctggaatttagtgattaataagacccagatccaccaaactatgagcttcctaagagcagggagtgcatatttcatttatgcatacacagtgctgggcatatgatttccataaatatgaatggatgcttcaggcaaatgcactttaatgaagtttgccacagaggcatctaattctcaaaccaaatgctggtattttaatatcttttcataaccagaggtctgagggcatgggaaaattgctgggaaggagggctctggaataacatgatattaagatagatgcatgagtgatgacccaaagcttcttgttgtcacccatagaataacttagtttcctgtcttccctggaagaaatgtaagaggatgtgtggggctagaaagagcaacaagcttatatcacccatatagtagaaaaggagtgagtggagcatcgagcctgatcctgtgcatttacagtagcagtaatagagtaaaacagagcaattagtgcctcatgtagacttggcattgagcaccccatcgcaaaatagccatgttacatatttcagtgtttaccagtgacaacgttttcctcttctttatgatttttggttcctgagatgtttaactggccttaatgcagttttgagagattgcaggaagtgatgggctgggttgggaatggctgggcattcaagtgatttagccatgggactcagcagtgcattgcttttactcctgaaggactcttggaagaaagctctgggcctctgcagagctttgatcagcttgttcagaaagagagcgttttatcgattttatcatggttacctttttttattgttaaaagtgtctatgttgtaaggcctctttgtgtgataaaattctgaaatgatctcacattgatttattttttcctgctttcaaaacacagcaatcttggtagtttcttagtatcccaaagggataaggagtcagcttctcaataaaccttttctggttatgaacactgtatgtattaaataataagcaagccttacagagtttatatgatcacattaagggatctgttaaattccaagagttattgttatgtgtgcaaaatactacagaagcacttgattttgttccagaagcactctgctgggaatgagtgcatattggttctagtgactctgccagtaattagctgtgacctttggtaagtcacttctcctccattccctcttgcatcctgatctgtaaaacgaggagtctcttagtcccttctaagtccctcaccagctttaacattctgaggcttaaaaaagctcataggagacaggctgttctttgcaatattttccatacaggtagtataaacaagtggagaggtaattgaaagactgactttcaaaatctagtacaaggaccttatttatatgggattttaaactgatatcttgagtcggactatgaatgactacgactatcaatcagttatctgcaccaataaaggacaaccgatgtgaatcatttggagatcttcctactcccagtagatgcaggtttcgtgccccagaataatactggaatgtgctcatgtctttagcacataccaactaatcttggtgagaagtgaccccctaaaaaggtgttggaaggcaagggaacacagtggctagagcttaacacatttgttggaaagaagagcatttttacactgctgacaatatgaggactatttgttttcttattttattattatacttttaagtattaagatacatgtgcggaacgttcaggtttgttacatatgtatacacatgccatggtggtttgctgcacttatcaacccgtcatctacattagatatttctcctaataatatccctcccctagcccctcactcccccaacaggcccccgtgagttatgttcccctccctgagtccatgagttctcattgttcacctcccatttatgagtgagaatatgtggtgtttggttttctgttcctgtgttagttcgctgagaatgatggtttccaacttcatccatgtccctgcaaagaacatgaaatcatcctttttctggctgcatagtattccatggtgtatatgtgccacattttctttatccagtctgtcattgatgggcatttgggttggttccaaaactttgctattgtgaacagtgctgcaataaacatacgtgtgcatgtgtctttatagtagaatgatttattaccctttgggtatatacccagtaatgggattgctgggtcaaatggtatttctggttctagatccttgaggaattgccacactgtcttccacaatggttgaactaatttacactcccaccaacagtgcagtgtaaaagcattcctatttctccacatcctctccagcatctgttgtttcctgacgttttaatgatcaccattctaactgggcatgagatagtatctcgttgtggttttgatttgcatttctctaatgaccactgatgatgagctttttttcatatgtttgttggccacataaatgtcttctttggagaagtgtttgttcatatccttcacccactttttgatggggttgtttgtttttttcttgtaaatttaagttccttgtagattctggatattggccctttgtcagatgggtagattgcaaaaattttctcccaatctgtaggttgcctgtaggttgcctgttcactctgatgatagttttttttttgctgtgcacagctgtttagtttaattagattccgtttgtccattttggcttttgttgcagttgctttcggtcttttagtcatgaagtctttgcccatgccaatgcctgaatggtattgcctaggttttcttctagggattttatggttttaggtcttatgtttaagtctttaatccatcttgagttaatttttgtataaggtgtaaggaaggggcccagtttcagttttctgcatgtggctagctgttttcccaataccatttattaaataggaaatcctttccccattgcttgtttttgatagttttgtcaaaatcagatggctgtagatgtgtggtattatttctgaggcctctgttctgttccattggtcaatttatctgttttggtaccagtactatgctgttttggttactctagccttatagtatagtttgaagtcaggtagcgtgatgcctccagctttgttctttttgcttaggattgtcttggctacatgggctctttttttgttccatatgaacttgaaagtagttttttccaattctgtgaagaaagccaatggtagcttgatggggatagcattgaatctataaattacttcgggcagtatggccattttcatgatattcattcttcctatccatgaaaattgaatatttttccatttgtttgtgtcctctcttatttccttgaacagtggtttgtagttctccttgaagaggtccttcacatcccttataagttggattcctaggtattttattctctttgtagcaattgtgaatgggagttcactcatgatttggctctctgcttgtctattattggtgtataggaatgcttgtgatttttacacattgattttgtatcctgagactttgctgaagttgtttattagcttaaggagattttgggctgagacgatggggttttctagatatacaatcatgtcatctgcaaacagagacaattcgacttcctctcttcctatttgaataccctttatttctttctcttgcctgatttccctggccagaacttccaatactatgttgaatagaagtgttgagagagggcatccttgtcttgtgccagttttcagagggaatccttccagcttttgcccattcattatgatattggctgtgggtttgtactaaatagctcttgttattttgagatacattccatcaatacctagtttattgagagtttttagcatgaaggcatgttgaattttatcaaaggccttttctgcatgtattgagataatcatgtggtttttgtcattggttctctttttgtgatggattacgtttattgatttgcatatgttgaaccagccttgcttcccaggaatgaagctgacttgatcatggtggataagctttttgatgtgctgctggattcggtttgccagtatttcattgaggattttcacgtcaatgttcataaaggatattggcctgaaattttctttttttgttgtgtctctgccaggttttggtatcaggttgatgctggcctcataaaatgagttagggaggcgtccctctttttctattgattggaatagtttcagaaggaatagtaccagctcttctttgtacctctggtagaattcagctgtgaacccatctggtccttcgttggtaggctattactgcctcaatttcagaacttgttattggcctattcagggatttgacttcttcctggtttactcttgggagggtgtatgtgtccaggaatttacccatttcttctagattttctagtttatttgcatagaggtgtttatagtattctctgatggtagtttgtatttctttgggatccgtgatgatatcccattgatcattttattgtgtctatttgattcttctctcttttcttctttattagtctggctagccttctatctattttgttagtctttaaaaaaaaaatacctcctggattcattgattttttgaagggtttttcgtctctctatctccttcagttctgctctgatgttagttatttcttgtcttctgctaggttttgaatttgtttgctcttgcttctctagttctgttaattgtgatgttagggtgtctattttagatctttcccagtttctcctgtgggcatttagtgctataaatttccttctaaacactgctttagctgtgtcccagagattctggtatgtagtgtctttgttctcgtcggtttcaaagaacttatttatttctgccttaatttcgttatttactcagtagtcattcaggagcaggttgtttagtttccatgtagtcatgaggttttgagtaaggttcttaatcctgaattctaatttgattgcactgtggtctgagagactgtttgttatgatttctgttcttttgcatttgctgaggaatgttttacttccaattatgtggtcagttttagaataagtgccatgtggtgctgagaagaatgtatattctgttgatttggggtggagaattctgtagatgtctgttaggtccacttggtccagagctgagctcaagtcctgaatatccttgataattttttgtcttgctgatctaatattgacagtgaggtgttaaagtctcccactattattgtgttggagtctaagtttcttcataggtctctaagaacttgctatatgaatctgggtgctcatgtactgggtacacgtatatttaggatagttagctcttcttgttgcattgatccctttatcattatgtaatgcccttctttgtctttttgatctttgttggtttaaagtctgtttcatctgagactaggattgcaaccctttctttgttttactttccatttacttggtaaacctttctccatccctttattttgagcctatttgtgtctttgcacatgagatgggactcctgaatacagcacactgatgggtcttgactctttatccaatttgccagtctttgtcttttaattagggcatttagcccatttacatttaaggttaatattgttatgtgtgaatttgatcctttcattatgatgctagctggttatttttcctgttagttgatgcagtttcttcatagtgtcgatggtctttacaattttgtatgtttttgcagtgactggtactggttattcctttccatgttagtgcttccttcaggcgctgttgtaaggcagcctattggtgacaaaatctctcagcatttgctcgtctgtaaaggattttatttctcctttgcttatgaagctcagtttcgctggatatgaaattctgggttgaaaattgttttcttataatcaatagcttaccaaccaaaaacagttcaggaccagatggattcacagccgaattctaccagaggtacaaggaggaactggtaccattccttctgaaactattccaatcagtagaaaaagagggaatcctccctaactcattctatgaggccagcgtcatcctgataccaaagccgggcaaagacacaacgaaaaaagagaattttagaccaatatccttgatgaacattgatgcaaaaatcctcaataaaatactggcaaaccgaatccagcagcacatcaaaaagcttatccaccatgatcaagtgggcttcatccctggtatgcaaggctggttcaatatatgcaaatcaataaatgtaatccagcatataaacagaagcaaagacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatgggcaaaaactggaagcattccctttgaaaactgacacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatgtccttaagctcataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgctatctacaactatctgatctttgacaaacctcagaaaaacaaacaatggggaaaggattccctatttaataaatggtgctgggaaaactggctagccttatgtagaaagatgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaactgcaacaaaagccaaaattgacaaatgggatctaattaaactcaagagcttctgcacagaaaaagaaattaccatcagagtgaacaggcaacctacaaaatgggagaaaattttcgcaacctgctcatctgacaaagggctaatatccagaatctacaatgaactcaaacaaatttacaagaaaaaaaacaaacaaccccatcaaaaagtgggcgaaggacatgaacagacacttctcaaaagaagacatttatccagccaaaaaacacatgaaataatgctcaccatcactggccatcagagaaatgccaatcaaaaccacaatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggataaagaaaatgtggcacatatacaccatggaatactatgcagccataaaaaatgatgagttcatgtcctttgtagggacatggatgaaattggaaatcatcattctcagtaaactaccgcaaaaacagaaaaccaaacaccgcatattctcactcataggtgggaattgaacaatgagatcacgtggacacaggaaggggaacatcacactctggggactgttgtggggtggggggaggggggagggatagcattgggagatatacctcatgctggatgacgagttagtgggtgcagcgcaccagcatgacacatgtatacatatgtaagtaagctgcacatggtgcacatgtaccctaaaatttaaagtataataataataaaaaaaattgttttctttaagaatgttgaatattggcccccattctcttctggcttgtagggtttctgcagagagatctgctgttagtctgatgggcttccgttgatgggtaacgcgacctttctttctggctgcccttaacatttttttccttcatttcaaccttggtgaatctgatgattacgtgtcttagggttgctcttctggaggtgtatctttgtggtgttctctgtatttcctcaatttgaatgttggcctgtcttgctaggtcggggacgttctcctggaaaatatcctgaagagtgttttacaacttggttccattcttcccatcaatttcaagtacaccgatcaagtgtaggtttggtcttttcacatagtcccatatttcttggaggttttgtttgttccttttcattcttttctttttttttccaatcttgtcttcacactttatttcattaagttgattttcaatctctgatatcctttcttctgcttgatcaatttggctgtttatacttgtgtatccttcgtgaagttctcatgctgtgttttcagctccatcaggtcatttatgttcttctccaaactggttattctagttagcaattcctctaaccttttttcaaggttcttagtttccttgtgttgggttagaatgtgctcctttagcttgaaggagtttgttattacccaccttctgaagcctacttctgtcaattcgtccatgtcattctccttccatttttgttcccttgctcgcgaggagttgtgatcctttggaggtgaagaggcgtgctggtttttggaattttcagccgttttgtgatggtttttcctcatcttcatgaatttatctacctttggtctttgatgttggtgagcttcatatggggtttctctgtggatgtcctttttgttgatgttgatgctattcttttctgtttgttagttttccttctgacagtcaggcccctctgctgcaggcctgctggagtttgctggaggtccagtccagaccctgtttgcctgggtatcatcagcggaggctgcagaacagcaaagattgctgcccgttcattcttgagtaatgtttagcaggcatagtaagccttcttcaatatttaattgtctgcatactgatggatatttttagggatgaagataagtggttcttgtttgcagtggatacgatgcttatgaggaaagaagagctctttttaaatagagtctcttgggtagaaactcccttgattaagttcctgaagtcttttactttgctgatcctcaattcagtttcatcagctcacccagagtttatcaaactttggaggaatgattttaagaaccaaatatggccagatgcagtggctcatgcctataatccgagcagtttgggaggccaaggcaggaggatcacttgaggcaaggagtttgagaccagcctgggcaacacagtgaaaccccgtctcaaaaaaaaaaaaaaaattaagttagctgggtgtgtcactgtgcgcctgcagtcccagctactcgggaggctgagttgggaggatcacttaagcccaggaattgggggctgcagtgagccatgattgtgccactgcccttgagcctgggcaacagcgtgagactctgtctctttaaataaataaatatgtaataaaagtggaaaaaacaggcaaatgtataagtcactgatctataactctaacgtgatagtttgtttatttactaattatattgccaactgacactgattgctcagacccttaagaggcactcttgtgtgaggatttcactcaagacaccaaattacagacagtgaatgttccatggagaacagagttgaaatacttccatgcatattgtctctgagaaaaccacctcttttccaggagaggttgttctgcagagggtgccagatcccaatcctgaagaatccaaacaccttttgaaattgtattctggggctgaggccctgcttgttcaccttgatcagacaggtgaatttcctcagcttcctcagccattgatttctaaatgatctcttactttgaggtgcagataagctttcttgatgtagatcctttccattttccttgtaggtacttcgtggttcaaactttcactactgcaactacggttaccataaagtgattactatgtgctagattgtgtactaagtgctttccatgaaatatttagttgtcacggcaaccctacacaggtctggccaataaacatttctgcaatgatggaaatgttttataatactagcaccacctaactctggtagccattaacacatgtgaatattgagcattgaaaatgtttctagtgtgactaagaaactaaagttttaattttgtttagttttgattaattaaaatgtaaatagctagtgtggccagtagctatggtattgacatgatgcagatacaagtactttgattctcatattacatgtagagaagctacagttcaaagaaattaaataattttctcaaggtcacagaacttgcaaatggcagagcaaggatttgattttgaagtcagtgtccttatccctatagtgtatggccactatttagactgtgcctgctctttttgtatccaaatttgttaagaaacacctctggtacatttgcaattaaccattgaaagaaataaaactgataattatacaataaaggacaacagtcattaaaacagcactaccctggtcccaaaatagaagtatggctaatggaacagaagaaaaaatgtacaggtatgaaaatagatgttcttgtgttatatttatattcttatattactgtgatgaactgagcatcacaaaagaataagaaaggaagagctatttaactaatgacttgggaaaaactggttatcaattaaacattcataagctcccaacctagtatattgtatgaaaatatatttcaaatggcataagattcaattattaaagaacaaacttgtttaaaaaatcaaatcacaagaaacagcagaaaattcatttaagaaaccatctgttccatggtaagttctgaagaaatcatgaaggaaaaaattacagatttgactgcttaagaaataaagactaatgaacaataaaaatatacatagaataaaaaggataacagatttggggaatatttgcaacgaataagaaagacaagggtgataattacattatcaataagaaaaccttaagatacccgggaaagttaatggaaaagaacgtgaacagacagttcacacaccagggaatataactagtgattgagcttatggggaatagttgaattagggcttttcaaagaggtacaaattaagtgatgacaagatagcatcttatgccttttgaattagcaaacatttaagaaaatagtaattctttgtgttgaagataaggcagaaaactgctgtatatgctgcctgcggcagctaaaattactctgatttaggaagcaaatttgatgaagtaatcaagaaccataaaaatgttcattcagtctgacttaataatccgcccctgaaaatttatctgagaaaaaaatcctaaggaaaattcacctccttttaccatcaaacctttaaagtagaggaaaggccatatattaaataatgtgaagattttaatttatagagttagccctaataaggaaaggaagggaagcaatctaaaatgctgagtcattggtgaaggccattaaatatattatgacacatatactctgtagaatattatgcatctgttaaagtgataattatggccactgtgtagcaacatggaaaatgtttataatggcaaacgaaaaacagcaggatacacatttgtatcttgtctaaaatttcaatcctgtcgaaagatacacatgagggccaggtggtggctcatgcctgtaatcccagcacttagggaggccaaggcaggcagatcacttgaggtcaggagttcaagaccagcctggccaacatggtgaaaccccttctctactaaaaaaatacaaaaattagctgggtgtggtggcatactatgactgtaatcccagctacttgcgaggctgaggcaggaaaatcacttgaacctgtgaaatggaggttgtggtgagccgagattgcaccactgcactccagcctgggtgacacagcaagactccatgtccaaaaaaaaaaaaaaaaaaaaaaaaaaagatacacatgcctaaggacccagactggaagggaactcaaggcaaacaaaaacagttggtatgttagggtcatgggacttgtttttatttttatttacctttgtcctattttctcaataaactcaaactagaaatggaaacacagtcacagaaatgaaggatattcataaagcattgtttcctgttggaagctgccttttattctcctttgccctcagacatgtactcctcattttgatgagcagcaagtgatcagaattatccagccttcagtcaaacataatctgtagaagaaagcactgctttatgcaaggagatttactgtgtgatggttggcaaaagaaaggatgcacaaagactctgtgtgggcagatttagcagaggtactgaaagtgaaaggagaggccatctggtagaatgtgctgtggcaaattaaactgagttttatgaacatgaaataccagaagaaaatccaaatgccctggacttggaaaaagcccatctgaggcaccataaaaccaatcaactacagactgacaatatgccactcataagctcagatatgcccattactagggacagcatcattcaagccagattttgcagagctcatttgatgtggatttcccgtaggggaaaaaatcaacaaattacccaccgtgtcccccacacatgcgcagatgcctgatacagagctactgtttcaataaatatggtaaatgcataatgatctggaaggcattggtttggcttctcctgcctcacattcattagtgaactctgacacccaaaccagacaactagacttgggtatggatataaggagccatttttccctccctccctccctcctttccctgcttgcctttctcttttccctcccaattattttcattctttcctctcccctccctccatctctccctccttctctcccttccttccctctgtccctccctccctcacttccttccttctttccttcctttgtttctctctccctcccttcctccctcccttccttcctttctttctcgctccctcccttcctccctcccttcctgccttcttttcttcattctttctttcctgtccctccctccctccctcttcctcccttccttccttccctccttcctctgactctctccttccctccctttctttcctcccctcctcttttcttttcttcttttcctaagcagttcatatccctatcctttagcctgtatgtctggaattctttatagttccactacacttgccccctcattttgtcctaatgttcctccaattctccatttcctctttatttttactctggggctctttcgagtgcatgtatcctgcatattcagctacttctgcttttcctcacctttaatgctttgattgcttccattagagtgttgataattctgtcatgatccttgtctgtatatagttcttccttatatttcaagtccctttatgatagctctgctacaagtgtgttttcaatggcactgtagttctgctgtggctttggggctgctttggttttctttggaaggagatagctacatgggtagcttgattgaggaagggcacaaaagcagtctaagtgtttgaaggactgtctctgggaagaggagcttagctattcccatgtggctagaaagggcacaacaaatcccactgggaggtgtacttagactctgtaaaaggaagcacattctaatatagcaggtcaaagactgaatgggctatttccagggccgacatatctgggtgttcagtttgtgcattgtacaaagacacctggccgagaaaatgaatgggagctgaaatgcagcccgtgctttgctcactaagccctgtgctctggagtgaggccatgccgacctagaagaacgggtgccaagataagttaccttttgatattccacataaagacaccagtatgtgctagtggtagccctagctatcccaggaggggatattgtctactgttgcagaacaagggagagaatagatgaacttgtgtgctagaggaagtgcttgcctcttctccaccatctccacatttcctggatgtgctttgattctattgcactgccaaacaatccctttttctaaacttgtctgtgccaatcttgtgtcttcttatctcacatatgctaacaacatccacattaagactctcaacttccccgagatggataggtgccatcacataccgtgctggattgaattctcatttcagagaatacatcttctttctacttttcaatgaggatcagcatcccattcttgcccaccacctagtactttgttaggaacacaggaggtaaggcaaactgaaagcactttgaaaactgtgaagaattttttcatcaatatcattagacaagatcctgttacaccaggaagtcaagaggctttactggcatttagtgcctcttgtttcaccatcaagattccctgtctacaacagttcatagctgagtctctattcatcaaactttctgcagggttgacatacacaccatttatttggctctcagtgtataacatttggtggtgagtcaccctttcctgtgtacatcttgtttaccccagatagactgtaagctcctggaccaattcaggaaaccacatactggtttcctggtatggaaaggaaatgttttatttcagaaagtcacttctctccatgagcaaagaacagtgagggtcattttaaactgttgtagctgaattccaaatggcaactgagatggtcccaagatttgggccatgtcaatttagggagtaggtaattaaaggcagtccaacaatttcacaaatttatagttaggtgccatgccgtgcactgtcttggaattcctcacaaggacattgtgtaatgtatactttttgaattcaattgaatttatccttccttccacctttcctcccttccttcaacaaatattcattgagactgtactatgtttcagtctttgttccaatgaacctaaacagacaaaagtctgtgccgtcatggaactttctattcttgtccagatctgccatttactagttgtgtgtagactcaaccaaatcacttccttctccggaccaagtgtgttcttctgtgtacactgaaggtttcacagatgtttccatttttccttcctattattttttctttaatcaacctccgtacttttaattgctttcttggttatctatttttgcctaatatccagtactgtaaggaaaataacaaggatgtactttttcttttcttttttttttctttttttttttgagacagagtctcactctgtcgcccaggctggagtgcagtggcgtgataacggctcactgcaacctctgcctcctgggttcaagcaattctccttcctcagcctcctgagtagctgggattacaggcgcccgccaccacacccagctaatttttgtatttttagtagaggcggggtttcaccatgttggtcaggttgatctcgaacccttgacctcgtgatccacccgccttggcctcccaaagtgctgggattacaggcgtgagccaccgcgcccggccgaggatgccctttttcaatggttcacctttgggtatttttatatctatgtttgcctagatcattcctttgttttgatatcatcaatttgtttagcccaaagataatggctgttgtatttccgtcttgagtgccaagctcacaatgagctgttactcagtttttgaagtattttctcccattataacatcaaccttctttcatttatttcctttagtcctctgtcctgagagcatcccccagagttatagccttggattctcaagctgcaggagattgcatgtttaaccatgataaatactcaggacaaaattgagcctttttttctctcataattttatttgtttaaatcttgactgcttatagtaaatatcctctcaaagataatttcatttccaaacaatttggtacctgatctgacgcagcttgagtgtttattttggggatgttgtttttcttttttaatgagttccccaaaatagcttttattgtttttacatctttcttttttttccccgggctatcagagggattgtagttagcattgctggaggattattagtttattaataataattatctcttaaatttcttttttggaagcagcatttggtcattattgaaaaaacagagcttttaaaaaatggaatgactttaaggaatctgaagaaaagataaatgtactcctgtatgatttttatagtgtttgcaatccagtgatcattctcacattgtttaagtttcagtttcaaggtgcgttgtccccctttatctgtggggaatgtgttccaagacccccggcggatgcctgaaaccctatatatactatgttctttcctacacatacttacctatgataaagtttaacttataaattaggcacagtaagattaacaacgacaacaataaaatagaacaattataataatatgctgtaataaaaattatatgaatgtagtctttttctctcagaatatcttatactgtgatcacgtatttcctgactgtgagtgaccatggctcactgaaaattgaaagtgaaaccacagataagggtggggactatgatagtaaggtaagattggtattaatatattgtctgagcaaggcaactaaatgtgttccttttggaatgcatactgttacaattcaggtttaattattaaacagcattggtctaagtggatgaaggttctgttttcgacccataatttaacacatgtcaagtttaaatgtacacagtaactcaaaaaacggcctgcctttggttgttgtttccaggatactgtgagcattgcaattagcaataaggaaagcactgaccaactcccggaaccacatctagttgcctggcatggaaaggaaatgcttttattttagaaagtcacttctctgcatgagcaaggaacagcgagagtcattttaaactattgtagttgaattccaaatggcaactgaggtggtcccaagatttgggccatgccaatgtagggagtagaggattaaacacagtccaacagttttacaaatttctagttggtgggtggctgggaactgtttattattgttaatgttactgaaaaatcacttgtttcgtgttaatacatcatcccttctccagtcctccagccccagtgaattttgtgttgatatagcaatgtgttcatagtgccactttactgaatcagttgttaaacaaatatttgtgccatacctactattttacagacattatgtcaggcactggggaatttatgttggtgaataaatagacatggttcctgctctcatgaaacttaaaatctggtctttttaagcaagctatttcacttttctgagagtcagtttcattatcttaaaataggcataatgcctatctggaaggattgtggtgagaataaaatgagactatgtctataaagcactggtgtgatgtttggcacatagaacatggtagaacctcaacaaatgatggctcttataatcattgtgagtgctggagagccccagtgctggtctatggattgaagagctatcgaagaggttcttgctgaaggttcaccccttggagtatctctactcaatccactgagtgggaagatttgaaggtaacaggctacgggggttgaacttttcccacatggacattttaaactcagttcaaatacatttgaatgagagagcaaagtacattaagcacagaatttctagaactcaccttgggaaatttaaagctgaccattttctctagcattttggaaattatcaaaaggccagacggaatgcacaattcacttcttggctgccaggagtgaaggagagaagaggtgaggttgaatgatttgaaattcagttcgtctgtgttagaacaagtcaaaacaattctagctgttaattttagttagttgagtccagagtaaaggtttgtaaagggcataagaaagcaacattacttttttctcacaatgagcacttaaaagatcttttaaaagtgtttctgtaatgtaaaagaaatagtcttactgcagtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgattcacttacaatcataatgtagggcttgatgtaaaacatgagaagacttgatgtttctgggtaacaatgggtgcagctcttgattattcatagtctgattatccttactggggagtatcctgtctcattttacttcttgttgtctgaatgcctaccttttacctttgtaaactccagatttaaagtttgtgtagggtggggtgcggtggctgacgcctgtaatctcagcactttgggaggctgaggcaggaggatcgcttgagcccaggaattcaagacaagcctgggcaacaaagcaagagaccatctctaaaaaaaaagaaaaaaaaaaaaaagccaggcaccctagcacacgcctgtagtcccagctactcaggaagctgattcaggaggattgcttgagcccaggagttggaggttgcagtgagctatgattgcatcactgcactccagtctgggtgacacagcaggagacactgtctcaaaacaagaacaaaaacaaattttgtttaaaactgaaaatggggggatagatggaaactattttactttttatcttaacagcttgtgcaggtagaacagtttaatgaggaaggagctgacactcttgcctatggtgtgttgggagattatagattttagttatccatgtttatgttgtaccccaggactacagattattggcagctggctataaacaaatgaccaaataaatctacagttgaagttacctagtgtctccaagatttcagggatgatcaaggacaggtagcagagcctggggccatcagctgtgtgttggcctcatctcattctgaacccctctcctactttaatcagaaccctgatacttaagggactgaactagctgtgacatccatttatccattttatagaatggctgtaggtaactacagggccataatcggaattctatacagggatgggtccctaggctcattaattgatgacagggtaggagaagactttgacacctacagattcattagagacagctgaatggatttattccaaggaggtcacctttgaaaacgcaatgaatttctatgggtggataacaatgcaaataggcaaggatgaagctttagatttaatctacatctgctgcaacaatgttctgatatagaattgtttagcccaagtcctaattgaaaaggtgagtaacattgatattgtctttctgaaatggattagaaatagggctggaaattggatgctaggaagagggacatataaggtttatgaggtaaaccccaataaatggaatttactatgattatattaaaaatagagacaatgtcatgtttatacagcgtgtaatatcatgcataatgtcaaatgccctttggagttactcctgtcccttgtactgataacatggcagttttttgagtcctagcatagggaaacagtgaaaatttccaggagtgcatcttttcaataatgcaaaggatacatatcagtgtttcacaaatttctctcttttttttaagagacagggtctcactctgttgcccaggctggagggcagtggtgcaatcagctcactgcagccttgaactcctgggctcaagcgatcctccctcctcagcctctggaatatttaaaactacaggcgtgcatcaccacacccagctaagttttaaagttttttgtagagacacggtcttgctgtgttgcccagactggtctggaactcctggcctcaagctattctttctccttagcctcccaaagtgctgggataatgggtgtgagccaccctgcctggcctcacaaccttttgaaaaagatcatcccctaaggaggaaattcaatttaaataatcctaatgagagaacttaaatactaaggaaaaagatttaggggaggaggattggatgtgaagggccacaatctactgtaatatctttttttttcactttccccccaaatcaattttcttccccttatggacaatatcacccttgttggaaatgcatgatatagatctgtgaagccagccaatttatgatgtgatatttaaattgtctctggttatggatattgtttccattgcccacattaaccctcaagaggagggcagtaatgccaattaagttcttgctatgtgttagatcctttccatgcattgtttaatttcacccttacaacaaccctgaagttgagaagttaagcgactttcccagactcatacagtggcaagtcaggggttgaacccaggcctttctgatgccagagactagaatatttctaacacttacttatcttacgggaggcattacaagatgtgtcttacatagaaaggacataatggtgggtgtttatttctgaagttgattttggagtctctggattgcattttggttaccctcaggtagaatagaaaagagaaacttgattaatactaaattttctcttttattctctccacccctctttaatggtttgtattgtgtttcttagtattatgtggaaataaccttagcttcttgatatgtgctgagatcctaggaactcagtgacttacagcacaggttggataaggttaatattatgttaataacacagattttatagctcttctactaatctttacatagattaatgcctctcaattttacaaaaaatagaccattaattgtgaagctggaagaggacaattcatggcagaaaatgttaggttagtagaacaatagtcatttacacaggattgttaaagaaagggaaaggtaaactgatgttcaacatctagtgcttgagaagttgctctgcacataaaatcaaaccaggcagctttgacctagctcttgggagagaatatatcaggttgtattgatgatgcattgatgagaatacatcagtgtgtatgatgtgggagcgtgtgtgtgtgtgtgtgtagatgtagaaaatagcattttcttatctggactttagacttcatagttaaagtaaattatgttcatacatctgtatgtgtagacttcctacctgtgctttaacgcctctatctccacctccatccctttcttctgtctccccagggggcaatggtgcaagtaaaccaaattcgaaatgcttggtcccagtgttgttagcagctgattcataggtgctcccctcattttagataagaagaaattgagatttgcaaaagtcacacaaactggagctcagattgcctgatttgtactggtatattgcactgtctgtcggccttcactctttctgactctctgcttcttagaaaaagagagtgtgggaaaatgtgctggcaccttcatctggtggccagagaccaattctaggccagaggtaagctttaaagagaataaaaagtgaggaaaattggctcaccagagcacgtcattatttacataataatacattgactacgatgtgggctttaaaagaaaaagaaaatgaaagtctttctcacaaaatactctaaaaataaactttttagggaacattataaaaccatacaatgtattttttcccaaacacaaagtcccactgaaatctgtctcttggttttttagatgccaaaagtcaactcatcttgatgtagaaaatgaggaggtgctgttagtgcatggagaaatagccttctgctaagaggtagttgacttagtttctaacttatgttttcgtttcatgctatgtgatcttggtcaaatcattttgcctctctggactttgatatccttttctgcaaaataaaagggttcaactggatgattttgaaagcacctctctcttctataagtctctgcaagtgggaagatgattagtttgtagtcttataatgtttagatggtttaacactgctatcttctagcttttctaaaagttttctgatgttgtcataggcagttttgtgtacaaaggtcatttgatggatgctaatgtacctttggttgataggaggttcgtaaaagaaatatgcatcaaaccttattattcgtgtattagataaagcagatctactgacattttaatgtcaccaagtaagtaatttataaagtcagtgtgccccactgaaacatttccaaagatatttactattgagtacttgggttctgctgagggtgaatactgaaatgtattctttttgtgctaatgtttgcagtacagtgtttcccagcagtcagaatgattgtctgatattgttagtgtaacccctgtgatctaacataggcttctgtgattataatgatttttatttgaaaaggtaattgtgtttgcctggcaacctccccacttgattttttttctgtatacacctctttctttggctctttaaaagccagcagtagagtatgtgtagttaaaataccttcttcttcttgcatccacgtttttgactgtgtctttgcattgccattggggggactggagagttaatatgctgtgttgcctaaaggaataaaagcaaaaattatctttgcaatcaaaatattaccagaaagaatttattaaaaattacaacagagagaaaaacggacattaaaaagagatttttatctttgtttgctttttgttttattggcttgccgagctttatcagtcattaatgatgaaggaaatagaagacctctccaaacctatgcatttgaattttgtccagttatcaagctttcccctgtgcacacccaattttttttactagctcaaggacaaagagatttttctcattttcccattttaagataagctatataggaatctgggtacatttgagtatgtgaggaaagatcaaggactctgtaagcatgcatctttccaatcatggcccttttagcaatttgcagtcattggaatgtgggagtttagggagagtgctgtttccagagttagacacttcggtaattccactactttagggtttcctgccacatgctgttggctttcagtaacaagtttcagtaaggattctcttggagtatgcatagaattttcttaacaatctgtgagtgattataagcagtatattctgggctcttgtgttttcgggagttaagagacctctcttttgcagtccccaagagtccatggcgctcatctatgaaaacggcccaagtgacagccagatgaatgtgtgctgagcgccactgaggctaagtgccaggaaagtagaaggcaccaccctgtggaagagggccaggaattctagaggacactactcctttgaacaaaaaggatgtggaaaacagttttctttgtttccttttgagttagctttgggcatgggctgatgccaagcttcgtcctatgacaggctcattgccatccatcctacccaggagggatgcatctctgagcatggagacagtgctgaggaaggcaggttggatggtgcttccttatctgattatcagacaagccatattttttcaaaggaacagtgagaacagatgatctttctgatctcgtgttaaatacagtactgggcatctttagcatatgtgctttaggttattgccttcttagcctgctcagaaaaaaaacacagcactggcagcattccgtttacttactcattagaatctaagggctggaagatcccttgaaagtcatctactccaccacccacccccatctgatgcaccagctgtttctacaaccaagtcgttatccttgcctatgcatgatgttctcaaagacacggcattagaacaccttccattgattgagttgaaatctttttcccattgctgtcatgcactgatgctagctgggcttcttggaaccatacaaaacaagtctaatgttcttctctatgccagcccttcggagctttatgtcacattccagtctcacccttcctttccatctcagctgcagtaaggttgattaacctgaattaaggaagacttgagggtggggtgagaagttgcacatctgttcctctgataacatggatttgattctccctctcccttttggtccctctgatagaaataggctctagttcttccatattcctcttaacaatgttcagatgtggtctcactagtgttgatgatctccgtctttatacttaactttgattcagcagtggagtccaagattctgttagttcttttggtgatctcaccatactagagattcctattcaacttgtacttgataaaaattttattattgtctgtgcttcctctaagccactggtgctcaaccggggtgatactgtcatcccccacaacgtccccaggacatttggcaatgtctggagacaattttgatttttatggcttgggggatggtatactactggcatctaatgggtagagtccagagatactgctaaccatccaacaaggatgcacaaaacagccccccatgacaaagaattatccagcccagaatgttaatagcatcaaggttacagaaccctgcttcaagccacttgtgtccatattccttccaaattttttctctgtactgtgaaggtagctttgttgactcaagtcaggatcttttgcttattcctatttaatttcatctggttagaaatcatacagctgtagtgtttcaagaccttcttggacttgatatatatcatcaacgaacatatctgcagtacctccagcttcatgcatgaacccctcttgcttctgatggactattaataccaaattcagggaactctcctcttaaccaaaagcaaattgttttcctagactggcatgggattccatggcaggtggactgatgatcattaggaggtgctgtgctcagttttttttcttttttacatttttggtactcccagacttccttagtagagagctggtgtgatctagaatggcatttgtatcttctcccacccaattagattagcaagagagagtttagccaagcaccactgctctgcaaatggagtctccaaatgccacatcagcagaaagaaaagtatctacactcataagagcatggggtagggggaaacaaggatgcataggttgttgcttggcaaatccattcactcctagcactgttccagtgatattagttccacatgcctagacagatagagaatcactgcgactggtaggcaggtcctgctgtctctaatgggatctgttttaaggaaaaagttcttgcatctattctgatttctgtatcaggccaaacaatgctagagttgctgacttaatgaccacattggctccgctgttggtcaagatcatcagactctcatttcagctttcaatgatattgcatcctgcaaacaaaccacttgagatgagcttggtataagggtcctactaagagagttctgattaccttattcacttgagatgaaatttttcactggagtgaaattaccagacaactaaaatgttttttccaagggacaaatgtgcaatttttgatccccaagagtagaccagaggccaaaagctacagccattctaccttgcctgctgtgtttctgtggcacacaaactaagaatggtttttacctggttaaatggtaggaaacagtcaaaagaagattttgtgacatgtgaaagttgtatgaaattatatgaaattcacatttcattgtccttatggcggggtcatcagaacgcaaccacacttatttatgtgttatttatgctgctttcttgaaacaaaactagagtagttgcaacagagaccttatggcccacaaagcctaaaatatttattttctggccttttacaggaaaagcatgccaatccctggtctagagcttaatttgtgtaaaagacccttcattttgtgacttttattctgttaggggctgagaaaataaacttcttatgaataacgtatttgatgggagtcttttggtgtctgagtgtggactcaaggaaggcaccgagggcttttgagactgctaaataaggcatctatttctatatatactgtcatggtctgggagctggaagaaatactttaagaagctcaagttgccggatgggatttctggattttttatgtgcacaactaatagcctctcaacctagagttgtaaggtaacttctaatgttcatagggattttgagaattgcttcctgattaactctaagagttgttcagttatttacattctttcagtagaattcttttatacctcctatgtgccaggtaataaatgtggagacctttcccaaagctttttgtatatatttaatttagagagcttctacctcaattttgttgcaattaaactgatgctaaattatgttcttcccttttgaattatggctgattgtgtctctcatcatacatagagatgttagaaagctaagctttacatttcagctgcttatattatatatacacacatgcaacacacattcacatataattgaactaaattgacattgacattgagagaatatcccctgatatttatctatgtaatttttattcttaggattagattaatcagtgattgagactgatcctctgaatcaatctctctctcgatgaaatacacaatatgtataatgtatatattaataattataattattaattgttaatatataataattagatattataactacacatatatatttaaaatttatattttctccagaactttgagttttaaccctagagagactctatcacagcacccagaatattctattttaatagttcatttaggataccaacactggaaaactccagttttccagtgatgaataaagttggaaactttattcatctagcacgacgtatggtgctcagcatagtagatgcctctgaaatgctgattgaatggaactaaactgactttaatcgagagaatagccttgagatttctttatctatataatttttatccttaggattagattattcagtgatggagacttgacctaaaaatatggctctgtaatttcactgatattgtcaagagcttgtttatgctccatcagcatcaggtccgtgggtgttgattccacttataggagtccctgtggtgttgggagggggccagaaaagtaaagagtggtctgctggaagtcagtggattagctggagagctcattctgctgatggctgccctggtagagcaccccatttggaagtggagctgaagggagagacagtagtgatgctaagagaaatgagaggaagatgagaagggaaaaattagctcatccaggcagaacctttattaaatttagttccagatcttgagttcacaacttaaataccctgtaagatcagaaatgttattatttgtacctgtagatcaagacttagaatacaggaggatcatggctatccaggatggaagagacattggagcctctctatttcagccctctagctcaatggttcttcatctgggttagtcagtggcttccctgaaaaggctatgtgtctatgcatttttcttgagaagagattccacgctttcattattttctataggatgagtccaggaaacctccttcatccccactcccccaaaaagttaaaagccacctctctagaagatgtgtgaactcttcacagggattctgataaacaattgctgacagatctcatgtaaaccttcctataaaagcgaatgtaggatttcatgaggcagcacagctggaattgttgtgaaattattccccacattgagtggaaatttatctctatgtaactttccccaacttcattttatttgtttgttctctgctccctaaagtaactgaaagtaagttccacccctcttctatggtcctttgaatataaggacacaatttgtatgccttccttaaggcgacttccccagggaaaagagcctttccaaacttttctcatgtatttgtgctttacagactcttccctgtgttggttgttttgtctgttttgtctttgtccctcataaagtcatggcagctagaattgaagatcgcatttcgggagtgttctgaccagcacaaatcagaatgctatcatctacaatcccctcgttctaggtaatatatttctagtaatgcccaattaactagtttctgtgatagtgcctcacactgctgactcataatgaactgttgattgctaaagcctcctccaagctgcgtttggaggtttggcatgtgaatctatttatacccacttttttatatttaaaaaaggcatcacattgatgcccaaatcaggactgttatgcacatgtatgtagatgagtaagtttccctttatgaatttaaaaaaacacacacacgtcatttaactttattattcttgttgctttgcaaaatattaaggacatcttgatgctttcagaatgaacaccaaaacccatgtaagtggtataatacttaacaatgttcacacatgaaaatacataagtggtttatttaattcatgatcaattatttgtttttgaaggaattttcagcattttttatttggacattctggaaatgaaatagtaaacatgattagttcaggtagcattgagaacttttaacggatataatacttatgaagaatttatttgcagcagaaagtggtcacttgctatttataagatgaggaagatagtgtgagccaagtaggaggtggagataacctcctgccaacagatgccaaaatgggagactgccactcggggctgcctggaatgcaactgcacctagaagcatactgtgttgtatgtgtaaacaagcaagaacatccttgtgtaaatgtgtggtggctctgctccttggagaaatagaatggtttctcaacatcattttcttataaattccttgctgttaaatcagtagccatttatccagatacttgtagtggagctagagatccccctctggttccaagtctataatgaattgtggataaagactgggctggcttaaacatcccaggcatggcaggcccctcatatgggaatagagtcaccaggatctatctccttcagaggctgcttctgtcggatgcactgatgaccagtgagagtattctactgtgtgtggtaatctggaaaggcccctgccttcatccacagatctgtctattcagggcagggggaggggaggaagagaacaggccagcctggaagcactgtttctctctgtctttctctctcgggattttctgggaatcaaaaggaaaatattttcctgatagtttagcaaaacatttaattaggggtggtaatgaaaagtgattacagcagcacaatgcgcttgcattatgagttcgagttaacatatttaggggtacttgcgcacaagctgtttggtgattagggaccaatccgctgaacatgaaaataaataaataaatgaaactgctgtgtgaaaaatgaatgtgctgaaattaggctgtgtataattgcaacgaaaccaaaattgagcagatacagttcccacagagaggtggaaaaccttgtcagggagcattcgccagcctgagctgttgtttgtggctgtgtgtggaatggactcaaagcccactgtggctgctggaaagtggtagggtgatttgatctattcagtcagaactagctgatgtagtgaccgaattatctcaagtgcttcccctcctgttatgtaggcaaaacctctaaattcaatgggttggattttttctaacctttaatcatttgcgtttgatatcatgtcttcattgccagtttcctccttaacccaacgtctttcatcttcaatcttcttaaactttaaaagatacaacccttcatctttcctttgatcttcacctgatgggcatgttagctgtgtccatcagtttcactaacctatttctatgaaaacagagaaaatgtttaacctagtatgacgggcctatagattataaaaataattgactaattttgttgtaaaaaaatactactctttgtaaaaacaaatcagcaaagctggagttttgtctttataaaacatgatgcttggttgcttgcttttttcaccttttaactggctatttgggtatcaagttcaactgaagtgtacttttgagaactgtcacagtagggcctccccattttatatggtagctcaccaaactgactgctgctgccagcacccttttggtttgctcttaattctattgggagccctattgctggcaagaaggctcctcatttaattcccataataagcttcattttcagcaatgcctccctaccctgagcttcataaagagtatcatgcctgtcgattttctttacagaaaggtgagcggtacttctgttgcccagtttgatacccagtagggagattcacaagatgccaagggtcttctacagaggaggtactagaagagtatttgtggagtatatgaaggaccaaggatgcagcaactaagcaatatgtatactgattatagatattttcttgattttggggggaaaaacctccagataagaaaagcagtctcattggagacctttggaaaaatgaacaataaatctttggagctcttctaaagttggtaagtctcaagtttctcccatagttctacgtaagagtactagctcattatttctcatagaaataattgagagactgaatttccttcaaagtatgaaattgggtgattgtatgagatcatgtgatttcatttcctctgttagggctttctcaccacttgtaactagaatttaagaacaactttgttgcacttgaaaaagaattaagctctgtaagcctactgctttccactggcccactccagttttaaaattgctttgcgatttttatgaaccacccctgtgaagttaataaaacacaaacatggtatgcattatatatgagagggaaatagaaaatgttcaacataaccgcttttatcattaagaacaggcagcatacagaatgatttaagaataagtgctaatgtttatgcatttttgtacctgcacatatattagaattgacttcaattcttagtcatggccagataaggacacaatggctgtaggaagggcaaagtaggaagaagaaaaaaaggggaaggaaaggagaaatagagtgaaattaatattttatgagcttccaaaatgtatcaggcactgtactaggcattttcacacacccaattccatttaatccttaaaacattcttgcaatatacaggcttttaaaatcccaataatattaataacatgtgttaggtacttagagagaaagggagggagggagagagagggaggatgaagaggaaggggaagaggaggaggagggagtgacaaagggaaagagaaagggagagtggggaggagggaaacccaacgcttgcctcattccaaaatatttgggcttgattgactttgggaacctgcattattgatctcatgattctgagtctcccctctacctcatgcaactaaattcaattgttaaattaactggatctttgtgggtataatatcaaattagaactaaagatacttgtttcatagtcaagagccaagtggttgacccagttcacagctcttcagctgctcttactacttctgcagaggctctaatttatttattatttttttttgagacagagtctcactctgttgctcaggctggagtgcagtggcaaaatctcagctcactgcaaactctgcctgctgggttcaagtgattctcctgctcagcttcccgagtagctgagattacaggcgtgcaccaccatgcctggctaatttttgtatttttagtagagatggggtttcaccatgttggccaggctggttttgaactcctaacctcaagtgatttacgtgtctcggcctcccaaagtgttgggatcacagacatgaaccaccgtgcccggccagaggttctaatttgaagaggatactcatttgcatcttcccacttccatgggaagctgttttttaccctcctcttctggttgcagatccttatcatcttgaacaattgttgatcctcataggtaacttttttttatgtgtataaatttaaggtttacaagtgcagttttgttacatggatatattgcctagtgatggagtttaggcttttagtgtaatcatcattggaatgatgtacactgtatctattaagtaatttctcatccctcaaccccttcccacactcccacccttccgaggttccagtgtttattattccacactctatgtgcatgtgtgcacattatttagtgcccacttataagtgacaacgctaggtatttgactgtttctgagttgtttgacataagataatggccgtcagttacatccatgttgctgcagaagacataatttccttcttttttatggttgcatagtatgccacggtgtgtgtgtgtatatacatacatgtgtgtgtatatatatatatatatatatatatatatatatatatatatatacacacactacattttctgtatgcagtcatccgttgatgggcacttagatcgattccgtgtctttgctattgtgaatagtgttgtgattaacatgagtgcagatgtctttttgatataatgatttcttttcctttgggtaaatcacagtagtaggattgctggatcaaatggtggttctatttttttttttttttgaggaatcttcatactgttttccatagaggttgtactaacttgcattcccaccaacagtgtataagctttctcttttctctgcattcttgccaacatctgttttttttttttccgactttttaataataaccattctgactggtgtaagatggtatctcattgtggttttaatttgcatttctctgatgagtaatgattttgagcattttattatatgcttgttggtcatttgtatgtcttcttgaaaaatgactattcatgtcttttgcccgctttttaattggggtgtttttttaaaaaaaaatagtgacggcaggtggtatgttcctcacacttgacttgtcatttacaactgaatttttcagctcacgatattgaaatccagaaccactttttctatagtcaagtgtgattcagcaaaaaataaaaccttcttgcattcatttggaagtaatatatgtccttttggaatttctgtgtaagtccttttttagtgagaaaaaaatcaagtccaagttaaaatgataaaatactaaattcggtgttgccaagtagagtttaatttcaattcagatactataatttataattctgggtcttaggagccaaagcctccttagaccatccctttaatccaggcctatcatttggagatctcatagctcccttcactgtaatcaccgtctggtgctagatagtggaactgagatacttctttgctaatgacctacttgctttcagatacagggcaaccagcggatggttcctgggatctcatctgatgagtgacatctttccggacagaactgatgactctctggcagtaaaagggtggagagggcagggcagatatgtttcacgagcaagaagggaaatagtgtgttgtaaagctttgctgtaggcctgccaggatctggtgaagtgggtgggcggggagagcttgtgttcacagaagagtcagatggttaaagaatttatgataattaaaatgacgtttctatgtaagtctgaaggaatacagccataaaaacataattgctgtaaaacatgctgcatcagactaaataaccacttgatgatggcaactatgcctgtgccataaagaaacctgtgcttttgtgaggagaaaaaaatatgtatttattatggctatttgcgtctcatgttaattgttcacaacaaagccattgattaagcaatgactccttacaagatggggctggatcaaataatgcacagagtacagcaaacaaaaaatggttgtgagatgaaaggatgattctgagaaacagggtcaagctgagaactctctgaactctccttgggcacctgcagtcatagttctagaagtgtgcggaacaatttgaatgagagattagatctgagtttcggggttttcttttcccaaattctactctgtaaagaatggcttgcctggatatggaagaagtgctaatggagggaaacaataaggactgtttcacaggaacctgccacacagggttcctgtttgaggtagagatttagtgacactgcctgaactcaatcagagtgaagccaggctttctgcattctgctagtttcactgcaaactgtggccagtggggccagcattcagtcagaaacacctgtctaggaagtcacaaggccatttatgattagtcttcccaatctggacatcatggagcagactcaggcacgtgaatggcgtctatttacacacacacacacacacacacacacacggctatactgttttcctggacaatcatttttcccacatttcctggaggaactactggaatcacaaatcacaatttgtggcttgccctgggtaatgagtcattggatggaatttcatttggtagatttaaagagagttagtgttgatctatgaagccagatgatttaagaaattgaagcagtaacaagtaaattgcttttctcttgtactgcaaaatgctttctaggcgtttttggcttttctttttaaaatggatttataatgccatttctctccacctcacggctcaagtaaacctctttgctctgatgaatcctaaatgactcctcatttcccacaaacagattgttcaaaggagttcttaatatcttgttttacactgtggaagctagaatttttaattctataggacacacaaatgaatatacattccctgttagaggctttatttattctgactcctctcatgaaaaattatgtccaactatgttcaaattccttgaccttataatcaaggcctgccactaaccaacctaaactcacttgcctttatttatttgttcatctggaagcaataggaaaggcttagaatctgccatgtagtatgctagttgttaaagaggatacagaaaagaaaaaggatctgggatacagataagtccagctgcttccttcaagcaatttactggccattggccagggcagatatgagagtggacacttctatgagatatgttgaacctgtgttgaagtgtgtgcaaaggactatgagaggagaggagagctgttgcttctcacagcagcacctcctctacatgggatgcagagagtccaagaatgctccaaaatggccttttccatcttcataatggccttccagccttcccatttgtgggcacaggggccccctgccctagcaaccttaaggtgccctgttgccagtacccttgagactccctcatgtttacggatagattgtaaattacacatgaaaaaggtctcatattaactattttaactttacagaaaccccacagaagtgcagcccacttggtcttgagctccttgaaggcgaggactatgtgatgccacatctgtaacccaagaacccagcacaaagtgttgcacatagcagatgctcaataaaagttttaaactgctgggggaagaaagtactatgggcatctggaagaggggccagctaactccacataggggactctggagctgtgctaaaaaatgtgtggtccactgcttcacttgaagagcctaaaaaatgtgtagagatttatgagggattaataggctcaagaattcgaaagggtactccagacagctcagagctcttgcccccagaatatgtgaggcatcgaaacaggaaagtaaaatgtttctagcagatttcttcccccctccaccccagacagtcttgctctgtcacccaagctggagtgcagtgtcgcaatctcagctcactgcaacctccacctcccaggttcaagcgattctcctgcctcagcctcccgagtagctaggattacaggcgcctgccaccttgcccggctaatttttgtatttttagtggagacggggtttcgccatgttggccaggctggtctcaaactcctgacctcaggtgatctgcctgccttggcctccaaagtgctggcattacaggcgtggcctaaaatgtttataacagatttcttatcaatctggttctctaaaccacagggaccacttggtgaacctgaagttttgtgactacaaggagatacataaatgtgtatttgagttaccttcatacagctacaatttggagaaggacgtccaggaagatactgagaggagaagtaatcatcgggtactgtttaagagagccgctgtcattactgcctttactgggttggggtcagagacaggtgggggaggtgctctgcaggttgtgttttatgtaattggtgctccgtcctcctccttctgttatatcactcatctgtgcagcttttcatctcatatgtattttccaccatggtggcctttgtaagacataaggtgagcaaactgcttattaaggtaagacaatggaggccccattttaaaaaggttaagatgtcctcaaaagtgtcagcgcatcccaggaatcattaacagtgtatggaatgcacagcctggtattttccaaaggccacactaaccttttcaagcatggaacaggctaaaaggaatggatttcttcaccatttgatgagagaagaaatctttttaaatgcttatttttatttgcttgctgagaatcatctctgtgaagctcaatatggagaaatgaattctgaacattttagcaactcacttaaaataccattagaaagcacttgggttattaaaagctgaaaacaaaggactaggagccctctggcactaataacacttagggagaaagcgagagccacctatgccctcatgtttgccaaaaatgtatttgaatttaaactcttcattgttaagaagggaagcttaagttttgccaaaccctttttgcctttcagtacaaccacttttccatgtaattggctcaacactgctatttgcataattgtcatatttttctgcttcccaagagggctgtaaagcgtaaaggtgaactgcaaagctttgacaaagtgcacatttatgtgtgatgtgcaattctcaaattacgaagaaaattatatctttttcattgagtttatcttacacttggaaatgaagtattcagaactcattgccccctgagatgagtttagcctgcttttctttaacttggccaaagtgcaatttcctgagccttgggtcttcaaataatgatgttgccacaggaccttgactgtatgaatgacctaaagcagaggcatttttctttaagccgcggaataacaataagctcttttagttggaatcagagatttcatcacagctgggccatccgttaagctctgagaggtcaaacagatcatttaacctctcaaagcctcagtttgtttaactgtaaaatgggcatgcctttaactcacacatgtattgagtgcttatatgtgaggaagtattttacccagggcttggtgcatagtaagtgttctaataaacacatgatattgcctcgttcctcttcttttatagcaggtggatggcatttaaatgaatgagagggcttgaactttggcacgggaaaagaatggagttgagtcctgcctatgtcacctttttagggagtgggaggatggggttgcagagagctgtgtgaccttgggcaggttacatagcaggagagcctcagtttctgtatctgccaaatgaggatggataatagaatgtgattgtgcatataaacagcatgtaaatgctcagtgttacctgtagttattaacatttcatccttaacagcggtcattatcaggtttaagatatggccctatgaggagttaatgggtgcagcacaccagcgtggcacatatatacatatgtaactaacctgcacattgtgcacatgtaccctaaaacttaaagtataataatttaaaaaaaaaaaaaaagatctggccgtgaaaacttatgttccctccaggtttgctgtgtgttgtcccatcacttttcacattggggagagtggaatgttcaacttcccttcctgtgaatgctcctggaagcctcctgcttacttccccaagtggggactagatttttacaggtttcctaattgctgtgtgcttctggctgcagcctgagggcatcagattacagtgccaaatggaggaatagtattctgggtgtgatactgatcagatcaggaagatatcaggacactagacatccggcatctgacagctggtcacaggggtcacttttgatccctagtttccccttgacaaggttagccactacatgccaagtgtttcatgggcagaattctagccaagcactaaactctgacagagaaggagaaatacaggctggcaggagggctggcattgccctaatgtcacagctggcactcacattccaatgaatgaatcttggatcaattgctaatgtacggggcccaacacaacattaacagatcaaaataagaggaagttggaaagtattcaagtttccagaaacaggtagttaaatatattaacgtaaatctacttgataaacttatctaatcattttaaaaaaatgaaaacatggtaattaatgttagaaaatgcttatgttgtaatgttaggtcaaaaaggataaaaatatatagtataattagaaatgtaaaacaacaacaatagacaaatctataaagacagaaagtggattagtagttgccagggtctgggaataatgagggttgtggaatcattggccaagggacgtggggtttgttctgggagtgatgaaaatgttacaaaattgattgtggtgagggttgcatcagtgaatatactaaaaaccactgaatggtacactttacatggatgtgttgtatgttatgtaaattatatctcaataaagctgttactgacaacaagaacaagtcttatacatacaaaaatagaacagaaagaaattttccagaaggctaacagtgtatataagttagtagcaaattgggactgatttttcttctgtattttttcacattttaaaatacagtgattaagtttaatgatcacatatgtagtctcatatattaaaataaaaaaactattggaaaggcaaataaacaaaaatgaattaatgccaacttttttagctcatggaattgaaaatataaataatttaaaaagtaagagaaaaaattatttttaaactagatgaaaatgtagcatagagtatgtggccccgtgtactctggattaaatatcaatacttaaccttttcattaatattttggcttgtaatgaaattgccaaacacaatggtatacataagacacatggcataaatattggaaaatctgtgataaaaaaatttttaataaactgttttctcagaattgacgtctatccttgtttagatttagagcttttgaaactttcagaatataaattaaaaattatctttgtaatcataatgcacccctaatttacatgtcctgatcttaaatctattatttatattagcttttatcaaaacattcagataagtgatcttcaaatgattagtacttaagtactggttggagatgaacttttgcaagtgaacgtcatacaatctattatttctattggagcttaattctgaagctcagagactccctagctctcctcgcctcaccatggtaatttattattatcctttgtctcctataatgtttgcttctttggcctacctgtagcataaaccttttggttgttctgcagctatttcagttaaataactcaagccctaaaaaccacagaaagaagagaatgtgcaaagcgatcatatttatggaccaccagatccttctcagcataattgccaggctttttatactgaaaggcaagaaacagctgccttgttctactttggtgtccaactcagctgtttcagattcatcctgttgctttaagcatctgttgacaggtgggaaagctcactgtgaagagaaacattgttgccctgggtggcttctgcctaagacaggcctgacccttttgtttctcccctggaaaaggaccgaagtgttccttccagccttattaagtacagctgtcgggtacattttagtagatgagaaccatttccaaagtatctcggttctgagaactgagaggcagtgtccagaaggtagttggacaagctcgtgtgctgtagaatgtctgtaagtggctgggacttacagaggagaggcccgcacgttgctagtcctccttgtcttggacatcttgagcctcccacttgaatatcctcttaggctctcattttgtaccagaaattctggaaactggaaggctattttgttggaaccccttattttacagattagaagaccgatgccagggttagttaagtgttttgttttatgctacaaagttggttagtggaattcttctgcctatataataacatcacagtatttcagagttgttttctgtcctctctttgtcaggtttctgggaaatctctttctcctcatgtttattatttggcccttaatccagcataataaaattacaggtacatatagtttgtcacaggatttccagttaggtctcagagacctaaaggaaagaaagttattgaaagttctggaaaaacaaaagtcctgagatagtttcttgacatacatcttctttgaaatctttaaaatcaaacaaaacaacccctagtgtcttccctgtcgcccccttcactaccttcttttgtattctgcatatgtagccattctcttgggcaatagcagaaaggtacatgtggattaatggaatttatgtattcactggcggtaaaaggcactgggaattcctgcactgggtgtaaaaacttgggccttggggacctcactaatgacttttcaagagcagttctttacagagcccaagtcttcaatcttgtaactggaccatcaaccccagtgacagcctactttgaaggaggcctcataaagacaaggttcaggctctttctaacggttttggctaatggaagacctggaggggaaaaatgaaattgttctcaaacttcttacaggtagaaaggagaaaatctctggaagttctgagaagtgacaggaatgtaaaattttgtgtttaaaatgtaagaagtagcaggggatgatgaagaatgcttaaaaatgcttgtttttattataggcagtggaaaaaatgtgagtctcaatttgcttgccctggaattgctccagctagcagaataaatcaaggctagaaccagatcagaatttcttacgagatgacagggatctgaaggactttacctctatagtcgttttgcctttttaggcactgggtgacctggtcccatgtccatcctagtgggccctgtatgatccaatccaaaggcccctttaggtttgcgttttatcattccctctttctcagaatttgatgtttgtatgtaaaagcactctggaaaatatttaaatcatggtacaaatataagagaagtcatgcaggtatggaattgctttgagaagtatcattttattaatttgtctggcttgataccaattacctgatgcagttgttaagggcagatccatccagaaacctttgggttctctgctccctgattttgttttgcaaattatataaccatacttcatagaaaacaccagtggtggctatgttgttcacagacacaaagtgattctaaggcaaccacaggagagagacacaaaagaaatcacacaaaaatctctcatcacaacataaatattgtgacaattgtgtggtactttttgtcttttttgttctctctgttccttttttgtcagtacaagtaagtcatcatgaacaaataagcttttgtatcctgcttttttaacctgacatgttcacagaacataacctagtcacacacgggcaagtacatcttctatccagtgatttgtttcaccatcaccctgcacatcacttttctcatgtttcaaatgatttcctcagaagagacatctggaaatgggattactgagtcaaagattctcaacctcttttaaggcccttgatatgtagtggcaaattgccttcctgaagggctgtgccagttgacatggctggcaggggcaaggcttgagtcttcctctggacctgtacatgggtacagttaacattaaatttttttaatgagtataatttacatacaataaactggacaagccttcagtgcataggcttggggaatttttacatacctacatttgggtaaatgccacccagatcccagatctctctctctgtagacagatagatacatacatacataaatacatagatacatagattgatctatctgagcagcatttatatttatatatgatatatcacatatgatttatatatttaatattatatatgatttatatgttagtatgaatcatatacacataggcttaatttatgcataaacatatgtgcttcacatatctttacatagataaatataaatataagtatgtatatatatatatatatatatatgttccttacctacaggatccaacacaagattaacttagatactttccagcttagatattaacttagatctttccagatcagaataagaggaagttggaaagtatctaggtttccagcaacaagtagttaattatattaacatgaatctactcgatagactattatgtcatcattttttaaaaatgaaaacattgtaattaatgttagaaaattcttatgttataatgctaggttaaaaaaggataggtgtgatttttatatataaaatatatgtacagcatatatatagctacatatttaaatatataaatacagcatatatatatttatatacttaaattataaatatatgtacagcatatatatacttaaatatataaatatgtatatgctgtgtatatatttatatatataaatcacacctatgtttgtgtgtgtatgtgtgtgtgtgtgtgtgtgtgtgtgtgtgtgtgtgtgtgtgtgtatatatatatatataaaatatgatatttccattatccccaggaagttttctagtgcctagttggtatgtagtgcccagtcggtgtctccacccacccccaaggtaaccactattctgaaagtccctcatttttgagtgatttcggaaatgttcttctctcatctgaaatgatttgacaggcagtctctgaagggagattgccatggctttggtgttgctcggatttctgccaccttacattggcaggctcaagaagatatgcacagtctttatttcattgatgtccagttgcctgtattgagcttagctatcctgtgcccaggttgccttagggatcactttgtgactatgtgcagcttatccactaccttttttttcccttcaagaattaacaaaaccactaccatctgttctgaaccatgtgcggtagcaggtagggggtgacaatgaaggtgtgttacagaaataaagtaggagccatgctgactttaaagaaacacccccacccccaaatgctcctggctgttttctttctatagatgagttaaaacagagggtatgaagtgcttggtttgcaaatcctgcaatactttgccatggcaagtccctaggaagtagattaaaagtggatctcccagagtgattaggattgggcagataaaatgatatgtttgttttggtcaattgagttcgaaatacaggttcagacagtaaatactcccttgctgagactaaacagtcattttgttgttcattttgatgaaaatcatggctcccaattttccgtgaaagctatcctttctgagatagactggctcttcatgagttatgaagcacctgaaatcctctctaacagcaaaatcgaggggcaacatcaaggttaggaacatcacgagcaagaacttacggctcagcagtggttgtaggtgtaaattcagtgtcccaagtcagaaaccaagaggtgtaagcccaacatgaaaggcaaagaggggaggaaattaacaaagatggaggctaggaacaacgttaggggctttcatatgtaataatccatttaatatttgcaataagtttatgaggttgatctatataaatctccctttaaagggagggaattgaaacatgtccagagtctcacagttacatttcttctttgcctctttccttccctcttttctttcttttttccccttttcccactgttgacacattccaggacacacatcctcctcctgttttccttttccttcacatctttctcgtcctttgctgtaacatcctgtgccataacaaactgtcacttatccagtgtggcatgccctgtgaagccttccctgacaccgtgaaccatagtaagtttacaggacccttcagtgttggagttctatcttttgcagctcccacagcacctatagaagttgtgttcacagagcactcaacaatttctaggcttgaataatgctgtgacaaagatggggttctgttgggaagacactgtagccactgtcagcataaagatacaaatggtccttgtaaatggatggagggcctttgagtgatttcttatcaatggaagtgccttaggaaatgcccagttgctgccttaaaatcaatataattatccaacattggtcactgagtttgttcctttgccaccctccccacttgcatgtggaaacctttttggccatattttattttagtatttcgccaaggagttttcagtcatcttaattaataacaaaaacacatcaagctggaaggagatggcctgaccatagtacattcctttaccaggactctgtagacaggtccccagctggcatacggatcaggagctcccattccctccaaggacccgtgaacagttcacacctacagtgttagattagaacagatgtgaaattcaaatgccactaggttgttataggtgttctctgaaaagaacagtggtaaaataattagtgcatctaattatcagtgtgttcacatgctttatatttttaaagggccacagcagtggccctttatatatatatataatgtgagctatatatatataatgtgagccatatatatatataaaatgtgagccatatatataattttaaagttttttagtagtcaatttaaaaatgttgaaacgtgaaattaattttaataatatatatttaatttaactgagtaggccccaaatattatcaccttgacatgtaaataatataaaaatattaatgagatattttacttgtttttgttctaagtcttagaaatctggtgtgtaatttatacttacagcctacctccttttaagctggctatatttcaagtgctcaagagctatatgtggctactggcgatcatattggccagcacaggcccaaagaaacttctagtggagtctttcttataaagatggagctacgtttgttcataggcaaaaccaaaaccaaaacaaaaaatgactctgtatgtttattggtcccatgctctgtgctaggcactagagtggggagacaaaagggtgcagtgcagcctctaccgtaaagcagtcacacgtgaaaagtgaaatcattttggttgtaatttataatgtgtccaagcacaaggcagtttttgtgattaattctcaagcaagtgattctggcagcttaggactgtgagtttaaaggagaaagtaatccctactatttgagatggtcatggaggacaggggacattggacaaagtataatatttgtctgagatggggaaagaggagaacaagcagttcatgtgggggagacagcttgaacacatctacagaagcattgtgacacagagagtagattagcttggctataactgagaattcacataaaggaaattgtggaaagaaagatgggattccttttggctgtattaaagagagttggactatatagagagatggctaagagacctcagttaacaacaggaatgaaaataataatcgcagctagcatgttcctgattagggtccagtccctgtatcaaattctttgcatttttttgtcactgaatattacaaatgagaaagtggaatctctagagaggtagaagtacttgtccaaggtcacacatccagaaagttggcctagcaaaattttgaatacagaaccttctgagttcagagcatttactttaaccatcaggagatatgctcctgagaacgttggaagcagtgatctctgtgtttgattaatgggacgccccccagccctattgacaaaggtgctgcccaagtgctgacgtaccacctcaacataggacagagaatttccaggccaaggattctctgcagtttgtgtcctctgaacagatacaaatgggccttttagcatgatgcccctgaaagttgactgaagtcactgactcaggtctttacaacccagtgttccactagttggtttcctcctttctctctcctcgtataccccagtatcatactagaatactgggatctcagagaccttttagttcaaggccctgttcttatagaacagaaaacagaggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaaggcctgaaatagctagttgctacttaatgtttgctgcttatcattgcatttgctgggacctggtgcttgtcatgcttatgcagtacaaggagggaccaaagaggcagaagacagtccctgccatagtgaagtgtagtcattttagaggacaggactaaaaaacacgaagcaatgaacaaaccccccaaaatacaatagtgtgctgaatgatgcagtgcagatacttcttagaggtatttaggtgtagctgggctagattgtttctgtattgcatcaatagattggtccatgttgactattccacttcacaatatctcagggatggacaagatggcagagttcaggccccaaatttaccaaaatagaaattttctccatcaactaatgagtggataaagaaaatgtggtatatataacccacggaatactactcagccattaaaaatgaaataatgaaataatgtcttttgcagcaacttggatggagctgaaggccattattattattattattattattattattattattttttatgaagtctcactcttgcccaggctggagtacagtggtgtgattgatatcagctgactgcaacctccacctcctgggttcaagtgatttttgtgcctcagcctcctaagtagctgggtctacaggtgggtttttttttttttttttttgtatttttagtggagacagggtttcaccatgttggccaggctggtctcgaactcccaacctcaagtgatccaccagctttggcctcccaaagtgctggctttacaggtatgagccatcgtgcctggcctagaggcattattctaagtgaagtaacataggagtgaaaaaccaaaattcatttgttctgacttataagtggaagctaagctgtgagtctacaaaggcatgcagagtgatacagtggactttagagactcagaaggaggagggtgggagtgggccagggattaaaaaaaactacacattaggtacaacatatactactcaggtgacaggtgcactgaaatctcagaattcaccactatataattcatacatataacccaaaaccacttgtaccccaaaagctattgaaataaaaaaattaaaaaaatatgtaagttccatttcagcatgagaaatacttcttagaggagtgttcataacataggttagtccccatgagatttgtgcataaagaggactccataggcaagccattccatatcttcctcttggagacttaaaagacatgttcgttcgtatattaaaggctatacagctttcaaacttttttatcaaagtcttgcagtttgtaactttgactttaacccagtattaaccaaactagtcttcctacagagcctttatttcgtagtccatgttccatgggccttgtggcagaacacacaatgggaaatgctgctttacagtggactcttggctccccagtaatggctaaatgcctgatttggttatagttctgtcagcccctgttccttccaaacgagaatcttgtgcaggaagtaagaaagagaaactagcccaagctattttgacaacaggcctctgactgaaacaacctccctgaatggttgataaacattttccctctcttaagggaaaatcatgcacagaaacaagcacatataaataatttaccaagctgtaatatgctgtaaataacaaccctgctaaataatgaattaacccaactgctgattcataggtaaatgtctcttgtaaagcagcatttttatggattttatagcttagttaatatccactcatatttcattaggacacttcaggtgaagtattggggtaataatctggatatatttgaaactgacatagcacatatcaggagtccaggcagagtttggggagctgccaggatccttttgtcttagctagagcatgaggagagattgtactgggccttactcttctccttcctccatggtcttggtttgcccagctcctcagtgcaagcctgagttgctgagcaggatgcggctctgatatcagagagggtgtcctctctgagaccacgggcagggatggaaggagaggtagctctgggccaggggaagaaagggacacagaaatcactttggcctactcgacagagccagctcttctgagtttttatgacacaggtgtgcagactctggagctgaactctggatatttgcatctttaccacttattaactttctgacttgggcaagtcacttatacactctgtggctcagtaccctcacctgttaacagggacaataaaagtacctactcctagggttattatgaagattaaatgagtttgtattgtcaagtgctggaacattgcttggcacataagcaagtgctttcatttatttattttttgagatggggtctggctctgtcacccaggctggagtgcagtggggagatctcagctcatagcaacctccacttcccagactcaagtgatcctcccacctcagcctcccgagtagctgggattacaggcgcatgccaccactctcagctaattttagtatttttagtagagatagggtttcgccatgttgcccaggctgatctcaaactcctgggctcaagcaatcctcctacctcagcctcccaaagtgttggaattataggcgtgaaccaccatgccgtgccagcaaatgctttttgagtacagtattagctgttatatttgttagaactggactcttttagattcttcattttggcattctccagctctggtgttggattctgagaacctagaccctggggattggagggcctgggtggggagggggtcaccgggatcactcagatgcctcttcttgcctctaaagaatgggaacgggggccaagtgcggtggctcacgcttgtaatcccagcactttgggaggccgaggtgggcggatcacaaggtcaggagatcaagaccatcctggctaacacggtgaaaccccgtctctactaaaaatacaaaaaattagctgggcgtggtggtgggtgcctgtagtcccagctacttgtgaggctgaggaaggagaatggcgtgaacccgggaggtggaacttgcagtgagccgagatcccgccactgcactccagcctgggcgacagagagagactctgtcttgaaaaaaaaaaaaaaaaaaagaatgggaatgggaagcaggaactatgatttcattacagtgaggaaaaactgcttttgatgatctctcagtaactataagtaagaaatattctcttatttaaaaggaatgttatctatctttgttaatgagggttttatggtggggggaggtgatgagaattatcagtcaaatcactttgagaaggaggagatctgaatttcataaataaaccctaatttgttaatgggaactgatgccaaaaacaaggagtttttcctccttgcggtgacactgaatgtcctgggctgtggagggtagaaacaggacattctcagtgttccagctcacaggggtggagttagagtaaatatcctgcccagtttgccatcacactaacactgcataccctatcatcagcctaatgacctttcaattctgattgaatggaagagcactccggcccttgatccaactcgtggttgattacagtgctcatgccccattaccccaaatattcctataaattaccagagcgagcattcacgcttatacaccatcatagatttagctcatgccggtggttctcgatagcagccatctgaagctccttttgcccacagctccctggatagctccaccattccctgcatgctagtcttgtggtttggtcttcagcctgctgtctgtactttctcacacgttgcatgggctttctccgatgcctacaagcaaaatctcttttccattcttcctttctctggctcctgggttcagaaatctctagggatcattatcagtcctctggctgccccctctcctacctacctccatctaccctagctctaggacagacctatggcgatgcccaactttctgcattttgaaataggggtgattgctttgacttgggccctatctattagggtctttcatctgtctattttggacaaagacaatagcagtgaagcagggggcctttgcattgagaggctcagactctcaaactctctcttaaaaaaaaaactgtctggcattaaggggcatagtctgcttgccttcaatagacctcaggctggggaggctcgaggtgcctactagggcagccagtttgcatagtgccttctaaaagcaggaagagccacccttgctgccttacagcctttgtccttgggccttagaatgaaacgcttcagagctcacaattaacatttggccaagcctcttcctcacccccacccccgtgaagtgggaagaaatacggtggcgtgacattcactttgacaaagctctttttcttttctctacttctcaaaaaagcctaaagaaataaaaacagttgctaagctactgggtgggctctatcggtgtgttttgttgcagtcttggcgttaaggactcatgctatcatatatgcagcagcttagactaaagggaggaagcaaagtgcttgagagggctctcttgcaagttcacttttttgtcaggtcaagtgcttggctctgggatggcaggggacatggagcatgacaactgcaattctctctccagatgggaaagtagaagggaggatttcttccaatcctcaaattcttccaaaagagaatgctgttttggaaccttgtctttctttaccatttatttcagaaaggttggatctctaggaagcatgggtcatactcttagttctctgggtattgtcttttgtacacatcacatgcagttggtgctactgatggggcctggacactagctagttctggtgagctcctagctcagtgtgccagaccgttgtactgtattgtatttaatttttttgtctccagcattttcttttcaaagctggtgaatcccaggttttgcaagttttcatttaacaacattcacataatccctaaattcagcatggtttataacttgttaggtccgtttgctatatacaaatgccatacctccaattggtactgaggaatggttccccactcctgatttaaaggcattaacactgagaatggtggaaagagagcctatttcccaacactgctttgcaacatcctctaaatctttcataatggcctaatccacccattgcgcgttggttctcagtgtggggacaatgggggcattactgattttaaacttgttttcatcaactagctcattctgtgtagagttgagtttagaaaaaaaaaacataaaaattaatgcagcctgggacaccctctgtggaggatacattgaaaatacatcttaaataaaaacccaggaaattgtcccttctgtctttcacctgtcagaatcagcaatagaattctatagaccattcagtggcatacttaattaagcaacctatctgctgaatgtgctgggggttggctgacagtgcttttcactgctgatttggatgacaaaggatatggtgagatactcaacagtctggtggaatggaaagaaactcccaattggtcacacctacctatttctcttggcatgttgcattagctctgataatacagaaaatagactggcttttatgcattgagaaagtcagtggacaccaacctcttgccttttgctcttccacagcaagccctgagttttgcacacatttccattacagatgaatacagattttagttgtaggtgagaaacatgagcttgtaattttcaagagacaaaacctccagctgctttttttaatcctagtgcagaatagttccttcctgatcatcattctatattttgatggcagttattgcctatccctaatgtatattattagtattagggacagttttgcagtgtttatctggtgccagacacatgccaaagcatcatccctcttgccaactctgtagggtaatactctattttgcagatatgaaaattgaggctcaaaaaacttaagtgacttgcctgaagtcactcaaccaaacagtaagtggtgggtcaagcttagaacatagagctcttctaccctgcagtccgtgcttttaaccgctctcttgcatcgtctctcttgaaagccgaaagagtgtcacacagtacaactattaataactaggggttggggcacacgtgtattaggattacaaaccttttgggagtctctcccacaaaattgggctcttcacctaggttttgtagagcctttcagtatccataaagcccttcaaactagatgcaaaaatatgtgtgtatattcaagggagataggccagagttttcatcaacttcttgaagaagtccatcacacacaagagggttagtaacttccacataatcctaaagtgcatgtagcacttgccaggcatgaatatgattcatgaatatgtgcatgaacttaagcaaactcatttcattctcaccatagctatcagaggtaggtatgattatcatgcccattttacagaaggggaaactgagactaagagaggttataaagctaataagtgacagcactgggatttgaggccaagcagtctagctcctgcttttaatcacttttgactgcaatttcctttttatttacttgcatatctccagcacagtgcccgacacataatgggatgtttattgatatttgttcaattgaattgatttgcacactgccggctctgtgtagatttcatcttaggaatcattctcaaaggtgtgactccgtaagtcttggctggacgaatgaaaagaatcaacatggtcaaaagataatttattagagtttctaaagacaaatggcttggcaaagcataggcattttactttcaatcagtgttccctggagggctgttacactgatttccaagcccattcttctcccaactggctcactagattgttccaattggttatgtggtgcccctgagtatgggctaggtaactctgcaggccccatgaatctatgtgatgtttcatttcctgattactatgcataatctcccctgccttttatttccaagtgaccaaccagaagccacccaaaccctctgcatattgacatgattcaaatgtaggtctctacaaggtatgccaagcttattgaggggaaggtggggggagatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacatgttccaaggtttaactttgtggcctccactgtttccctaattttacctgctgcgatcttattttacttttcattttattctctaatcaccgccaattagagccctgagtccatgctggttctgttgtctgcctctcagcctaatgggcctctttgtactgaggcacagaacccagctggcagcgagacttcctagggcccggaagcttcattactctttgttggcagtgaactctaaagttgctgtctttggagttgggttttctcaagtacagtcacttaacatttggtctcaaagttgttgtttttcagatttttttctcttttttcctaagtcaatcagatgcatgagctaattataagccagcaaatattttgagaaaacttccctccagtggagacccttgcacaaacttcagactatattcccagtaattaatatgctccttttatttcctttgaggtggaaaacagtcattgacaatcattccctacccatttggttcaaataactaattttgtacctgaagactaattacagtagtgacaccatcttttcctattaggtctctcacttgaagaactcagagcaatttataacctttgaatcttggggactagtttaatctgttcgtgggcagcatagcagtgaacattgttatcagaaatatagttaaacctctttaattgagcccctattaattcaaaaggtaataattcaaacagtgtgaagaacaaacttgaaacgtctatgacaagaagaaagtaagttggcaaaggggttatttaaactgccaagtagagcacacttttagaagtgccagttcacatgcaaagaactggtaagtacacacaaattgttccattaatagactcagaatcttaagattaaaagccctgtagtacaactgttcataactcaaaaaacatttgttgagtaatgctatgtgctggggcctggggatataatttttttgttaatagcttcattgagatataataaatacaccatataattcactcatttaaaatgtacagttcagtgatttttggtatagtcaaagagttgtgaaaccatcactacagtctattttagaacatttcatcactctagaaagaaaccctgcatcctttagccatcactttcccatccccctattactcacagccctaggcaaccactgtggggatacaaatttgactaaaacacagtacctgcctttgagaggatggcaagctattgaaagagacatcaggcaggtgaagcgtacttatcatagcatcgtagaatgttgatattgagaggcactaagaagatcatcagatataatcttctcatttcacatatgaggaaactgaggcccaaagacaagaaatgacttgcccaagaacaaaaagctaacagagccaaaattaaaactcatgtattgtgccatcttagcctgttgcaatgttaattacaatacaaacttctggagcatagtaacagttgagagcatggattctagagccagactgcgtggatttgattctcagcttaccttttataggctgtgtgacctcaggcaagttacttaacctctctcagcttcagtttcctcatttgttgtcttgaaataataattgtaactaccttataggactcttgtgaagattaaatgagtttctatatgaagtacttaaaatagtgtttggcacagaataatcgatacataaaatgattgttattattatttcattacctagttattaaatataaaaacatttcgtaatgtcctaaagtatattttaaatatttgttcttcaggttttaaatcctgactgtattcatacataatttctatttcgtttcttccaacatatatttttgagtgttaggggctaggtataaaaatgatgtttaaaacagagttcaaatgcctaagaagttcagtcaggtaaggaaggcaggtgaacagatatgtagctataaatcaaggcaagcaacaggaagtgccccaaataaagtatgtatgaagcataaagggtataagaaaggcttcaaggaggctgtggcatttgacttgggttttaaaatgtgagccagatttcaccagactgaagagggcgagagaagaagacattccaggctgaggtaacagtagaagtggagaaaagaaagtatttgccatggtttgggaaaggctaagtgttgtatgtgttcatcgcatagggttttgcaagatgtcctgggagacgagcctgaatatagatggggccgtgctcagtaggaaaagggaggagaatttatacttactgaacaccttttatataccaggttctgaggttgggcgcagtggctcactcctgtaatcccagctacttgggaggctgaggcacaagaatcgcttgatcctgggaggcagagaagtgagccgagatcgtgccactgcactccaacctgggtgacagagtgagacaatgtctaagaaaaagaaaaacaaaaacaaaaaaactatataacaggctctgtaaaataccaagtactagatatgtatgggtaactattttgattctcacaatcatcctgaggaagcagtgtagacaggtgatataaattgatcaatatcacacccaatatgtggcagactccagattcaaactgaagtctctctctgatgctaatgcttattccctctccatataccacaccaactcctgaacttctgtaccagcttggacgttatggaaaatgggagctttaaatgttcttgaaggccaggcacggtggctcacgcctataatcccagcactttgggaggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaaaagtcaattgtgaggcttttacggtaggtaaaaggcagcgaggacatgaactaggggcgtggtaatggagaggaggggacacatataagagagggattgacaagacaggacatgtgaccaatttgatgtggtcagagcaagagtcaaagagagtcaccaatgaaggcatgattttttcagcctgtatgttgtgatgggttgaactgatggactgagataagaagcctgggcatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataaggaaacggaggtcaacattgctaagcgctaaagaatggccaagttagatagactgaaaaatgtcccttggatttagtaattaagtaatttagtaattaaagaggttattgagtaataagaagcaaaccaagtagaatattatgggtggaaattatgtggcagtggtttggaaactgaatgaggaatggagacctggagacataaatgtagacaactctttctagaaacttgtctggtaaggtatagagagatgacagaatcttgaagacaaacagatcctgaataacttttttttaattatggagaaagttgagcatttattttggctgagaggagtgagtcagtgaagaaagagctagtaaaaggggagaaatcgggggataacggataaagattggagaggtagcaagaggaccaaaaggaaataggaaaccacagagagatggttagctatggacttgagcccttcctctgagatggggttttgaagcgaggatgcacaggggcacagataaactaaaggctttttccaacagagtctgaggtatttgtgattgattattttctttaatttagaattctctgcgtaagaaaccttgctctttttacactatgtaaaatccttatggaaacaagaacaacaaaaccaaacacaaaaacctactttatttaaatgtgggagaagggcttgaataatttctcccccccccaaaaaaaaaaagatatacaaatggccaataagcaaatgaaaagatgctcaacagcattaatcattagggaaatgcaaatcaaaatcacactgaaataccacttcacacccattaggatggccattattattattattttattattattattattattattattattattattattatttgagacagagtcttgctctgttgcccaggctggagtgcagtggtgcaatctcggctcactgcaacctccacctcctgggttcaagcaattctcctgcctcagcctccggagtagctgggattacaggtgtgcaccaccatgcctggataatttttgtattcttagtagagacagggtttcaccatgttggccaggctgatttcgaactcctgacctcgtgatctgcccaccttggcctctcaaagtgctgggattacaggtgtgaaccaccgcgcccggccaggatgtccattattaaaagaaaattaaaagtaagtattgttgaggatgcggagaaattgcaacctttgtgcactgctggtgggaatataaaatggtgcagctactgtggaaaacagcatggtgctttctcaaaaaaattaaaagtagaattaccatataatccagccattccacttatgaatacagaaccaaaagaactgaaagcaaggatttaaatagatatttgtgactatagtcaataataatttaattgtacattttaaaataactaaaagagtataattagattatttgtaacacaaaggataataaatacatgaggggacagatatcccattttacgtgatgtgattaatacacattgcatgcctgtatcaagactgtacaaacaaaatgtgatatatatatatatatatatatatatatatatatatatattattcagcctttaaaacaaagttctgacacagctacaccttgaagacattatggtaagtgacggatgggtgaactttgaagacattatgctaagtgaaataagccagttacaaaatcactgtatgattccccttgtatgaagtacctagagtagtcatattcatagagccagagagtagaggttgccagaggttgcgaaagggaggaatggagtatggactttcaatttggaaagatgaaaaaagttctggagatggtggtgatggttgcacaacaatgtgaatgtacttaatgccactgaactatatacttaataatacttaaaataagttttaccaccattaaaaaaaaactttctagagccaccattttagcttgactggggtctcctgggttgttcgtaacctagagtagtggctctttccactgctgacagatagcaaatccagagcagacacctcgtgtaagagctacctcttagcagaactatgattcaggtttgtgtgcattacatttaagccagctgacatatcactttctttctcactgctgtgtacacaatagtgacatgatcaaacttgaaagtgcatgagaaacaatcacttggagaacttgttaaaaatgcggattcacaaaatcatctcttccatcaaactaatgtagtaggtatatcagctagtttgtgctatataacaagccacccccaaaactaagtgatttaacataactgtttattattttatagcctatgagttggctggatggttctgctcatctgggccaggcttcgctgatcatagatgtactcagctgcagtcagccagtgggttaaccagggcttggcttttccaggatggcctcagttgggatgactttaatctgctctacgtggcctctcatcctcaaaacatcagcccaggcttgtttttgtgctgtggcaggagtctaagcaagcaagcacaataatatgagggaacaagaagaaatgcacatgagctcttcaagtttctgcttgcatcctatttgctaacgtcctattggccaaagcaagttacatggctgagtggagattcagagtgggaggggtgtacaaagagggcaatagcaaggatgtagagaggtcactgggtccactaatgcagttaatctactacagtaggtttcagtaaagcctcggaatctacatatttagcaagcttctcaaagtgatttttttctttctctctttctctctttctgtctctctctttctctctccttccttccttccttccttctttctttctcatgatctcactgtcacccaggctggagtgcaatggtgccatcacagctcactgcagcctcaaactcacaggctcaagcaatcctcccgcctcagcctcccaaatagctggaactacaggcatgcaccaccaggcctagctgtttaaaaaaaaaattacagagatgaggtgtcattatgttgccaaggctgatctcaaactcctgggctcaagcaatcctcccacctcggcctgtcaaagcactgggattacaggtgtgagccaccatgcccagcctaaagtgatactgatgcaggctatcccttaatattttcagaaatattattctagtatctcttaacaccaagattggaaccagcatcattgaacgttcagaaaacgaagactcagtggggaagggagcacttattcttctccttatttccagcttatgattcaggcctcttggtctcttagaggcagatgctgaaacgaacactctctgtctgcttttcagacaatctcatataatcatttacttgttacaaagaacaatggagttggattaaactgataaagtgttatttttcaatgcaggtcaggaaggcattgttggtttgttttgcattgctcattataatttctatttttgtcctggggaagctcatggtaatggaatgaagcatcgaggtggtttatgggccatgtgataggatcataaagttgaggttgttgcttggacaatacctttcttagaatagtaatccaagcaaagagaacatggacaggaaagaaaagaaacaataagaagaaacttcagttatttagccagttgtatgaggttttcattgctcagatccttagttaaaatgtgggatcagaggcctgcaggtaatgcctgagctcaggaaaggcagggaccatgatgcttttgcattcctgatacgaaccacagtgccaaccacattgtcagtactcaaaacgtatttgttgaatgaatttctgctaattcctgggatctattctcagagattctgattgagcaggataagtaaatagtttttcacagtgtggtccctgaaccatctgcatcagaatcacctacagggcttgtttaaaaaatgaatgccagggccgggcatggtagctcatgcctataatcccagcactttcggaggctgaggctggaggatcacctgaggtcaggagtctgagatcagcctggccaacatggggaaacccagtctctactaaaaatacaaaaattagccaggcgtggtagcacaggcctgtagtcccagctactctgtaggctgatgcaggagaatggcttgaacccaggaggtggaggttgcagtgagccaagatcacaccagtgcactccagcctgggtgacaaagtgagtgagactccatctcaaaaaacaaacaaacaaacaaaaatgaatgccaggatcccaccttctacttcttgcgtttgatgcatgagaaatcctagtttacacattttattaaatctgggactggttgtaactggcactaatgtagtcttgtgtgaaggtagtggtgcgatggtcattctctacccttgccccacctgagagcctctagagggaaggctgtggtccagtgcactgacctgaaccctcaccacatgcgtcccacacatatggaattgggagcagtcatttagcatctcttagccatttcgctctaatttctttgtttgccatttttgttgactttttccttgggaacctgaatttaaactcatgccacttttttgtcttccttattctagtgggtaggaatttgatcttgaccccaaaagcaatgataggttcctacagttctgtaaagtatccattgcttctgaaaggccttctttccccattgtctttgacaatttagattttccaagtgctaggattttggagaaagtggagccatgagcccaggcaagtggggtagcctgataatgccctcccatgacacatggggctggggatgtaaaaacttcagagtttccatgtcaaataatctcctttgccctgtggccttcggttacaggaatcatttatattacaggcacattttgaaatatcaaaacaaattggacactttttccctattaggaagaaaggcatgttaatttaagtgtggagtgtgacatttggaaatgtaaaaagaggcttttggggagtagttgggggtttgagtggaatatctccctttttgtatatctctcttgtttttattcatcctgtgtcttattcagatagtgattttcattcacctgcctgatcttctggaacagggattttagagaaagccattttctcagcagctccacaagggcgagatttccaaatgggcaaggaaaggctgcagagacacatctagcttggaagtaaatgcaccaagccagccaaattggaattgtcttatagggatccttgtgtgctgtcacagaagagttttcaggaggctttcctttgggcactaatggccaaccactgctgctgagtttctcccagccttctggagggaatgccagccagcgcactctcagctgtgacatgaccctcctaggagctgttcaatgctagcgccgttttgctctgatgcccagcaccctctgcttttagtcactttccttagcgtcctttcgcagtgcttgcatttcagccaaaatcgtgcctcgtgacttttcttttcctagagttttcgcttctcacagtgaagaatctatcagctgtttcctgaatccttctatgtcttttaaggtgttaacattttcaattttgccacattcagcatttttggcctactctgacctgagctcgataaagagcatcagaaattgagtaaagacagaaataagtccctataagcatgagccctggcactgtccacttcctcctcctcccctaccctgacagcactaatctcccttcagctctactcattggaccccctttattctttaggctctctttagtgatttatcttagtttagctatgagaagaatcaagctttttaagggcttcgctgaaaacgtaatgaaagttgtttcaactctttaaattttaagtgaattgtggccatctcaggcccactagttcatgtacctgatacaatttttatttggagccactgtattcacatcttcctgggacaggatttcacataattggggtaggttaatgagtgtggatttggcactccctttctatagagagtggtaaggagctcaggccttggagtcagtcaggtgtggttccaatcctggatctactattaggttggtccgaaagtaattgccatttcggccattaaaagtaaccgcaaatacttttgcaccaacctaatacttagtagctgtgcagtcttgggtaactcgtttcacctttcttgtgtctcaatgtcctcatttgtaaaatgggcacaatagtcccaatcacataggttgaagactaaaccaaagaccccatttcattagcttagccttatccctggcagataccatgaactcatatgtcattataattatgataatttacttaccctttcaattaggggtataagatgctacacagttttcctctaggacagggcccgcaaaccatggcctgcagcttgcctgtgagctaacaatgattttcatatttttaaaaggttgaaaaaaatcaaaagaagagtgccgtttcgtggcatagggaaattatatgaaattcaaatttcagtgtccataaataaagttttattggaacacaactgtgctcactcatttatatattgtctatggctgcttttgctctatcatagcagagttgagtggttgtgatagagattctatggcctagaaagcctaaatatttgccaccttgccgaccacttgccctaagacatttagccatgtctctggaacatcactgtgatagatagttcaggaattatttgcatattatcatcactgttattccaaaactctgactgcgtgtgtttctgtgtggagagtgatttacaaaggaagaaattatacaagtcataacaaaaagaaaaaaaaaaaattacacaggtccatgtaagacaaatgagatgaggcttttgtggcagttttagctaaggactcactttgtgccttcgagggatcagaaagaatttagaagtagtagcaatattggttaggagaatttacagattctcttgttttcttttcctctatcagtaccttctctgcaaggaggagagaatggatgttagtttctccttgtaagatgaattgaattgcttgtgttagtgtactaggactctgggttggttgtgaatgtggtataccaaggcaaagtctcatctgagcaaataccaccataacaccctgttctcccccaaaaggcaatctctgtagagaattataaaatcttagaatatcaagattggaaggagcctggagatctgagggaatgatattgatattaatatctccttgccgatgtagatacaatatcctgtttgaaggcaaaacattgtgtaataaacccagtctactcaatctattcaactaaggtggcctctagtgggtgtctgagtactggaactagatttgaatacttgtgagatattaaatttcatatgctttacaaaacgtgcagccatccgggcacacaaacaaaatgcccacttttggatgtgaaagtgggggcaggagtttttcccatttaggagctaaaagctctggagctctggtcctcagattcatcttgtgtctggcctgtggtcgcagtgagatgccttttcagtagggatgaggtatacttggggctgggagaggggggacatttggaggtctggcctcccaggggtaggtatgtgtttagccgggctatgcagatgaaccaatctgggtgtctctgtcagggaagaggctaggaaagctgctggtgagaggggtcagagactggtttgccccaagggggatgggggaggcagggaggctgtagaggagctgttgggccagatcttgttgagaaaatctctcagacccgagacttctcccctcctctcatttcctatatttgggctttcacacttaagggactggtcttaaggagagatgtactttttaacatttgatttgcccatgttgtgccccgtacttctgcgtaccaccagaagaccacaatgacaaagaccagcgaaggccaaaggtggccatgtgtgtatagaattgacactccaaggtcaccggatctgcaatctaccaaacagtcttgactcacaccctcaggtttcatatttgaacctcctttgcagggctggtcctggctcctttcaccttctagactgcctttcctttcttactgtcctctgagaggcacactgaacatctgtggacagtggcagttggtagctatatatatacatgtatatatatcagaatttcctctttgtacactgtagcagtggacttccattttgatgatattatacagggtataaatctgcctatctcaacaagttgctttaaagaagaatcagtttcaatgtccaaactaccacttcagtaaagtaacagagccaatgccctgtgtctttttcctttatttatttatttattttgacataggttcttgttctgttgctcaggctggagtgtagtggtttgatctcggctcatagcagcctcaacctcccgggctcaagcaatcctcccatctcagcctcccaagtagctgggactataggcacatagctaactaatttttaaaaattttttattttgtagaaatgaggtttcaccatgttgcccaggctggtctcaaacttctgagctcaagcgatcctcctgcctcagcctcccaaagtgctgggattacaggtgtgaaccaccatgcccacccccctttttcttatgaatgggtgaagcaggagaagagcagtgagtatggctagagatgctgacaccatgtagtatagcaacttgtgggcttctgccttcttcctcaagatgaggccaagaagagcactgggacttccagcctctggtgcatgtgtttcctctgggctaggtggtatgtggtgtccaggtatctgcacacttgctcggggcagggttctaagcagtggatggtggcaatggatatggccaacaagagacaatcatggcagtgtcactgagctgtgaactcccacagaatcttttggcctcccaagctcagagaagaagcttaagggagaaaacctgtcaacagtccttttgccatatttattcactggagtcacacttttataacaggcataggctcaaaggtgtaaataaagccaattattttagttcagcattgattttcatatataaattatcaatatagttttgatttagtaataaaaataacagcctggagttttatcccctgccatggccagtgagagctgtttttaagctgtttctttgtacagggaagcatgtgtcaaagtcacacctcctgattaataaaaacaataaccttttagtccttcctatgttccaggcattgtgcagagggctcacaaatactatttcatgtaatgctactcataattctctgaggtagattagtatttgtatacgtatgttatagacggggaagctgaggctcaggaaatcacttacccaagacagcagctggcaattctaagaaaatttttgaaattctaaaatgcatctgaggacctggcactgtggctcatgcctgtaatcccagcactttgagaggccgaggtgggtggatcacttgaggccaggagttcgagactagcctggccaacatggcgaaaccccatctctactaaaaatacaaaaattagccaggaatggtggtgggcacctgtaatcccagttactcaggaggctaaggcacgagaatcgcttgaaccagagaggtggaggctgcagtgagccgagattgtgccactgcactccagcctgggtgacaaagcaagactctgactcaaataataaaataaaataaagcacgtctgctgccttcacaccccattttctgtaccatgcatgtcaacttctatagggcccttctcttgtatgggtgtccattaggtcatatcttgcagatatggcagagctagagacctagaggtaaagcaagatactaggaaaacaagtaaaagggagctattttctgggagactaggaaaaagaagagactaggaaaagtaagtgaagaagctctaactagtagggggccaataaggggcaaacaaaggagagaagctggctgcttagctaaccaagtagagagcctcggatctggaaggaactggaccgaacatctgtaactgggcagggctggccttgggcctgtcttgacttccttgaaatgtctcttttacctggcctccttctcatggctgtcatcaagcagccctgttgatcatgttcctgaggaaggacagaatggggttggggagattaagtttattagcaaggcaatttcctctagggagaccccaaacctggcttggtaactacagtgaaaggagagcgtttgagccccttcccccttctgcttgatctcctctccttcaccaggctttcttcagacctggttccaatcattataaggcagatctaaagccactcttcctgacactgaaactttgctgagcctggaaaaatcacagaggctcagtttggtgtttttgcatgcaaaatacgagaggcagaggtgaaggtgcattcctggtgccctgcggttcccaggcagtatctgagtgcattttcacctgttatcgcttgcctttcaaatattcgttagctcccccagaagtttagccacgagtcatcttctaggggaaatagctgctctgctctgtttgtagaatctcatagtttattttggaatgaagatgtattttcctggaaaagtgttactactttacagtgtccccttcatctgcgaaactgaaaaggcaggcagccttgctgtatgagaagaccacacacttgcggacagaaaaaagatgcatccgggcttctcttcaagtccaagacaattgatgacaaaggaagtatgacacaaacttattgagatctgttattatccttgtgctgcccgggttttagacaaaaacaataagcagattacataagtgagtgtcaccacttttgcataaccaaggtttcatttttctcttctcacttggttagtcttccgtgagctaagcaacatcatggtagttttctgtagtaccacttatggctttccttgttatcatcacctgcctttgacacatgccttcattaatgagttgatatatttaattatatgttatacagatattttatattacaagcaatgttaattgcattcattcagaacagctcccaattaaaatctataaactacttagacctctataaaaatcccaccatttaccttacagcttcacattaatatttaccctggagaggataaacatctcatcctgtatttatctgttagatcatttttgttgtcataaaaaacaaaagccacatgtttaattggatcccttcggtatgaatttttaaaataatagtaggaatccttacttgggaagatggtttcatagggcatcctaaaaccatcctttgttccaaatcctttgaggatgcacacatttaatgttttccttcttactactatgctatgaacttaacagtgctacatgctaaagtacaggcagcagaagttctctgggaaagtggagatccctagcaagtaaggaacccaagagaaggccattctaagctgtagtcccttgttggaccaagggaggaaggaaacagatagcatccacctggcgctgcaattctactggcctgtggggtggtctggctttaggaagctcactgtgtaatccatcagaggacaatcctgccaagtcttcttttcaagtaaaaaatgttaatgtttctttccatactttgtctcataatcaatattcaattttcaaggcagtaaaactaatcaaagaatataaaatgaatccaacacaagagaaaggagggagaatgagtaagctgcaaatgggactgagcaagaaaataggaggatattataactatagaattttttttttttgagacagagtcttgctttgtcacccaggctggagtgcagtgacgcgatctcgactcactgcaacctctgcctcccgggttcaagcaattctcttcttcctgttggtgaatttctcccaggaggcatgagccaagatcctgtttcatgggtttctgggtataccccttgaaacaccagagtcaggagtcaggaacaacacctagtgtattagttggttttcacactgctgtaaataactgcccgagactggataatttataaagaaaagagatttaatggactcaaagttccacagggctggggaggcctcaggaaacttacaattatggctgaaggggaagcaggaacgtcttacatggcagcaggtgagagaagaaagtgaaggaggaacagccaaacacttataaaaccatcagatgtcatgagaattcactcactgtcacaagaacagcatgggagaaaccacccctatgatccaatcacttcccaccaggtttctccctcaacacctggggattacaatttgagatgagatttgggtgggggcacaaaaccaaactctgttacccagttagaaaccggccagtcagcatgtagtccctctggagctcacaattgcagatcatggtatgatggagttctccactgcacggtaggctctggggcttaggcaggcatatggggcagcagtcaacataggggatggtgggagtgaggtgctctacagcagtggtcctcgacttttttagcaccagggaccagtttcatggaaaacaatgtttccatgggcttagggggtgggagatggtttcaggatgcttcaagtgcattacatttattgtgcactttattttgataattattatgttgtaatatataatgaaataattatacaactcactataatgtggaatcagtgggagccctgagcttgttttcctgcaattagatggtcccatctggaggtgatgggagacagtgacagatcatcaggcattagattctcataaagagcacacaacttagatccctcacatgtgcagttcacaatagggtttgcactgccatgagaatctaatgccactactgatctgactggaggcagaacagagctcaggcagtaatgcaagtgatagggaatggctgtaaatacagatgaagcttagctcgctcatctaccgctcacctcctgctgtgtgacccggtccatggcctgagggttggggacccatgctctacagcactgttatggcatgttccagactcttgagaatcggtccttccttgcatctcacctcaccttcaactttattgttcacttttagttcaacctttgccagcaggtaaagaggtaaagagaacaatgtgtcctgtgaagtatttatgagagaagcagataaatcattagatttattgagaacttttgaagtgcactaggcatctcacacacattacttcattgaatcacctccataatcctatgtggttgataattatattatccccacattctggatgaagaaagtggagctcagagaggttatcatgacatacatactgctcacaaaaccattctgtggcagaagtagattcaacagctcaaaaataaaagagggctgggcacagcagctcacacctgtaatcctagcacttttggaggctaaagtgggtggattgcttgatcccaggagtttgagaccagcctgggcaacatagtgagaccctgtttctaccaaaaaatgcaaaaaacaaaaattaggcaggcgtgatggcatgcacctgtagtatagcttcttgggaggctgaggttggaggattgattaagcctggaaggttgaggctgcagtgagcagtgattgtaccactgcactccagcctggatgacagggcaagaccctgtctcaaaataattaaaaaaaaaaaaagtaaaagagaacatgatgatttatggggaaattgacactaaaaatgtcttggatgaaataaagtgacccaggcatcaggatttaggggcttacatgggataacactgttctactccatagcacctcacctgtctaattagtgtctaattagagacatttttaatcagataagtgcatttatgaacattgcaatttttcccaaagtttaaccatcagtttctctgaaaggacttctaaagcctagaaactcacctcttgttaatagtgctgctcttcctcttaaggattctgcccaggagttcaacaccagcctgggcaacataggtagaactttgtaaagtggaataatgctattctaataacttatttagcaaacatttactgagcaattaccctgggtcaggcctccttgcaaggttctggggacatagacatgagggaattctcacccttgaggccatcacagtcagctagggaagaaaagaagtaaacagatcattataaaaccctgagataagtgctactgtgaaggtatgtaactctgtcccctgggtgctttggaagtgtgagagcttgggacattgtagcaggatgttggtagctccatcagatctggagtcttttccaccttgaacttgagatcagcctaaagccaaacacttgacttttaaatgatttgattttaacagaatcaactttttattatgcaaactcaaaagatgtattctgtagagttttactgagccttttttccctttaaaataactaactatatgttttgacatgcttcaggggactttttttgtaaaatagcacaaataggacaatactggaatacatcagtgtgctgtgaagcctgaatgagtaatacacaagtgactgcactttcaaaaatgtaaagaaaagtaacatgctaaaaatcataaactacaaagaggcggcatagcttggtgagacaagcgttgacttgtgaacaggaaaaaaaggatccctgctggctattctgctgagtgaccccaggaggtccctgttcctcttgggacctcagtttcctggttggtggaatgggtattggatgagaatctcaatctgaagatctgcattccctttcaagtcgctaaaatcctggacttctacgataatgctgcatccttctgaggttccaaacaacaatatgcagtaggggccccttttgcttccttccttgcatgtatccaggcagtctcctgagagcatccagcattggggaggaatggggtgtattgaagggaaaagcaggtgccccattgggaatgggacactcccgccccccgccctacctccttctttcaacttgacttccttttttttttttttttgagacaaagtctcattctgttgcccaggctggagtgcagaggcgcgatctgggctcactgcaacctccacctcccaggttcaagcgattctcctgcctcagtctcttgagtagctgggattacaggcatgcactattatgcccagctaattttgtatttttttagtagagactggctttcaccatgttggccaggctggtcttgaactcctgacctcaggtgatccacctgcctcagcctcccaaagtgctgggattacaggcataagccaccgcacccggcctcaacttgactccctttcttgtcactgtttctagatggtcaactagatcaatactcagatcagctcttctttcagaggaacaaatgagaactttcctcttgttctccatctcctccttctcctaatgcacacacatgtgcatacacacactccactgccatcactagagagaaggaattaggtccaaacctctgttcgcactcagagtcttaaagtgacagctttacgtttacaagttaggcattaaatggaattccattctccctgtcaagtttcagacaggggaaagcccagaattccaatagtgatggtgttcttggcaagcgctttttacagggtggtaagctaatcagtctgcagttcggcagtctgaaggcttgagctttcatctgacttggaatatataaagggcttggcattgcagcttccaaccctatgacttagctttgagcttcgcatcttcccatcaacttcgtagctctctccatcaaccaagtacccactacaatcaaggagaaaggatatggcagattaattgaatctttgtgtctttttagcacctgtgggctatggacttcttgaaattggagttacttttattcctttgaattgagcccaataccccgcttcagtcagggtgcttttaccttcccagaatcctcttgctaaggacaagcaggcaggctaatcggggactactgaagttttctggctcaaagaacataatgcagtgtgtttacaaatccacctcttcgccttcaccctaaattttcctttcctttatatgattttagcactttgggtttacattaagctctcagttacttaaagtaggctgaagaaaataagaagtgtagtagtgcttcactccccagtgatgaaatagggggtaattggctccaaaaatcgttgcatgtcttgtccctttcagggactttaactgctctgttgcccttgctccatggattggggctgcatcagtagcctaatgtgaggggaatggttgaaagtaattgtcagagcccagagctccacttgccatggaaagcctattgactttaatagtgaccatctggctgggcacctctgaagatgtctcagttaaggcctatttggtgaatggacctttgcttatttgaaagctacactgctgttccaacctgatcattgcattttatgtgatgggcactggaagtccaaatgaaagtttcttagaaaacactcccattaaatttaccagtccatgtgtgattgccactttcagtgcagtcagagcacagtcattctctttttattgaaagcatatggtaggtacttagagcataccctaggccagactcagttatggtgccatcaagggcagcaagaattaaaaagaggaaaatggtatccaggtggcagtaggaattcggtaggttggatggaaaatattcatagttaacgagctttcataaggagaacagaaacaagttagatgtgatttgcagatccataggcaatcagtctctgctgagcagaggggaaacttggagaagattctcagaagtgtgcctcacccttgacccaaacctttccctgaacatgtgcaataaatattattaagctttgagaatttctttaaaataatatctgtcaatggtaagtgccacatgccaggccctatgctaccagcatcatctcatatcatcctcacatgtatcctgtgaggtggaggatactatcccaatgttacagatgagaaaactgagacttaaacattaagttgttcaaggtcatacagctaagaagtcacagagctgctttgattaaagttctgtctgaggctgggtgcggtagtgcatgcctgtaatccaagcactttgggaggccaaggtgggcggattgcttgagccctggagtttgagaccagcctgggcaacatggcaaaaccctgtccctaccaaaaaattacaaaagttagccaggcatagtggtgcacacctgtagtccaagctacttgggaggctgaggtgggagaattacctgagcctggggagcttgaggctgaagtgagccaagactataccactgcactccagcctgagggacacagtgaaactctgtttcataaaaaaaaaggtctctgtgacttcaaggcctttgttctctatactattaggaagtccagtaagtgaagaaaagtacatgtaaatttcactaaaggatcacagcttcttgtacggaagggctttgagcacgtcggctgtggctcctgtgcagccagccagatctgcctaagcagctctgggagtagggccacacaggaatctgtcacagggaggattccacattccttcagcccctatcagcacagtcaaagaatggtaagaagaatgcagagggtggctttgaaatactcacagccttccatggataaaccatggagacattacactcatttgatagaagccagacacaaaaggccatattattgtatgattccatttatatgaaatatcagaataggcaaatccatagaaacagaaagcagattcgtggttggtaggtgatgggggaaagacttcagcaccatccccttccctctcagtctcagtgaagtggaaggaaggagtagtctcagctagggaaaagaggggaaaagctgaagacgacagatttctatgtctcccagtttaattacctttccctttgctctcgcctatgaatgccactgcctgcaggttcttagggaatcaaactgggacttcagtctggaaatgtgctttcaggacaaagacccatgcatacgagacaaggtgacaatcctaaggtggcccccagtacttcggggcagtggaaaggaccttgcgatgggtgccagaaggactaacatcaaggccagctctaccatgtctgaggtgtatgactgtgggcaagtttcttcattacaacttctgcaactgcacagtgactagcataatcctttcccattaggcactgctggatcattgcaaagattaaatgagggccaggtgcagtggcttacgcctgtaatcccagaactgtgggaggccgaggtgggtggattgcttgagcccaggagttcgagaccagcctgggcaacatggcaaaacccagtctctacaaataataataataataataataataataatcatcatcatcatcatcatccaggagtggtgaaatgcacctgtagtcccagctaatcaggaaactgaggtgagaggatcgcttgagcctgggaggacagggctgcagtgagccatgatcatgccactacactccagcctgggcaacagagtaagaccctatttcaaaaataaataaataaataaggagacatatgtgaaagcatttccgaagtctaaagctccacatacacataagtgattataagaaatttaacaaagggtagtcacataattgacattgtcctttggaggagagaaaattggtgctatccccttggtggacaggttccctcatccttaaagcacatttccagagcagaaggaagccttcatctaagtccaagcgctacatttctgatatgagagctagtttgagatttaaatgaaccctgtctctcaagacacagctttgcatctattttgcattcaaatttatttatctagagacaaaattgtgcattctttaattctactcacagcgtatgcacgcagaccaaatgaggtgctgatccagcaaaacggcaagtagccttttgcttccctgaaattgctaattttacaaatggcagagtggtgaaacgtggcacggaatatctattttactagaatccggcaaaacgggcacatatggtcttgtcaagaatgaatcaaacacagtttcgggattataattaagtagttgaaattccaaaaggaagaagttaatatgaacaaagtgagatttcgattgcttttggttagcattctctcaggctccttcctttacacattatcaggaacatagctactttgatttcttgtcctgaaaaatgtttaattgtaaaatatcaaacgttttcaccccaactctaattgtacttgatttgacatctgtacaccatgctcagggtaccaaatattattaaatgtaataagtccaggcatagaagtcaagccaaatgttcctacgtaagtatttaggttgacaccttctgtcaacaaagctaaacctctgaccaattctgtagcaggccaataaagatacaggaggaagatgggaaccattagaagaaaacactctctcctcatctctctctctttcagtactgtttctacctgaaatcagggacatattccattctggtccacaagcccagcatctagcacaggggctggcatgtaaaaagagttgatttgggctgggcgcagtggctcatgctgtaatcccagtactttgggaggctgagatgggtggatcacctgaggtcaggagtttgagaccagtctgaccaacatggtgaaaccccatctctactaaaaatacaaaaattagccaggcgtggtggtgggtgcctataatcccagctactcaggaggctgaggagggaaaattgcctgaacccaggaggcggaggttgtggtgagctgagattgcgccactgcactccagcctgagtgacagagcaagactccatctcaaaaaaaaaaaaaaaaaaaaaaaaaaaaaaggagtttatttggagatttgcaacttgtcatgggaaacattcccagggtttcttctagagttgttgtggacctgattttgggtgctaagtggtaactcactatatcttaaaaacacatcagctaaaaggtggaagcaatctacatgcccatcaactgacgaaggggtaaacaacatgtggtatatccatataatggcacgctatttattcataaacaggactgatatatgctacaacatggataaactatggagacattacactaagtgatagaagccagacacaaaggccatttattgtatgattccatttatatgaaatattagaataagcaaatccatagagacagaaagcagattagtggtgggcaggtgatgggggaagagggagattggtagataatagttaaaggatatgaagtttctatttgaggtgttaaaaatgttcttaaattgattatggcaatggttgcatgactgataatatactaaaaacctcaaattttacactttaaatgggagaattgtatggtatgtgaattatatttcaataaagctgttatataaataaaagtttacttcagattattttgatgtgcacttgcagttcagaagcttgagctagattaacagttcctaaccttagttttggctcctaactcctgtctcctctcagatcttaggaccttcaggttccacacagcctaccttgctgctacctagtttttgaagttctaattcccgaaacaaagaactcccttgaagagcattgatgccatggcggaggagaggaaacaagaacttttggttttaagctgtgtctacacttaaccaccttgtgcccacttgggtaggtgctctatcattgaggatcaggacccaattattcccattctcatgtttttccaggacctgacaaatcctaattcagattgctattccctttgagagtgaaatagcttaggtacgtttcttctacaacaatgcagatattctattaatgaaaggagctgctacaaagtaatttttaatgtttatataggaaagtgtaactttttttttttctggagacaggctcttgctttgttgcccaggctgaagtgcagtggcacggttatggcttactgcagcctcaatttcctgggctcaagtgatcctcccacttcatcctctcaagtagctggaactacaagtatgtgccactacacccagctatttgtttgatttttttttttttttgtagaaatgggctctcactaggaaattgtaagaaaaaggagtagctttcttaaaaccctggtttaacatgacaaacccaaaacattgagctgtacacttcattggttaaatcttctttttgcttatttaaagaaaggacaagaaaaaagaaaagaaaaacttttttgctagttcacacctcaaggtacacccagtttctgactttaaagggaatcagtccaaagtaacaaaatattattttgacatctgaaaaagaaaatgctcgttttataaattggatagtgatttctaaccattgttgatggacatagatatcttttgttaaagcctcatcaataagctcatatttctaggagatcatattgcgatgagaattatgaagagggaactggaggtccatgctggaaagtcagtactcctttaattcaactaaaaatatttattcaatagttaaatattgactgtgatatcaagtattttgaatgttggtaaaaattaaaggttttggcaaaatagacaatggtatacttacaagttttctgagggtggttcccagaatatattacccaaaatactatacagtgagaagtgatagtcaccattccatgtctttgaccacaaacatatcttaagattttctttgaagagggttttttagctttttgagacagagtcttgctctatcacccaggctggaatgcagcggtgcagtcatgggtcactgcagcctcaaactcctgggctcaagcaatcctcctgcctcagcctcccaagtagccgggactacaagcacatgccaccacatttggctaattaaaaaaaaaaatgtagagacgggatctcaccatgttgaccagactaggctggtcttgaacttctggcctcaagtcattttcccaccccggcttcccaaagtgttgagattacaggcctgagccaccacacccagcctgaagagggtttacaaaattatttcaccaacatgtaagaaaatgtaataggcattttaaagtttaaccattgtcagtcactcttttaatgccttagtacccagaacagtgctacttttagagatacgtatgtatctattttctgaattcatttttggttgcaaagcatcattctacaaacattatgaaagagagccaaatactgtgacttcaaggattatccaatactctataattagtttcatgaccaaaatgctttgaataactgaaaagatgagtgaatgactggatacatgaatacatatcatccatttatatgaaaatacttttgaatacaggcatatcttagagatactgcgggtttcgttccagaccaccccacaataacatgaatattgcaaaacagtgagtcacatgaattttttggtttcctagtgcatatagaagttatatttacaacatactatgttctattaagtgtgaaataacattatgatgactaaaaaatgtacatgccttaatttaaaaagagtttactgctaaaaaaaagaggctatcatctaagctttcaatgagttgtcgttgttttgctggtgaagggtcttgcctcgatgtgcatggttgctgactaatcagggtggtcgttgctaaaggttggggtggctgtggcactttcttaaaataagacaacagtgaagtttgccacatcaattgactcttcctttcacaaaagatttctctgtagcatgtgatgctgtttgagaggattttacccacagtaaaacttctttcaaaattggagtccatcttctcaaactctgctgttgctttatcaactaagtttatgtaatattctaaatgttttcttgtcatttcaacacgattattcacagcatcttcaccaggagtagatcctatctcaagaaaccactttctttgctaatccttaagaagcagctactcattccttcaagtttgatcatgagattgtagcaatccagtcacatcttgctcctcctctaattctagttctcttgctgtttccaccacatctgcagtgacttcctccactgaagtcttgagcccccaaagtgattaatgagggttggaatcagcttcttccaaactcccgttaatgttgaaattttgacctcctccattgaattacaaatgttcttaatgacatctagagtggtagatcagttccagaaggtttttactttacttttcccagatccatcagaatcaatatggcagctatagccttacaaaatgtatttattaaatgataagacttgaaagttgaaattattccttgatccgtcaactgaagaatggatgttgtgttagcaggcatgaaaacaacattgatctctttgtagagctctgtgtagatctccatgagagctctcaggtgaccagatcagtgagcaacaatattttgaaaggaatcatttttctgagcagtaggtctcaatggtgggtttaaaatattcactaaatcatgctataaacagatgtgctttaatccaggttttgttgttccatttatagattactgactgagtagatttaacataattcttaatggccctaggagttttgaaatggtaaatgagcattagcttcaacttaaagtcatcagctacattagctcctaacgagagagtgatgctgttcgttgaagctttgaagccaaatatagatttctctctagctatgaaagccctagatggcatttacttccaatataagtctgattaatctacattgaaaatctgttgtttggcatagccaccttcataaatgatcttacctgtgtcttctggataactggctatagcttttaactcagtacttgctgtttcactttgaacttttatgttctggagacagcttatttccttaaacctcatgaaccaacctctgctagcttccaacttgtgttctgcagcttcctcagcactcttagcctttacagaattgaagagagttagagccttgctctggatcaggctttggcttaagggaattttgtggctgttttgatctatccagaccactaaaatgttctccatatccgcaataaggctgttttgctttcttatcatttgtgggttcaccagagtggcacttttaatttccttcaagaactcttcctgatcaatcacaacttgacaaactgtttggcacaagaggcctagcttttaccaagaggcctagttttcagactatcttggcttttaacgtgccttcctcactaagtttaatcatttccagcttttgatttaaagtgagagatgtgggactctttctttcacttgaacacttagagaccattgtagggtagttactggcctaatttcagtattgttgtgtctcaggaaatagcgaggcccaaggagagggagagagatgaaggaatggctagttagtggagcagtctgaacacgcacaacttctaccaattaagttcaccagtttatttgggtgcagtttatggtgcccgcaagtaattacaagagtaacatcaatgatcactgattacagatgaccataacagatatagtaataatgaaaaaatttgaaatattgtgaaaattaccaaaatgtaacacagagacatgaagtgagcacatgctgttggaaaaatggagccaatagacttactcaatgcagggttactacaaatcttcaatttgtaaaaatcccagtatctttgaggcacaatgaaatgaggtatgcttgtctctactttctgaatatgcttttggttgcaaagaatcattctgcaaacaacatgaaaaaagatccaaacactgagacttcaaaggttattcaataccctatcgttagtttcataaccaaacaaagagaaatgccttgaataaccaaagggatgaatgaatgaatgatggatagataaacacatgtcatcaattcatccaaaaatacctcttttttttttttgagatggagtctcgctctgtcacctaggctggagtgcagtggcttgaactctgctcactgcaatctctgcctcccgggttcaagtgattctccggcctcagcctcctgagcagctggcattacaggcatgtaccacaacgcccagctaagttttgtattcttagtagagatgggggtttcgccgtgctcaccaggctggtctcgaactcctgacctcaggtgatccacctgcctcggcctcccaaagtgcagggattacaggcgtgagcctctgtgttaaaaatactttggagtatataggccaggcacggtggctcacgcctgtaatcccagcactttgggaggccaagacaggtggatcatgaggtcaggagctcgagaccagcctggccaaaatggtgaaacccccatctctactaaaaatacaaaaattagctggacgtggtggtgggtgcctgtaatcccagctacttgggaggctgaggcaggagaatcgtttgaatctgggagatggaggttgcagtgagctgagatcgcaccactgcactccagcctgggcgacagagcaagactctgtattgaaaaaatatatatatatattatataaatataataatatattataaatatatacatatatatacatatatgtatatatatgtgtatatatatatgtgtatatatatatgtgtatatatatatgtatatatatatatatatatacatatatatatacacacacacactttggagtatatagttttaatggtggtaagtgctctaaaagaagaagcaagtgctatgagagcatatattagggacctttgacccagcttgggatttatgtttaatttgagacgtgaaaatgattaggagctaagaggggttaggctggagagagggtccaggtagagacaatatgtggatccaagaaggaagaacaaagggatcaacaaagtgatagaaataggccgggaggggtggctcacgtctgtaatcccagcactttgggaggctaaggcgagtggattgcctgaggtcaggagttcgagaccagcctgaccaacatggtgaaacctcgtctctactgaaaatacaaaaattagctgggcatggtggcaggcgcctgtaatcccagctacttgggaggctgaggtaggagagtcacttgaaaccgggagccggaggttgcagtgagctgagacagggccttggcactccatccagcctaggtaacaagagcgaaactctgtcaaaaaaaaaaaagtaatagaaacaaagacaggaagcaaagagaaagaagataatgacaaggattaaagatgcagctttgaggatggcaaaaccgcagagaggagaactattaggatggtgcaaaggtaattgccagtttcaccactaaaagtaatgacaaagctcaaggtggtggtaggagggacagctgagtgactcctgagaaaatgtaaagtgctgaacctttgtagtttggaagacttggttaaccagaatgattcattccccaattatgccacatcttcaagattttactgtaaaagcaagcaggctggccctggcattcctaccataagctggtgcttcaacttccacatctggcagaggctctagatgtcacataaattgaacatagtcatccagctcaaagggggcttggggtcattgagtccaattttcattttatagctacaaagtactgataactaaaatttacaaagtaatgcacacgtggcagccactgttctaagtgtttactgtgtattaccccatttaaccctcagaacaacccagtgaagtagaaactattatgattcccatttacagatgagggaactgagacacagagaagttaagtgacttgcctatggggtcacacagctcattagtggtgctgtagaccttgggtataatcacttgtctgtatctctcaaaaatcatacagctggatagcagcagatccaagaatggactcggctgtctcccagtgcagtgccctttctactatggtaaccagaactcgacggtgctccctcagttggttgtaaataacataatcccatagtaattgcaaggatgagaatgaacttttcagtctccctgtccccacgtttttggaatggttctacctctgagagcacatgaactcagcctagttttggggctggtctgcccccaattttaacttccatcatggcattgccatttgaacagtgagtgttttggagctggcagaaggtatttttgcgcttcaattcaattcagcgatcgtgttagaagccatcctccaagtgtccaatgatgttagtgtgtccctttgggagtgatttatagtcaaatgggctgcattatagggtgatgtgctgaacaggggaccaaagtatgaccagcaatgctagagattagatttcaaggtcgttgagtaaacctgttgtcaggatttccagggatgatttgattgggaagaaaatgcatctttgtttcatcatttcaaagcaattttatgctttggttctccccgtttctgtcttctgaacacttccaaggccacacttgagcctcagcatcagcctgaagtcttgtgtgatagagttgccatgcaaggtctctctgggggtatgttgaaagctaccagtaagacttgactttgataaaacgtttaattgttttcttttgcctcaattaagttgagaagactcaaatgtagcttttaaattgaaaagtgtaactgagtgagaaggtttatatcaaatattgaaaggctaaggagccttttaatacattgttagctgtcaatgtgtttcaacaaattgtttcagtcactgttgtgtttcagtcactattacaactggggcctgcaatctgaagtgactcaggggtccatatctctggacaaggatatccacttttctgaaccgaaccaaggacgaggtagagtgggacagaaaaggacagattctagagagctttcccaagggacacgtctggcacctggaagtggtcgagcctaatgtgtaaagatttcaaataccatctggtcatttctttaggacctcatttgacaatctgtgggattgttttttgatgtggtgccagcccgaccaaatgaagtttctttcaatggtgtggttggtgtctgctgagaaagcagaagagggggctcttgtttagctcacaaccattgtgtgttaggcattatgcttgagcattttacatgttctggaagtattctcaaccctggctgcgatttcagtcacccagggagcttttcagaaacactgaggctcacacctgtgatcccagcacgtttggaggccaaggcgggcagatcacttgaggccaggagtttgagaccagcctagctaacatagcaaaaccctgtctctactaaaaatacaaaaactagccaggcgtggtggcgtgtgcctgtaatcccagctacttgggaggctgaggcaggagaatcacttgaacctgggaggcgccggttgtggtgagccgagagtgcaccactgctctccagcctgggtgacggagcgagactgcctcaacaaacaaacaaacaaacaaacaagcaaaaagagacattgaggctcagttcccatatcctaagattctaattcattcagtcttaagtaagaatcggggcgtttgtaattttaaaggcttgtcagatgactcatgtgcaaccgaggtggagaacccctaacttagagtgtcttgttgaatttggggatatttttctgctctgctcatccatccgcttgcaacttagagggagagtcacattcttcatggtgacaagagtgagaagtgtatacgttggcctcaatactccgaatgcctgtgccaaattccttcggcaccttgctttgatggtttggattgcctccctctcctgcctgattccagctaatattgctagctttccaggcgaatatttttggcaacccttgccttctgcattcaaaagaattgcttgccttcattactttatgactctcccagtgtgcaaaagtctatggagaggagacttttaggaggccccaagcaaataaggcctcatcttccatttaaggcttcattcccaggaactttcccaatacaaacctcagtgctcctgggctggccttgctggagagggcttcctgaggcggagttattgggacctgagggaggggttcctagagtgcagcaattccagactgaaattcccaggcttggggtctccctgggaattccctcaggaggaccctgtgtgcatttgggtgaaagaaagctattgttgaggaaatttgccctgccagggaccccagggcctactttgggtgtgtgtgggtgggtagagatgaaggggaaagttccagctgcttcagatggtggcgaatgacttaaacaaacaaggactggggcttggaagaggagagactgcacgtgcctgggcaggtttcaggttcctgacaaagagacaaatctgagagagatttacagacaccctctccatctatcacacaaatctgtgtcaagattttgagtctgcaaaacagcaccagcattatttcattgtctctgtgatttaggaaatgagattgaacacttgtggaatacccactgtgtgccaagcaccaggcaccagggtattcattcacccatatgttaccctagcaaatgatttgattttcaaagtatgccctgaagtgcctatgattactatcccaattttatggatttagaaactgaggcccaggtcactgacatgatttactcaaggttacacaaactgtgtaagaacctgggttaacctgacatataattgaagttatgcttcttttacttcacctctcatgaccctcttcccctatgtctttttaaaaggatatacatattgttacttttcttctcctaaatgttgcctagatttgctttctccatagtttcacctttcattcttctttggttcctgaatctggcttctatcccagcatctccaatgaagcagtactcctgtaggtcatttgatgaccaaaccatcaaacccaaccctaatcagtccttatctaacctgccttcatagtatttagcatgaatggtctctctctctctcttgaattggactatctcattcattttcataggtgtaccagctctatgctgatcaatctcaaatctacctctgcagtcctgacctctctcctaagcttcaggcttatccatctactgcctactagacttattcatctgggatatcctacagaggctccacacactcccaaaaggaatccagcatttctcctaaccaccaccccattcaaccccctttgcaggatctatgaagccagcaacttgggtgtatcttttccctcacccactcatctaaatcagtccatcaagttctctccattctgttttgtgattatttcttaaagacgatctctctcttctctacgcccaagactccttctttaagtgaggattcttttcaagagccttctaaaaagtctctctgaatctgcttcactgcatgagtctgttttccatgccgctgacagagatcttttgaggtgctaattaaactgttccatggctctcagaacctctattttccaaagtacatttgcaacctatttttccaggatactctgtgaaaaataggaccactgtggtcaagtagctttggaaactttctgtgtactatactttttgtttccttttggagattcagatagcatattaaatgtcctgagaatcccttaagttaaaaacaggcttacatttacatacttcagcatcccaaatggatttcatcatggaatcacccctcctcccaaacactcatatttttaagcatgagtcctgctcacaaccttctgcagaacacatttgaaaccacaggatgaatgctgtgatccttggcctgccatacaaggctcttgttcatctgacctctgttcacctgttgatatggttaggctttgtgtccccacccaaatcacatcttgaattgtaatccccataatccccatgtttcaagggagagaccaggtggaggtgattgaatcatgggggcaattcccaccatgctattcttgtgatagtgagtgagttctcatgagatcggatggttttataagtagcagtttcccctgcctgtgctctgtctcctgccaccatgtaagacgtgccttgcttcccgttcaccttccacctcaattataggttccctgaggcctccccagccatgtggaactgtgagtcagttaaacctctttctttataaattgcccagtctcgggcagttctttatagcagtataaaaacggactaatacacttgtctagccacctctcccccttaaattctcactactctcaccattcttgagaatactcatcttcctcacatacctctgtgttgtggttttgtttttgttttttgcttgaaaagctattcccctcccctcaccatctcggcctgccttcaactcatcattgaagacccagctcaactgtcttcccctctatgaagctttctcttattttctgcaagggagaagtagacaccccttctttttacttagaatcttcctttataccttgaatattacacttaggacatacgaagttattctatgtctacctagccttttaacctttcaaaccaattgggttattgtcttatatcttttcatgttatgactacctttatctcctgtcagaagtttggactcatcactgacccaacagaaaacagtcttatcctttctagtttttggtaagacagtgtatgtgagaaaccttacagttaggtatgggtggaggacatgtcaatccagagtgtttgctaatgtgttcagctacagtccacaatagcatgtgccacagtatgctgtctcacctagatggtgtgtagattggcttgattgtaggtatatggtggataataacatcttggcacagaaacaaaacccaaaggcaccttatcccctgctcctaagacaggctcaaggctcagcttcagctagttagcctggatctgtattcagttttccagtcatcttgaggctgggggctcggagtagcagcccacctcatgaatcctgctcgtcagtaaggggaatattcattgtcaagggcttactctgttcaggcactgtgctaagtctttgcctgcattatctcatgtcattctcacaacaactccattaggtggaaactcttattttcatcatgtaacagatgagtgagcgcactgaggctgggcaagtaaaatgacctgtcaacgagccatagcttcaggccctaatccagcctgtggcactgccctgatgggttaccttgggcaaatcaattgatctaactgagactcaatgtcgtcatctgtaaaataggaacaatactagtgtctatctcatggaatagttatgagggttcaatgataggatgcatgcaaagtgcctggcatagtgcctgacacttggtaagtgctctataaatggtagctattatgcgctcacatcagagacgttgttttcagccaggatgaagggaggcatgagggcagttttatactgaaggagagggtaggtctaaaaattatttggatgatgaaaaggtcacaatcctttgggaggcaaaggaggaaaaatttatcttaaacacagggagggagatggcagccaggtaccagaactcttgatgtgtaaagggctggccatatggagactgaacaaagtcagtgaagcttggctcctgtgcaaatcagagatgggctcaacatgtattccatgtagctgatcttgcatgtgcacggtggtttctgatgcctcccccgtaagggcagcttcatccactcctgtgagaaatgcagctcacagatgtggaggaccatctggagaagggatgtgagtgaaggtgggtgactgacagtgggtggagctggagctagggactcaggcggcagacctactgggttagaattacgactgtgccacttgctagctgtgtgggtttgggctatccactatctctctgagtctcagtttccttatctgtaaactggcaatagtaagggtaccaaccttatagggttattgggaggaacaggggaatttattcctgtgaactacttagcacagaccaggcacatggtaaaggttcaagaaatgctgatttttcatcattattatgtgttctggacgtggcaggggagatggggccaatgtggaggatcatagggcttgctgaaacagtcccaaatgaatcttcttcaaattaacctctgcaaatattgcctctgcctccattaatttagagaagctttgcattcttttctcttaagtttattttgcagctcatgtcttaatgagctaaaaaaaaaactatagaggttttgatccaatttcagactaccctgtaagatatcagcatctgacagttctgctgtactctttcaggcattttacttgaaatgatagtaatgtgatatttgcatccagtgcaaattatgaattttcactaattcttagattagatggggcttaactgctaggatgcagcttgcacatttaatctacttcagagcagcttcacttactagatggtcctcatgggtctggggaaaggatgtaaaatatcatcaatgaggtatgaagcatgttttaaaagatggagtcttgttttcagagtggattgaactgctgctaaatcacagccattacccaagcacacatagcatgtattccagcctgagttgccaccagtttttccttgtgacttgatccagtcctccattccctgctggcagtttgtgcacccctttgcttttccctgtgctgctcaggcaggtggttgctgcctaattaaacacccacacagcaattctctctgttttcttcctccattccaggatactgtttattcttgtttttacatttttttggaaaaatgttttgaagcaccttttgaaaaaagaaacatagtgctgatgatcagctaaatgtttttatagcttttcaggaagtgtgaaatgttctgatagctggcagccaagtgtcaagaaggccttggagaaaaagaaaaggccaattccaactcctttaaggcaacttttagaaaagatttagggctttaaattcagcttcacatactacctcccaagtcctctctaattagtagaaggtaaaaacattttggccgggcctgtaatcctagcactttgggaggctgaggcgggcagatcacgagctcaggagtttgagaccagtctgaccaacatggtgaaaccccatctctactaaaaatacaaaaaaaaaaattagctgggtgtggtggcacgcacctgtaatcccagctactcaggaggctgagacaggagaatcacttgaacctgggaggcggaagttgcagtgagccaagattatgccactgcactccagcctgtgcaacagagtgagactccatctcaaaaacaaaaaacaaaaaaacaaaacaaaacaaaacaaaacaacgttttttgctcaatccagcatctgatatacattttaactactttattgagttgaatttatatttaatagagttgtattctgcatgttgaatacatacatcattgtatccagaggccattgtttatttaaagaacttatagaacaattgtctattttaatttattatagaagctacactataatttggttgtgattgcctttatgttacatgcatagtcgtatctgtgatatacttggagcctaatctctggtcaagattgcagcattattttcatgggaaaatgtatgccatgacagtgacatgacttctggcctgcagcaataaatgcatcataccaaaactggagaagtgagcatagcccggtgtctgctgcataatcggaattcattcaaagtctgctgaatgagtgaattaattgtctatattctgttcagacacaactacgtggaacatgaaagactgagaactgttctctcaagttccatcataatcgacaacttcagacaagcccctcaactactcgctgtccccatttccttagtaagggctatccatctcataaagatcttaagaagaaaggacatggagcattagtctaaaatgccattctttaaaagtgatatttaggccgggtgtggtggctcaggcctgtaatcccagcactttgggaggcctaggtgggtggatcacctgaggtcagaagtttgagaccagcctggccaacatggtgaaacctcgtctctactgaaaatccaaaaaaaaaaaaaaaaaaaattagccgggtgtggtggtggcatgcctgtaatctcagctactcgggaggctgaggcaggagaatcgcctgaatcctagaggcagaggttgcagtgagccaagatcgtgccactgcactccagcctgggcaacagagtgagactctgtctcaaaaaataaataaataaaataaaataaaagtgatatttaaacttcattaaaagtagaagaaagccaaatgcatcattttaacttattttttttctttttactcaaccagatagttggtgacatataatcaacacacatttatcgagggatgctattgtaggtactcagcaccgtgctagacacagggaatgccaatgttcctgctcagacagcttccaatcctgttgaagagacaacccttctcaacactggttctattgacattctgagctagataattctttgttgtagggggttgccctgtgcattgtaggaagtttagcagcatccctggcctggccctggcctactagatgccagttgtacccccttcctagttgtaacaatgagaaatgtctagacatttccacggccttccatttcctctgtgatgcaaaatcgcctcctactgcaaaccactggtgtaaaaagtgatctgtcatgcaaattagtatgagacagtcaaatgaggaagtaatagggagtggaattcactggcgtgaatgagctggagtaatcagagacttaaactggacctttaaaaaactgagtgggattttgataagtggcaagattattgcaggtatagaaaattgcatgtgctatggttctaagactgcggtgctgcaatttggtgggtttgtgggatggcctagtgactaactgactggcttgagtgaatggagaggaatgcagatagtggacaatgaggcgaataaggtaggctggttgccacaatgtcagtttaaaagagcggcaggatgcagggggggtttggatagtgactctgccagtagtgtgtaggatggtttggagtgaggatggatgggggaagggctgtaactccccttatccatgcttttacaaagagagaggggaaaacaagttgaaatagtgaacacagattcctaatgcagcaatagcatctcctaagctttgtgtgcactagacatcacatcgctcatgtcatagggtagattctgcagatttgtttttctttcttctttttgcctgtgatttggagatcagaagatgtagatgccacagatttgtctttgaaagtaattgtcttgttcttcacattaatatacttcattaggtcttttagattagctcctgggactaaaatccatattcttcagacagctctctttgcaactgtgtcttgcgacaattctcttttcaattatgttgtgccactttcatatttctttcaaaatgttctcaatcaattttgccggcactttctctcctccaataatatggcaatgtattatcttattcgccatccaccccatgatcatacaattgttgcaagcacctggaaaaaacttttttttcattttgtcaaacttcatagtatttacattgatgagtttaacaactacatggcatgtagaatgtccatgaagaactccacataatcagcatctaaatttgagtatttgaatgtttagggcaacaacatgatctcaggacttctttttttcaggacctaagacaaacaaaaatggctgcaaaacatgagccttgtactgtggctgatatcattgaagcacgagttagctgcaagaggaaaattcacttggtttagtagcggaaaggtgatagagaagatctctagcacaactaatctgaaaattattaaaatctaaaaattaaggtagaaaatggcatgagaacagttttaaaagtcccatagttctgttcagtgaatctgagctcaatcggcttgccatttggtaatacaatgatgtggccttggcagatggtgagtcagtggaaggctcagtattattcaagctcagtttatataggaaagaagcagaaacaacacccccgttttcttgcattatgtctcataaagaaatctttttagtaatttcacttagaaaaggaaatactcaatgtaccctttcacatatctgaggtaggataagctcgcagaatcagtactagccctgaagcttctacatgcctcttattgtgtgagaggaactggaggaagagcggcaaaccatatgatcgctgacctcaaggagctcacgactgagctgaggtaattgagtagctgtgtgtggcacacctaaggtcactatggtctggagaactgtagaaagtttcctggaggaggttgaatttatacttggttttgaaaagtaatgtagagagaaaggtatgggcattttgagtaacatgagaacagaactagcgtggtgtctatagggaaaagctaggtgctctgctcagctggtggagggaagcagagaagctgtatatttagggaaagagtggaagtaaggctgatggacaggatgcccctggctgtgatgagagtgttttggaaaacaggctacttagtgtcgtcagcagtggtaaccactgcagtccatggagcagagatggatcatgaagaaaacggtactttgggccgggcacagtggctcacgcttgtaatcccagcaattttggaggccgaggtgggaagatctcttgaggtcagaagctcgagaccagcctggccaacatggtgaaaccccatctctactaaaactacccaaattagctgggtgtggttgtgcacacctgtaatccccactactctggaggctgaggcaggagaatcacttgaactcagaaggcagaggttgcagtgagccaggaccacgggactgcactccagcctgggcgacagagcgagactccagatcaaaaaagaaaaaaaagctactttgaaggggaaactcctttaaaactggagcagtcctaaagtgttcaacaacccaagtttacataaaatgaattgtgatgattcctgtaaatctgtaaatataggtcatgctgatctgttccctgaaggtgcttaaaccaacctcaacttcagtcgtccatgcctttcatgactcactctggctttccccagatagataaggtctctctgcatgagaagctgggatttagcttcatagcagttttgagacacggtctgtaggagcaatttttcaagaagcaagactatttgcacttcgtcctaaaaataaatgtttggggtggagagcagaaaacagcaaatagcactgttttataaatgaacaaggaggttcaggagcttttctctcaaccccctaaaccttcttctgggagttcctccaaacctaaagtcacacccatctgccagattgtgtaaagctgagtcctcggaatgtgaaatttatgagggcagggactttgttatgtccattctttattcccagcccttaaaacagtgtctggaacacagtagatgttctacatttccccctttaaatcatatgctgtggaattcataaactttccatttttgacacagacattatttgaataatcatctttattttcagttcatccatttcatattgagtttttaaaatagcagctttattgaagtacaattcctaagatacacaattcacccttttaaggcatacagttgggtggtttttagtttattcagagttgtgccaccatcactactaattctggagcagttttcacacctccataggaaatcccataattgtcagcaggcactccacatttccttttccctccagcttttggtggtcacaaatctgcttactatctctatggatttacctatattgaacatttcatgtaaacagaatcacacactatgtgatcttttgtgtctggcttttttcatttagctaaatgttttcaaggtgcatccctgctctagcactatcagagcttcacttcttttttgtgaccaataacattcccttgtatgagttaatcacattttatttatctatttatccattgatggacatttgggttatttccatttctcagctattatgaatggagctgctatgagcattcatatagaggtttttgggtggacaggtgatttcagttctcttggatatatacctaggagtggaattgctgggtcatatgatgatttcaaatttaactttttgagggactgtcagactgtattgcaaaatggctgcaacattttgcacttctaccagtagtgcatgagggttccaatttctccacatctttgtcaacactggttattcctggtcttttttatataaccatcctataatgttaatgagttaatgttgacttttggattataaatatattatatgtatatattatattataaatatataatacatatttattatatattacatatttataatatgcattaatatatattatatagtatatataatcaatatattcacatgattaatatattaatatctttaatattatatatttataatctatttatagattgtaaatctataaatatgaaagtttatgttaatacattataatatataaacatatatataatctattatttttatatctttacataaatatataaatataaaagattacattaatatattatatattaatatataatctaaattatatattaatataattggattatataaaatatattatattttatattacataatatataatatatgttatattttatattatagactatattatatgttatattttatattatagaatatataatataatatatattatattttatattatatcatatataaaataatatatatattatatattatattaagtatatattatattaataatgtagttctatatttttatatattgtatattaatcattacagttaattatattgtatacaatataattatattgcatacaattatattgtgtacaatatcattatatagaatacaattatttatattgtgtacaatatcattatatagaatacaattatttttattgtgtacaatataattatattgcatacaattatttatattgtatgcaatatatacatatattaattatatatatattaacaagtgtgaaagtcttatactttgcctcagaaatggccttgccagcacaatatttcccttcttgcatctttagtttgatgtgttgttgttttatttcctcataaagcaaatgaaaaagagggattggggatctgctaaaccagatgttagcactttttaaatttagagtgtggtggtcacaagaaaacacaactgggccttgagacggcatggaaaattctagaaatgtgtcatttcacagcatctgtgcagaaactgcttctgtgccagcatgttacatttgaaaccacattttgtgtgtgttcaacttttacacagatctcgagaaaagtgaaattgaattttatgcatctgtaatttgatttcagtccatgaccaggccatttctttataataattataagaatgtatccaatatatgactttcatcttctggtaattacaacaatttaccatttatagaacacatagtttaagacaccataagtaacatttcatgctaattgcttttctgaaaataaagggctctgttgtacacatccaagaacaatggtaggagaaaagaaaattgattgatacatcacatcaaagaggagatcaaaatgaagtcatccaatatatgccaaaggctctcataaattacaaattttgaactcactccaaactttatttttaggcaaatacagtatcttcaagtctcattatgaaagttacttcaaagatgatttgatgtgacagtatttttcccaaggctttgcctgttttctattcctaaggcttcccatgcgagcagggattcctggggcccaagctcaagcaaccaacttatactttgaatttgaactcaaaggacaagaagcccatttttgtgatgtgcttccccatttccttcttttgagcctaattgaagaattaaaagttgtcttcatttctaaagttatatgccgaacacaaaggggggtttcaacagctgcttcttgtcatgctgtgggaaaaaaataacatctcatctgaaaaatacctccaggttctccagatagttcttgcttttctcactcacatttttctctttacatgaacagatttggctcctcttcttcttttgtaggtagtatccattcagtaagatatttttcagatattgagagtaatacattgttcattagaaaacaaagttaaacatccataaaatactaaaaagaaaataaagatcacctgcagtgtcacaacccaaagtgtatcattttgctttagtttcttacactgtttgtttgcttgcattcattctttctttcactcgttgcatatttactgagcacctactatgtgccttgcattgtggtaagatacaaattgtgatcctaattttctttataataattaggtttataattgttggcatagtccatgcctcctctcctagactttagtgtctgggaccatcttactcaccatacatcgtattatgaccatttaccaggtcattaaatattatctgaaaataaaaagtttaatggctgcataagacttcactttcagcatctactagaatttactatttccttattgatcatttaagatattttctttttattctgctatttttgataattataattaattaattccattttgaacatcatttgtaagggtatacacatttttatggcttgtgttgtattagccacactgcccaccagaagagccctactaatttaagcatttaccgcagtaggtgaatatttctcaaatgaagttgaaggaagttccaaaatggcagacccaaggaactgaaagacttacccaatacatccctttgcctccaaggagagacagaatgaccactaccaccagaggggaagccagtttgtttaagagaattgaaaaacaccagggagagctctctcaatataatagtactgggatttgggggcaagaataagcagtggtgcaggttgtttatttacatacgtttataaattatctttacagggctaagagtgaactggatgaatggtgttggcataacctcagagaggcaatccaaattttattaattctctgttatgtgtcagagcttgagttaggtgctatgagtgatgcatggatgaactaaacacagttcttggcctcccagaatgttaaaatccagtagcagggaaaagtgtgtgcgagctggaatttgaatgacctgggttccaattctgattcttctacccattatagcagtgactttggagaggttacctgatgtctctgatcttctgttttctcatgtgtaaaacagggtgaataacagagttcttgtaagaaggaaatgagataatgtgtataatgttcttaggagagtgtgtggcacataacactatagcagcactcaggagatgataactaccattgctttggtaatgatgtttcctatcttccaagggttttgtgatgattcaatgaagtaacaaatgcaaaacacttagtgctactacagtctcaaattaagatgacgatctgatgataatgacaacctttttggtgaagaacatatcacaagcgagttgtaccaaacataaatgagtaacaaaagggtagcttgccccttgtctcagagaaagtgagtctcggcatgggttgctgcagaagacagtgttggctctccacatcctgtgacaccaagacttattaaaaccagacattcaaagcaattgcaagttctgatctacacaactgttggtcacttccgcttttgcgcctacctcatttgaggcacctggagtgtgttttttcttggtagaaccgtgacaacatgcctattgctggcctggaattgtctaccaagcccaaagctttttagcagtgggtgatatttgtttcttgtgccatcgctgaataatgacttttgtagtctgaaattaaacaagcattcaagggctctaagtgtctggcaaaaaaagttagtggctggaaaagctgcagaggatgtctatgaaatgcaattgatgaacacacttttccccctgagctgctttcctgttaggtggtggaaactggtctatttcggtgatgtgtgctgacttcttcccttctggagcccatgcattgggtgcctccaggtttcaaaagaatgaggacaaattaactgttcttctaaagtactaatgctgcaggcccttctgaaataaaacctttgcagaatggaaaatattattgtcttcttgctttcaaaagttacttgtttacctgttgctcataaaatgcaggataatttgtggttgggaaaaggtattctttgcctgatgggtttaatttcagcaccgtagacttccctgaagattacaaagctattctattgctacacatttatagagctcaccccgaggaaagggaattagtgtctggcattaccttcctgcctgccaattttacctcactgattcaacctttgaaactgatttaatcaatggatcagcacattattcaaaggtggaaatgttattacagagaagctttcaggagggtggatgattcgtacaggcactacacaggacttttaatcacaccacataaaagaagcaaatttgaatgttgcttatgcccagaattttgatgaaaagtaaaattttgatgaaacgtgaaaaggagtactaggagaagcccatggcttggatttatgttggcagacatttcttctgagaaagaaaactcagtatgttctaatgtaaagatccacaaaatccaaaaaccacaccaatgggtaagcctattgaaagtaagagagatgagaggttgaacatgataaggaagctgaaaagccaagcctgttcccaatagtcactacactccagtggaagaattctcagtttttgtgcagagtcctgcattttgcatagctcagttgctggacaagtgaatgatcattttcctcatctgtcaaatgggaatagtaatacttctcaaggtgtttgtgaggatcatcagatactaaggattttacaggtttttattttccttatatgatgtacacgttctttacattgaaaaaattatttctccaaactagaatcttaagttccatgggtatgatgggtctgataaagtatttggcatctcttttactaggtagatcccactcaccctgagttttttttttttttttttttgagacagagtctcactctgtcacccaggctggagtacaatggcatgatcttggctcactgcagcctccacctctggggttcaagtgattctcccaccctagcccccgagtagctgggactaaaggtgtccaccaccacacctggctaatttttgtatttttagtagagatggggtttcaccatgttggccaggctggtctcaaactcctgaccccaagtgatctgcctgcctcagcctcccaaagtgctgccaccctgagatttgacttaatggagcccatgggagatatagataccttgggtcattagcaaaaccttcaacgtaaagatgtatcaactctgagagaccctggctaggtctactaagttaagtggaagcaccacaacatcatggttaaaaggaaagcctttgtgttgagccaggtgttgttttgaatctcagccctcctgcttaggaattatgatcttgggcaagttacttaacctctctgtggttcaggttcatcattcaaaaagtaacaagcatcatactacccacctcaaaggggagcagaaattaaatgagattaagcatgcaaagcataggagcaccatgccgagcatagaggcacaataaagggcagttgagaggagtggcggcctggcagggtggctcatgcctgcaatctcagcattttgggaggccgaggtgggaggatcacttggttactttatcaaacccaccatacccatggaacttagattctagtttggagaaataattttttttcaatgtaaacaatgtgtacatcatataaggaaaataaaaacaagtaaaatccttagtatctgatgatcctcgcaaacaccttggaaattattactattcccatttgacagtgatcacttgatcacttcaagaccagcttgggcaaaacagcgagacctcttcactactaaaaatttaaaaaatcactgggcatggtgatgtgcgcctgtagtcccagctactcaggatgctgaggtgggaggattgcttgagcactggaagtcgaggctacagtgagctgtgattacgccactgcactccagcctgggtgacagagcgagaccttgtctcaaaaagagaaaagggagaggagtagcaggattgacagcagcggtggcgttgccccttgaggatggaaggtctcagtcatcttgaagtctgctggagcattagttccattgaacctctctttgagggagactatgttctttgtccttggccttttttgcctacctagaactggctgatcttgcatggactgctatagaagtcctttgtaatcaggtcgttgaggtcagataatcgagttccaatccaagctctgtcatttgccagctgtgtgacactgggcaagttgagttactcaacctcgcagagccccttgttctcagctgcaaaatgataatacaataattatttgctgcatagggttattgagagaatgaaataggataatccatgtaaaagtacctcaaccattcactggaacatggtaagtgcctaataaagatatcttctgagtatggaagcaagacttcattacatgtggtattgatttacaattgagtgcatttcatgatattaaaattaggtgagaattggtggtatgaaaatgcaaccacatcaccacaggcctcacacccatgcttcctgtgcagtctgtggaactgtgcatcaattaaacctctcttcttcataaattacccagtctcacgtatgtctttatagcagtgtgagtacagactaatatacctggaaaagttgagtgctctaggtcaactggcctgtttagtggcagggctaggattagactgtcaggaccccaagattccactttgtgacattgtcctccagagccattgccttcgcatactgattcaccttcctttctatagtttctgccctccatttaaccacttcttttgttcccctcaaatcccagatggccagccttttaggcctgcctttcttagatatgatatcaatcatatcatttcaaaatataaaatgaatttgttattttagttagttaaattaatggtgaaagattcatttaccaataattttgactgctcttcatttgttctgggatccctgtagtaatattctagctttctccatgcaagtgaatgctgtactacagtgattttcaaacattagttgaattagtttcaccttggggtctggttgaaaatacaaattcctgtgccccatataacaggattctggttcctgagtctgggccgaggctcagaatctgcacttttaacaggctttgccacgtgagtctaaggctagtggtatatgcagcccacacctttagaaaactgcttggctttgagtcagactgcctggcttgaaatccaggctctgccattgactagctggaagtccttgggccttggtttcctaaacttaaaaaggagaataatacatactagtccatgtaaggttgctatgatgattacatgagataataaatgtggagcacttagtattgtgctgaacctacagttggcactcaagaaatgttaagtaatattattttaaaatctagggccgggtgcagtggctcatgcctctaatcccagcactttgggaggccaaggcgggaggattgcttgagcccaggagttgaagaccagcctgggcaacaatatgagaccgtgtctttacaaaaaacattagctgggcatggtggtgcatgcccgtggtgccagctactcgggagactgaggtgggaggatcacttgagcccaggaggttgaggcttcagcaagatatgttcataccactgcactccagtctgggagacagtgcaagaccatgtgtcaaaaaaataaaaataaaaaatagaaataaatctattgaaacacacacacacacacatgcacacacacaaagtctacaatgtgtttttctggttattaaatggtaattagtgttaacagaagattctccttgcattaacacacgtgtgtctccacacgcattctttaaagcttagtgctaatgttctcttgtccttgaggtgtttgtgatcttcctcttcactggaataattgttcattttatatctctcccacttgtgcctcccatagaaggcattttgttctgcaacaaattctagtgagaattttgcatctctctcttccaggcttgcaagctgctgaaggacaggggagcagttgtagccatcctgcaccccaactcatacaccgtggcccaggtcttacccagtgcttagcactctgtagtacttaaaaccacacttgctatattcacctgaagttctggaagtgagaagcctcaaatgaaatactcaagaccagaatctctttactctttctggtctgagcaagtgggaggtgagagaataaaactgggaagtgttggatcttctctggcttgtttgttctgcagtacgattgggagaaaatgtccaaaaatgtagaattgagaagaacacccccaaaaccaccccagcaattactgttgttttaaaaaatcgtaaccagatggaagacatttcctgaaatcacacctttgtttcttggagaaagaaaaagcccattcctgtgagtgggtgttcattaacttggtaagtagggaagattgagcttggcctggaaggaggtggatttttgcaggggcactcaacagacaattaaataaggaggggcatttcccatcagaacacatgaaacaagaggctggttgaattttctgcaactgtctgcttgaaggtttatattcaatgggtgtcaccacaacttacacctcatagaacagggatttggtccccaagagatgtaatgcaaatgtcacatcataaactcccagactgccaatactgaagggattttaggaatcgtctagaataagaagtacagaccacccaccattgttttgttagtgttaccaaaatgtcaatggttgttcaaatgcctttagttgctgttttactgcatattttctgattccaaaatgattagtatttcttggatttatactctggctctgccactgactggctgtgtgaccttgggcatgtcagttgcccttttgggacttcatttccttttataaaaggagcaaactaggttgaaagatcttaaggttctttttagctctaaatatgggagagtctcccagaaatagaaatgcaccactcctttttttggaaaattcattctttcctaatgttgaaatgctggcagtccagtgagtcaggtaaccatgttacaagaattgtctcacaaattctgtaaggaggtagggaacaaagatacattctgatgtatgtttcttctattaaatctattttggtattccaagtgacatttgttcttgcacagcttatgcttcacaccaacatgctatctgtcagggcacacactgattaagacctattctgagaaaacatattctctgtgattgaaatccaaacgtattgattgttttatttccatcaggagagattgctttctatttggtgatggatgacaactcttcacacctctctgtctgccagctggacagaggatgacacaagcagcctctaagtcttgtgtgggctgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcccagctcggtgcagagagaacatctcgagtctgcactgtctgctgtttctccgtaccacggtgtgctagcaggaaagccttcaaaggattaaaacccaagtatttatgagctaaacataatgtttccctctctctgggaatgcccagtgagaataccacttacatctgcacagaatgattgcatttcgcaaagtactttcacatgcgttagctcattaaattcttaaaacttttactcgtgggaaatagatagacactacatttttaccatgttacaaatgagtaactaggtatgccctttaatctctgatccctgaccccacaagccactcttcaaggcttgaacccatggcttctagtccggtctttccatcatcctgaggtgctcagttattcgagcctgtagctaatgactgcaggacacataatcatagcaactcacatttattgaactcttactatgtcccagacacttcacataattttaatttaatcttcacaacaacctagtgaggatcatatcattattgtcatcggcattttacagaggaggaaaatgacattcagagaggttaagaaacttacccagggtcacatgatagtaagtgacagagttaagactgaagctgagtcaattgaaaagtagaaaaattcttaaccatgatgctctgttgctggcaactccctgtcccttaccctttccaaaaacattaagaataggaaaaaaaagaagagtgagttttccctcttgggctatgctagcaacagaggcccaaggggaaatgctgttttaagccaacctcttggaaagggtcattagcagctgacatgatgccaatatggaccaatatgtctgaaagcttgtttctgggtcttttgtggtctctgccattcttgtccctgtccctggcctccacattcctttccctctggatcctcagtaacattgtcatcctactttggacatgcaccactctccattttaggtgagatatgtagggttattgtaaataaatatttcagaatcagtattatttattccccacctatttctgaaaaggatctgaataaaatctgtctattaagtaatttgaagtttacaaaaagatctgaaaccttgtggaagaaagtcaagggagaagaagacatgaacaatggttctatcaagaacttggggtggaagtcatctcacacatttcataagcactgtgaacctggccctgggattgccactaaaaatacagagctgagtaaaacatggctcctgccctcaaagagctcaatatctagtagcattagaattactgaatttgaacattcaatttgactttgagttcaaaccaagacaataagtgaaacatgatggattatctagtactcatctgataaatggagtagtgtctgttcttcagaagacacaagctgcttataatgctgaataataatgatgaattatttcatatcagtaatagctaatattctttgagagctcatcatgcgccagctattgcactaagcaatagctgcattatcccatttgcatgcattatcccatttaatcctcacaaatgtcttcatgatgtatgcatataattacccccattgtacagatgaagtaattagggtaaggaggaattaccttgtggatccataagtaatacaaggggtgaaaacttcaatggagtttttacagaagattcagacccgtatttcataaggccagtgcacacatttctcggccatttctgtcttccctgtcactctacgggaagtggctatgaatatactgtctccaaaggctgtgactgtagccattgtgcttcggtattgccatttgggacctaacggttcagaagatgtaataactctccttgcatggaccaattacagaaaaactccctttgtaaagcaacagcatgagccagaacaggcacttcattatctgcctctgcccacagggaagtagagacgctggcgagaggatgattgacctgggaaatggcagggcttgggatccatgctttcagggtcaaaggccttcgtgcccacttccaggattggcttctcaggatgccctggtgctggctcgccccctgctggggtgggctcctggggtttctctctcagtgggatcccattggcagtctctcccctcccacagcagcaggcccattgacttctgggcactcacttcccaggacccttttcagtccctgagaatcagaagttcttttcactctgagagtttgcagacggtgttgcaccaagaatggatgtactttgcctgtagagggctttaatctagtgaattgtgctcagacagataaagggtaattttgcttcattttctgtacctttctgaaagtttccagggtcagttagccaggtctctgcaggcttctcagctccaaagcagaggcaaaagtctttttccaccatttattccttgcatatatggaagattcttaggcaaaaagtgattttttttcacccatatcttatcccagaaaacaatgccctctttttagttaaactgaatgactacaaatcatatcaccccaaattgagtaattgcaagtcttgttagttatcaaggttttattgagccttatttcagttgcttacatatgtttttgtttttaaagaaaaaaaaagtgtaacgcctttggcccgggcctcaaattcctttttttccctcaggcaagcacgcttacaagtgagggattcccagcctacaagggtgagttatgtgtgttgagagcagagtggaaaggtgggcatttactcgccctgccccctccactgaactcgaagtgctcattctctcccatgcctgtgtcctctctctcttcacacatggtcatgtatacacacagttgtacatgcacactttctccttgctaaaacttttctttgctctgagtagatgcagtccgttctcacactgctacaaagaaatagccgagactggataatctataaagggaagaagtttaattgactcacagtttcgcagggctgaagaggcctcaggaaacttacaattatggtggaaggggaagcaaatatgtccttcttcacatggtggcaggaaggagaagaatgagcaaaaggggaaaagttccttataaaaacatcagatgtcgtgagaactcactgtcacaagaacagcatgggggtaaccgcctccatgattcaattacctcccaccaagtccctcccatgacacatggggattataggaactgcaactcaagatgagattttggtggggacacagccaaaccatatcatctactctctccctggcctcaccccacattactgctctggtggccaatgctgtagtcacgaattctgccttttctcatgtctgccatttcaaggagctcaccccactcacctcaaaaaccgagcttttatagacgcagaaaactcttcctcctatatgcacactgattgatcacctacacatgccatcaagagcatgtactctggaattagatagtagtgagttggagccatgtctttacttattagccatgtgaccttgaggatactacttaacttctctgagcctctacttcctcagtgaatcataaatagaacctacctcataggattgttgtgtggggattcagtgaaatagggcatgtaatttagtacagtgcctggcccatgtgatcaataaatgtttgctattatcattaagcgtggtgatcttagctgattgtattgttgttgttgttgttgctgttgaagattttgcatcttctaggttatgtttctttgctgctcaggaggcagaacaagtttctccattgccaaattgtttgcttttttttattggggtgaaattcacataacataacattcactatttaaaattatactattcagtggcatttagtgacactcattatgttgtgaaattatcaccactatctagtttcaaaacattttcagcaccccaaaatgagacccgtatgcattaaacaatcactccccatcacccccacctaccaaatctttttttaatgttgctttcagatcatatgccattccataaatctgagaagttcaggaaggctagatagtgagcttttttccaaaaatcaatcagaaacatattcctaaataaaagaaatatactctgatattctgggactgccttatcagagagtgaagtgaaaaatcagaagtgatatagtctcattcaggccaacacagaaattactcctttaatacttattgcccatatttcacattattttctttgcctggtagctgagagagaaaaggagcttgaaactttgagtaaggggagggaaagattttctaaaccccctataaacaaatgatggtaaagcctaggaagaggttagcaggtcagcctctttgcatttaatttccatcttgccacattccaaggaaggaattttagtcttgggaggcaccaaataaccctcaggggaaatgtgaccctttgaagctcctggttgtctatttctgcagctgcccatctactcacaccacccaggttggaggggcccagctcttcagcactcaaatacagtggagctggccacttctttgcacggggatggtttataggctttctatatcaggctgtgtgcagacgagacaggcttgatgagtcagctgaaaaggggaaaggaggggaactccagttggcttgatgctcaagtgagaagtgggaagaaggaccaacagttaagaggactcggtgaaaatactacgggatttggcaaatgtatgtgaaggcttttgtaggtcagccagtttgcccttggagctgtgggcctgcctgagaaggcttttgttggccttgggagctgaaagggagaccctttctttaggctctgcaggctacttggcaatcaatgttgaggcaggttttctgcttctgtggggtgcaaagctttggtcaatgtcatcaagagcatcctcttcttaggaaaccatgaccttgccttgggcaacttttctgtagcctttaagaccagaaaagtgagtagagaagactaacgtaattggacaaaccttgctttgatgggtggtgattgggactctcatatgaattccagaaggaaatatatgaagagtgtctgtaacttgaatgtgcttcctctgttgggtcttgcattaaatcactgatctgcacactttagcctgcagcagaatcacctggcgaggaggtgcctgttgaaaaagataagaagtttcattcagaaaagatgaccctgaagtaagtcttctcactcatttctatttattcacagttcctactttactaagaaagtttttaattattggccattatccgtgactgaaaatacattaagtaaagttgcaggatgagttttaacatttatgagttaacttcatccacatcagtaaatttgacaagtatttttgaagacccatctttgggttttattaaatagaaatttctgaaagttgtatgcccaagggtattttgtttttctcatgtgtgttcaaatttgggaagaatgaattttgcctcctattcactcggtaggagatttagtgtctccttctgaattagccctttctgttcctgaaggaaagtatttatgaaaaatcagactccattctggaaactgaatgatttttgtattttgctgcagttagatggagtcctataaatgagcccaaaacatgctggctaaatctctcataaaaggcaaatatcacaaagaggaatggcccaagtcttattttggcccctggcctgtgtttgtctaaaaagacttttagaagtgtcacaaaacactaaagcactgcctaaatcatcccttcctaactttttgcttatgggggtgcaagggaagttgcacgtggtgggtgggggtgctgagagagagagagagagaacacaaagggccagctcccacttggagctcccctcgtttctctccattttgctcttcaggatgtccccaccccactctgcattctcaccacacccacacatgaacccagcatctgcccaggtgccacgaatcatattacaactttgctccctggcagagagtggccagagagaagtttctggaggtgaggaagtgagcctgcctgactgctttggtggcagaaaccaggggcttaaccagtgactctgtgctcgaggcttgtttgtgaaatcctttagcaactcttcagaagcctctcctctctgacttctcagagatgctggctcttctactttgggaagttcctttgctagtaacacatttgaggtgagttaaatgtcttcctccttcagcctcagcttcctgtgcctaagggtgagttaagcaattagtcctaaatagccccagctgttagggtttctccagaggatgctccttgtgactttgattgcttctaatgaggctattggctttatctgtaatagacaatgttagattacacatctatgtcttttacagcaccttttacccccagggctttacgttttctgagaccactcttgagaaccttggatccagtggcatttttcttcttgtgaataaaaaattattatctttcctgttctccctgtgagatcagccttgttcttgttctgctctggggtactctgtatttagggaaattactcatgactctcgggtactgaaaagacacacacacacacacacacacacacacacacacaccatgcacaggggaatgggagagcaagaacgtgtgagagagagccacttgaagagagacagggagaaagaaagagagtaggagaaagcaataaagaaagcgagatcacagtcaggcctgagaaggtgacagcaagccagtgttttagaggtagggaaagagcccaagatggatggagaaagctcatgcaggagcaagagagcacacatgggagtgccagcaaccttgaaaaaaagcaccagtgacagcaaagggaatctatgaggccaggaggctgggcgagcaaaagcaagagagtgcaagagatcaagaaagggggaaaggaggtgggagagggagagcgagccttcagggcaaaggagtcaatgagagagatcagcacattatttgtgggcagatgaagagaaagtctaaatgaggagctgctttcccctcatcttgttgagttggtggaagaggaagagaagatgcacagggcacagactccagctttcattaatccaaaatggaatttctgggacatacatgctcaggatcaatgtcatctttaaagacccagattccaattagaaccacaagtacacctccccatccttcagtattatttgaaattttagaacaactgccattattctacacaaagtaaaggatgatcattttggagtatgtttttatcaaaccacctccctatccacagacctgtgttagacagcttaccttagtggttgccaaacaccagaagtagatcattgtcatgattttggagggctgggccgaggcctggaattctatggctttaatacgtggctccattgggagattccattgcccaggaagacactggccttaagctacaccctttttcagaaagcagtaacaaattcagttggaccactgacctgaagccagattgctttccaacaaggcccaaactaaagggggtaccaaaaaatcagtaatcaacataaataacattttaatgatatgattttttaaaagagaagtttctacttatgttgcccaggctggagtgcagtgtctattcataggcgcgatcatggaactcttgagctcaagtgatcctcctgccttggtttcctgagtagctgtaatgatatgttttaaagacttaaaattaatgtagacaaatccaaaatgaacaaatatcaaaattttaaatacagtttccaactctgcccttgcacacccctgcctctcttgacccaccctaacaccatccttggttccagttaaactttatatacagaatcaggcagccatcctgtgggccatattttcttgacttaaaaaaaaaaaaccattgccttaaatatcatttattcaagtagaatccaaatcttgtttgttttctaatactgtttttcaataaaagcaaccagggctccttggagaaatgaccgattccaggactgaggcagaaaatacacaagataagcctggaacatcttgtattgccagaaagtaaggaagtgttaacaaatacacaaacaaaaacaaaaagcagaacatcacaggagccaactaaaagagctaccaacagccaaaggtataaaaacttgagaaaatatactagtattattggactataacccaaagtataaaataaacatccaagagtccatactgatataattaaatggttaaataaatggatgatagacacatcttttgtgcagggtaattccaaataatttgtgtagattctctgccctcaaggaggtggagtgtaactcctcactccttaagtatgaactgcgaatagtgacttccttgtaaaagagtatagtatgggccaggcatggtgccgcatgccggaaatcccagcactttaggaggttgaggcaggaggattgcttgagaccaggagtttgagaccagcctgggcaacatagtgagactccctctctacaaaaaaattaaaaattagccaggcatggtggcatgtgcctgtagtcccagctactcttgaggctgacatgggaggatcacttgggcctgggaggttgaggctgcagtgagtcctgatcatgccactgcactccagcctgggcagcagagcaagatcctgtcaaaaaaaaagggtgcaggccgggtgtggtggctcacatctgtaatcccagcactttgggaggccgaggtgggcagatcatgaggtcagagatcaagaccatcctggctaacatggtgaaacccagtctctactaaaaatataaaaaaattagatgggcgtggtggcaggcacctgtagtcccagctactcaggaggctgaggcaggagaatggcgtgaaccaggggggcggaggttgcagtgagtcaagattgctccactgcactccaacctgggcgacagagcaagactccgtttcaaaaaaaaaaaaaaaagtgcagtatggaaagggaaagacaagtatccttaccatggattaacctgacaaatactgcctcagccaggtgatcaatgtgaacatcaccaatcataaatcatgctgattgtatgtgtctttggatatgatgagatgcgaatggcactttatctctgtggtcttcttccctataatccataaccacagcctacttatgagaaaaacatcagaaaaattccaatagaatgggattctacaaaatagttgaccagtactcctcaaaattatcaagtcatcaaaatccagaaaagtctgagaaattgtcacagccaagaggagctcaaggatatgtgacaactagatgtaatgtgggatcctgcaaccgaaaaaagtaaaaactaaggaaatctaaataaagcatagactttagttaataacaaattgatattagctcattaattgtgacaaaggtaccttattaatcaagagatgtttatgtgggaaactgggtgtggggcttatgggaactcattgtactatttcacaatttttctagaaatccaaaactattctaaaatacaaaacattctttgaaaaagtatcttgatggctgaatgttttggtgcccccttaaattttacacacaaggtgagcaccttgcttgcctcaccttcatcctggccctgctgtctgagtgcaaaatacatttgtagcactggatttcctaggagacacctgttgtattagtctgttctcatgctgctaataaagacatacccgaaactgggtaatttataaagtaaagtggtttaatgaactcacagttccacatggctagggaggtctcacagtcgtggcagaaggcaaaggagaagcaaagtcacaccttacatggtggcaggcaagagagcttgtgcaggggaactcccatttataaaaccatcagatctcatgagacttattcactaccacgagaacagtatggggggaacggcccccatgagtcaattatctccacctctccccatgttgacatgggggattattacaatcaaggtgagatttgggtggggacacagccaaaccctatcacctgtacacactgcattctctttatttgtatataaataaatccatagtattctttcctccacaaccttctccttagcataagctgaattacattccttggcttctgacaaggaatgaatttagatgaagctcagtgtgcacttcccaaagttgcagttgtacagccctgtgaagagaagaggcagtggttggaagcctaagccacagaaacagagtatagtccaagaaaggttataatgctgtgcccagcagccagagcttctcctgcagctgctttattcctgccaagcaaagccatgagcttctcctgcagctgatttattcctgccaagcaaagccatcctcgcaaagagcattggcccctctgctgcctgggcctgcctctcagatagagctctggaagcctggacctttgtcctagaaaatgacatgactaaagtgggttttgtctttcctgttgctctctttcctcctttccctcttttcacatcaataccaattagagaggacaagtgttcaatcaagacataatgtcataggcacggacttctcctcactgtcttcctcagggcgaagaagctgccagcctggagcagaaagctgggtagagacactgctttaactttattccctcagggaaaactgcagccatgaaagtacaacattgagctgacttgacttggcagaaagatgtgttttgcgaggaattgggatctgggagaaggtgattctgatactaactcacagagcataccatcccatttctgatcagcgtctgcgtgagaagatcgttcaaagctaggcagtctgagtctcattggaagaagtggctaaatctaaatctggtgtcagttctttttttttttttttttttgagacggagtctcactatgtcacccaggctggagtgcagtgatgcaatcttggctcattgcaacctccgcctcccagattcaagcaattctcctgcttcagtcacccaagtagttgtgaccacagatgtgcgccaccacacccggctaaattttgtgtttttagtagagatggggattcaccatgttggccaggctggtctcgaactcctgacctcaggcgatctgcccacctcggccttccaaagtgctgggattacaggcatgagccaccatgccaggcctggtgtcagttctttaacagttccaccacatgggatttagcaggggaaatgctgcagagtgaatgccagagactttgtccagtttcatgtatatgaccattggctctggtttcagagagacttgggtttgggtcccagaatttcttaattgtgtgacctgggcaagtcatgtagcccccacagagccacagtgtctttatctataaaatgaggatgctggtagagttgctgtgagattaaaggagctaattcaaacactcatcccattgcctggtgcaggaaaggtgcctactggatgatagctctcatcgttgaaactctgaagcttgggactggggtaggggacacttccactagagtacagacccaggaataactctggagacatgttgcaggaggcctgccagctttgttggagtgtgtccttcgtgctggttaatacatgggaaatggctcaggaacaatagcttgctcttgggagaatcccggaagtgacagtgtgaaaaatgatggttttccaaggtggtattccctagggctgagatttcttgtccttccttttccatgctcacaggaagaaggggaggtatttggtcaagaaagggtttccagaagaaagtggctcagagtcttgctcctccttcctcccctgtctgtaaattctttgcatttggaatgtgtgatgacccctgtctgggctttgcactcagatccctgggagctaggagcagccctgagaatgggcagcatcctgcatctgccttcccaggtgcagtcctgagaatgtgctgatggagtttagttttaatgacaatcataactccagaggcctgctctttactgtttttgattgtgcagctgaagactagatgacctcattgaaaagtgggagacagaagcagctgttgccacaggaaataagcccccccgccccgccccacctcaggagacacactgcttctaagagttctttggagtgggggtggatccagaatggcagctgtcctctacccagatctttctttgtgtacccagaggttgggctgagctgtgggtgactagactgtggattaagaaaccatgaatagcgtttccagaacaaattcttggcctgtgaaatctccatttagcttgctctaccaggaccacatgtgtctatgatttgcctcctttctctttttggattagagtctgtgccctgcacctcatcccctggttaagctaccatccctcccactgtcggcttggagctggtttgctatgctgtcaaagatctgagtagcaacagatcacgcagcctggtgtttgtggcttattacatactccccaccttggctgagtaaaacatcaagagagatgtactaagcttccaagcacaggggtgaatactgaagccgaaggcttggtgtactaatggtgtaatttgaggtcccagctacaggttagaggtggtggggatttagagacaggggaatttcctgggtatttgttaaattgcagtatcctgagagctcctttatcttctgtagacaacattatgcctgtttggggaacttcacacatatatatccacgtgattctacccagttcccatacccttggcccatcacaccacaaaataaagtgctggagccaaagaaactctaaacagatgtctttagatgaaaacaaagctagcagcactactgtacagcccacatattgttgtagttttaaaagtagattgttgtggcttttggtttacttgctcactccttaccccatttcctgttggtgtgatactgaccagcaaagtcgcctttgcagcgtttccttggatctcttttttttttttttttttttcttgatgggcatctttcacttctaggaaaaccaaacaaaaatttcctccaaaaattcaagtcagtcaacatttattgagcacctaacaggttcatggtgttgtaccaggcactgcaattggagaagaatgttacaagtacacatgcccaaactcgactgtgtccagtctggagagaaggctggatctggccccacagattgtggtgggagactggctggggatgaggctgttggctcttggtgttttgcaggaaacttcaagaaggaagctggggggtgtgtcctccctaggccccccaccccggttaatttgctttgtttctgaaacacactgaccagtagctaaatgggcctagctcatgttcagggctgcgtgctgaaacttcattagctcttttcaaagccctttcctattggtatagaggttcctcttaacactgccagcttccttgaaaggtttttcagctgctccttatagaatcacttcgaattaaaatgcttcattccaggggagattttatttacagccaagcaactgtaactagtagcactccccccaccaggctgcagtgactatagatctttgatactgctgaatgactctgtcaagggttccaatttgcttttatacaagtgcatcacccaattcaaaataaatgcatccagactcccttgtcctctcccaacccccacacactattccatttcccataagcacgtggcctgcggctcaggggtgtcagtcacttagccagctgtctgttgcctgacacagacatatcaagttggttcaccttaactaagtgattgagcttgattgccaaccatctggtgagtttagttaagggaattgtgatttctagaccagtctaacacggccaaatatgtacctccccaagcccccaaaacaagtgtgtctgtgggaccacattttatttgtacagttacagaattttatggctggggaggactgctttccaacttcattgctgaagtctgaatttaccccttcaattcaagctctgaaaattttatgggctgagcccaaggctaattgttccaatattagatgaagcccctgtcctcaagaagctcacagtcactcagaggtaaaaggcagtcaccacttggctctaatgtaatgtaataagtgccatggtagcggcaagaacaaagtgtgctgtgagaatccgaaggaaggatggattactctgcctgtgaggggagagggtcaggaaaggctgctcagaggaggtgatatttgagctgggtcaggtgggaaggctattccaagcgaggagaactgtgtgagcaatggcatgcatgcatttgccatatttggggaatctcggtttagagatgagaggcctcccatgggcacaggttttccagagaataaatgaaatcaagagtgtctgaggctgggaacagtggcccacgcttgtaaccccagcactttgggaggcttgcctgtgttatatgcctttggcaggtggattgcttgagcccaggagttcaagaccagcctgagtaacactgcaaagccctgtctctacaaataatagtaataataataaatcatctgcatgtggtggcacacacctgtggtcctagattcttgggcagctgaggtaggaggattgtttgagcccaggagatcaaggctgcagtgagccatgattgcaccactgcactccagcctgggtgacagagtgagaccccgtctcaaaaaaagagcatctggctgtagaaaggtttttcccaagtatgatccaagcgttaggactcagctccatcctggtcagcattcgtagatggccaagtgtgtgtcattgtggatggctcctccctgggcaccaaaggttggtatgtagccaccttcctttaaattgtggcaacagtggtggcagccaaggacagctgctttgtgggagagaggagttaaatgtgagaagatttattttggttctattaccagcggtccttttctgagtgaggcttaacaagaggcaaacgcctaatgacctcctgagtatcaccaaagtgttcaagataggcttgaaaagccaaagaagatgaaaagaaagaaagaaatcaaagggtccttcaaaagaaaagaagtagacagtaacggctataggatttgggatcactttttccctgcttggcaggttggaattgcagcttaggtatgttgaagggtagttcccctctaatggtattattgatactagactctctgttcccacagagagagctatgttggggaagaaagaaaatatttgatgtctgattcatgaacacgctaactggcccatgcattgtggcagagaagtaacagctttattttgaaaaatgtcaaccttttaaaaaaaaatcaaagaaaataacataggatttttgtcactcatggcatgccttccacatggctttgttttccaaacctggccagcctgcagtttccttcccatagtggggaggagaatgagcctcccacctggagagtgtggagccccaagaagcagcatcctctggtggtcccaacatctgcaaatagatgagacagctgactcctctctggctggacttttgtttttgccctgtgcctgtctaaccttgggcaagcaaaagatctgagagcattagggctggaaggggccttggagaacattgagcccaacctccctcccccttgtacaaatgggaaaactgaggcccacagagagggagggacttgctcatggtcacacagccatggagatagagccaagatttgaactcagggttctttcttctagtctttgcaactatgggctgcagtctctctcagcagtcccaagcagcagattagtctcctggagaggcaggggcatgctttaattgctgccaatagggaaagttatagaaaagagggacagacctacttgctgctctcctcccttaggtaaacagccttgtctatttctagtcacatttcccttccagcgagctttcctatgttatatgccttgtaagtagagaatcaatgaagttcctcagttacagaggagattcaggtggacaaagccatgttatagacctaagtccccttgtggcacaggttttgtcctcaaaccatcatactgaggcacagttcatgcatcacctcctccagggagcatttcctgatttccaagactgagttgcacaacccctcctcaccttagcctttatcaactgtctgtcatggttgactcatctgtctctttctctgggctttgaacttcttgaggacagggaccttgtcttctccatgtcccaagtggatagcacggggtccagcccaaagtagacaatcagtgttttttaaatgaccgaggactcagattcccatggtaacaaaagtttgactcttgtttcctcggtgaattgaaaaaccaaccactgtaggtagggaaatgggaaatccaaacgagttgtttgttattcactgggcaggatacttcatgggactctgctagctcaagtcctgaagagccctgctctgtggtggtatgtctgccataggcccacctgtgcaatccctggtgggtccatgggattgtttcgcttggatgtctgtgactgtagacttcaggaacaggatacaggttgttcaatagatttcagttagactgaaaggccatggctgaattctgttgtccttcacctaaacattattggagggaggcatcttcctaggcagagggagtgaggtggggattggctgattatgaggaggccagagcttcaggtcagaatgttttttctcatctaaatgtattaggttggtgcaaaagtaattgtggtttttgcccttaccttttttttttgagacggagtctcgctctgttgctggagtgcagtggcgcgattttggctcactgcaagctctgcctcctgggttcacgccattctcctgcctcagcctcccaagtagctgggactacaggcgcccgccaccacgcccggctaatttttttgtatttttagtagagacgggttttcaccgtgttagccaggatggtctcgatctcctgacctcatgatccgcctgcctcagcctcccaaagtgctgggattacaccgtgcccggccgcccttacttttaatggcaaaaaccacattaacttttgcaccaatctatagcttggttttcattctctggccttggagtaagccctacaggtttacatgcaaagatattcccattcctaaaagccgtgtaccgtaggatcctgggtcattggaggcagtatcttttacttagactcatttgctccaggaaagtgagcaaaacatctctttttttgtactgtagccaaggctgttgtaggaagcgttgtctgtcattctcaatgctgactgcacattcaaacctttttatgtaaagttgaaaattcacctaagattttaagtaagaaaaaaacagaaactgataccagagttaataagaaaaacaattgttgctcaggccctactcataccaattgcgtcagaatctcatgggtcagccttggaaacactctctagatgttttttaatatgcagccagaattgagaaccactgatctaagtagaaggtgataatgtgttctcttcttgttctcagttactttctaagggattctaaagccagtgacccttgaaaccagaactctcaggattttccccaactctgtgaaggtttgagacacaacagattttgagagaaatactcattctgctctcacctagagctttgcttcagtctaagttgtgtctgggtccacatcaagcacatgggtaagggtacaaagtatttggggaaggcaattctcttcccactatgctttataaggccccagacactcataattttgacttcgatttcattgcttgggcagagtatctagtcctttctcacagattacagaatttcaggtcttaaaaaaaaaactatcggggctgggcgcggtggctcacgcctgtaatcccagcacttcgggaggctaaggcaggcagatcctttgaggtcagaagttggagacagcctggccaatatggtgaaaccctgtttccaccaaaaatacgaaaattagctgggcacagtgatgtgctcctgtagtcccagctattcaggaggctgaggcaggaggattgcttgaacctgggaggcagaggttacagtgagccaagattgtgccactgcactccagcctgggtgacacagcaagactctgtctcaaaaaaataataataaaaaaacctgtggatattttgctcagtacctgggtgatgggatcattcttaccccaaacctcagcaattacacaatatacccaggtaacaaacctgtacatgtaacgcctgaatctaaactaaaagttaaaacaaacaaacaaaaaaacccaaatcataaaaaagttacctccaaagtacattcataatagtatagccagagcagttctaagtaattttaaacggtgagtgagagaatgtttgatacctggcttccattcattcattttctttggtctgaatgtgtagtgggcacatggtggaaacagatctttgactttggggcttttgaggtttgaggcttacagagagagccctcagtaggaggaggggtgtgtttacataaccctggggcaccctgtcaatgtattctgtgcagccaaacagatcaatagagtgaaaaaaacaattcagctgagtgaactgataggctgataggttatttgattgactgggctggtggagccactcaagaagaaactacagtgctataacttgggaggccagataaacagctgatgccaaaagcatctgcttagcaatcactggagcccagttgacacaagctattggaaccacatttgagtaaaaaagatataaagtgcactggggtaccatgactatgggtgaatcttcttcctcatcatactgtagtccttcagatctcaggggccgtgtagcttattacctccaagtttcttcttaaggagagaagagagcacagctctgtagtgactctaaagcttctcagctgtgtggacttgagcaagtgatttgacctctctgagcctcagttgcttcctccagccataggagtaaatatattatgtacttcatagggttgatgggagagttcagtgaggttagacacagaaaatgcttagaaaaatgcttgatgcatatacataggaagcatctaataaatggtagcattgatgattcttataaaatagaatgctgcaggccaggcatggtggctcatgcctgtaatccaagcactttgggaggccaaggcaggagatcacttgaggccaggagtttgagatcaacctgggcaacatggcaagacccgtttctccacacacacacacacacagacaaaattagccaagcatggcagcacacctttgctcagtacctgggtgtcacagctactcaggagggtgaggtgagagaattctttaagcccaggagattgaggctgcagtaagccatgttcacatcattgcattccagcctgggcaacagagtgagaccttgtctcaaaaaacaaacaaacaaacaaacaaaaaacgctgcaattggtgcagtggataggacacagactttggtgtcagatgatctgggttcaaattctggctctaccacttcctagctgggtgcctagggcaagtcagtataaaatctcttggtaggtcccacttccctcgccctctctcatagctgaagggtgaggtgaggtaagcctttagcaatgggcttggtatgtaagtggtcaataaatgctggtttttatgattatcaatcgccatcaatatgatagttactgggaaattgccctagttcttcagtcactcctcagtaggacgcaatttccttagtgctagtcattgcagtcccctttttttggttgtgttttggtttgccatttactcccatgtggagtgtgggatacaaaatgaaccctagatccatgccctggggcctagccttttcataaccctgccccactcattcctgtttgcttatgcagagcttcccgtcaatgaaagccccaaggtcctattgtaaggcctgctgtgaaaccaggtctcccccagcttctagctaattgatattctaaaaccttggattgcagcttgacctttatccttgtcaaatatctcttgggttttggcccatgattccagccagtcattggctctttgtatcccactttcttgattattttggttgcgttttttaattaggcgttgtgtgttgcagagacacatgatggtgcttaatcatgccaccatctccctcattgctctttgtggttttgtgagtcttgaattgacatgtgtgctcctcatttagccttcctgaaaaccctacctgctgcacctatactttcaaacatgcactgctggtcatctggaggcatttacctgaaatgttaccatggtgcctagacaggactctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaagatttggctggttacaataaggctagatgggctagatgaggatacacaacaatggctcaccccaatttggggaagtcctttttggcctttatgcaatgggctctctaaaggactagccatgtggtagcctgtctaggggtggggtacacagtgggaggagcccttattgatggtcttggggtctggaacccatttcctgctaggcaactgactcatcctgtgacttagggaagcaagccattgcccatctctgggtttcagtttccagagggtgttagattggaaggtttcttccagatttgaactttgactattttagtgacttaagagaaacagctgaatccaagtgcaaacgtctgtcttgcacctttaaaaagaaccaaaaccacattgtaggcaaacgatccccagtttgaaatagcagcttccgtctttggattgtgtcctgctgcccattctttctcagacctgcctggttccacacactggctgaccatacaagaccttttcatctcagcactagatgtgcacgtcttttttcttgactgtgctctcagaatactgggagagattttttacaatactgttactactgccatgaatagcacctaccaatgactgtgtcttgtgtgacaggcactgtgctgtatgctttgtgtacattttctcttttgatccttataatatcctatggagttggcattgttattaatcccttttacagatagagaggagggatgactcatggaagtgacacacagctagtaagttgcagacttagtactgccagatcccagggtcttaatgagtattataagtatgctttttgcatccctgggtggaacttggatgtattaataataacaacagtggcagtatctcttatacgcagtgaggtaggtgctgttatcctccattttatagaggaagacagcaaggctgagagagatgtggtaacttgcccaaaactgcataactataagaatccaagctgaaacgaatctgaggctaattgccctcaaacccatgctgttggccaggcatggtggctcatgcctgtaatcccagcactttgggatactgaggtgggcggatcacttgaggtcaggagttcgagaccagcctgaccaacatggtgaaatccaatctctactaaaaatacacaagttagccaggcatggtggcgtgcttgggatgctgaggcaggagaattgcttggacctgggaggcagaggcttcagtgagccaagatcacaccactgtactccagcttgggcaacagagcaagactctgtctcaaaaaaaaaaaaaaacaaaaccaaaaacaaaacccgtgctgtttcttctacaccatgctgcctttagggctagaacaagtcttaaagaggctgtgggtttgctttctattctctgctcccaggaactgtggcactgcttttctgaatggctttgccggcgcagctggccaggcttgggcaattcagggttcccatagtgcaagagcagcatccacccgactccatctcccagaagcatgcagtacttactgacaattgtatgcccaaagtaggtaattttgccttttcaagcacaaaaaggtaaatcaaattatacccaatatagagcagaggaaaagaaggaacaaatgaagtaggaagaaatgcattcccttctgtgactctcctcagccactgtctgtgtcactgtctataatatatactccttgcttttcatttccttgcatatcagtgatccatgttcccagtggtgtctaaaggccacctgtattcaactgttagctgccttgcatgtgcctatctctcagtttcagcagctgcttcctcagtttccctagtcttggcaggtaggagctttttacctaaccaatagaggattgccatccagtggtacatattgggaactgcatggctgaaaaaaaaaaagtcctgaatttttttccccctttctaaaggcaaacaccacccattcctcaatcctacttaagggattaactatgccctttcttctcttttttcttagtcttttgtcagctttgctgctcattagctcttatacaagaagcagagcaggagaagtaaatgcagggaaatacaaatcactgccggatttcagcacccccacacccccgctattgtgaatggtttgctgggagagaagctctaggaactgatggggttcagctcattcagaaaatcctgttctcctttggtattgatggctgaaaactctgattacatctgcagagcagtgtgaatagtaggttctaaaaggggctgatacaaaggacaattcacaacagattacgtacaagtaggtaataaacaaaaggcaaaaaatcaacttcacttgtaatcaatgaactgtaaattaaaactaacaagagaaattatttttgcatataaaattggctgagaaatgttaaaatcaaaattcccagggttgacgaagatttcgtgaaatggttgtttttctacactactgctgggagtcataaattactcagcctttatggagaacatgttgacaatgtaatcaagagaattaaaaatgtctatgcgctttgaccccatagctttgttactagatttcacataaagaattcatcagacactactgtttatgtctacaaatcttaactttccctattataatagaaaaaaacaagactctgaatgtctaaaaagtgtttcttaaactaaggcataatcataggctagaatattacatagcaatttatccaaaatcatgttcttagcaaatatttaaggatttaaggttttaggaaaacgcttatggcataatattttttaaaaaattctctcagggtacaaaactaatcatatctcctctttgtacgatataccttttttttttttttttgaaatggagtcttgctctgtcacccaggctggagtgcagtgatgtgatcttggctcactgcaacctctgccccctgggttcaagcaattatcgtgcctcagcctcaggagtagctgagattacaggcacccagcaccacacctgactaatttttgtatttttagtagaaacggagtttaaccatgttggccaggctggtctcgatctcctgacctcaagtgatccgtctgcctcggcctcccaaagtgctgcgattacaggcatgagccacaatttatagaataaaaaatgaggctaagggaatgatagtccagcttaaacacacagtcactactaagaaaatgattaaaagcctgtacattctggactcatggagttagaacttaaaaggaccttggagtacatctagtgtcagccccaccaatgccactgaaatcccctcggtgactacctgacacactggttcaggcagtctctctttaaatactgtggttaaggaacttgctcaccgcctctggcaaccgcttcttcaaagtaaatgatagtgataatcccatccctggtgcgcgtctagtgatttatagtctgtgaagcttctaaaggcacattttcctctcacgaaccctgggaggcagggagaacaagtacatttatctgcattttccagatgaggatcctgagttgaagtgactcccagtggtaaagtgacttgtgtagctggtggataagataggactgcagtccaggtttcctgactcccactctgaggcttgttccagccctccacaaaatccagggtctagtttcattcaagtatctccttttattgagtttatgttggtcttgctatagctgtgacccctcccatgatacctcatacatcgtctcttagaccttgaaagatgtgcttggatgtggggccacatgctagctagctaaggtccagagtagggtgaacatggaaagagctcagggggagaatgaagaaaccaatgagtccaccttgctgcaaattctagcagtctccacacaggaatctgcaaccatatttatgaaacgttgttttcataaactgctgcttgttcaataaggcataaaatagccagtataagatagttatttgctctacaatatcgtttctgcaacacagcttcaatgtcatagcagttactgcattttgtttagtttcttaagagatgtgacacagtagattaaccattgacatcaaaatgcagaggttcccttagagctgtcagcaatcttgttccattcttttcccacaactctgcatcccgccttgggaaagcatttgtacacttccactgcaaggtctagtcacagacccactcggatttgtcaatgtcatgggaaagcaacaggcaggaagacaactttctatgaccttgggatgctatctgtgagttaggcaaaggaagctgagattcagtccattactggttatccctgtacacggatggtccacatcccattccagggactatgaagaagggcaaggaagacacagtagagttttccttctcacagaggtggcaagagaaatacacaggaaaggaagaacaagccagaaaagacaggataggctgactcttccaagtgcagtgagagctctaagagggaggtgactcactgagggctgccggttcaggtcaggactaggtcagaaacctgctctggcctagacccaagggttggcagagaacagaaacagctcagtgggtttgagaacaggatgggcactggccacgggagccaacaccatgaggtcctgatcaaaccctgcaggcgtcttctctggtgcagaggcacctacttccaggaactcagtctcagaactcagcaggaagtcacaccagccctcccacgcctaatctgccagctgctgcagcgggcacttgcctgccctggctttggagccttcattcttgccctagtgggggcagggtatgttctaactagagaaatgccaaacacctatgcttgccccttccgctggtttgactgttttcccggaatggacctgagaaattcagtgaaatgattcaaagaaacaattagttgattccattagaaagttagtcaaactggtatttaagctgaatttattctggcagatgggcttgcaggggtagactcctgccatagttcctgaccatctctccccaccgtgttgctaaaggtgggaggaactagaagataaagggagggccccagtgggaacgaatggaaataccaaaagctttgtgcgtgtctgcttccatccagctgctaactgttgtcccactccattagcccaatcttgcccagtaagttctcatgacagcagtgcacatcccttcccaagagcaccagaaactgttgtctagcagatgttaggatacgtaaggggccaagtgagttaccacgaagggactctcaggtccatacattgatatgaagactaggtttgaagccatttttcactatgttcttcagtttgtccaggttcccaaagcccaggttattctcagtctaagatttttttgctcgactccccacagggtcgagctatgtgatctatgtcaagtggtacctcccttctgagcctcagggtctccatgtgtaaaatgagatcgttaagtcagatgagctcagtggtaccttacagctcaagcattcattctgtgaattcaggtttgtcctcttttggtccaaactgaaattgccttcatgggatgacccaagtgtcttgttcctaccaatattcttataaactcaattcttttctatctttttaattccctaccaatgtgggcatatgggtccactttgttcctttcacaaagaaaatggtctgcattgaggtttcttttcaagaggggcaaggaggaatctcgtatttatataagatactcaggcccatcacctgataccacccttccatcttaggtgtgtttgatcattcattcatgtatatatttattcattctctcattcagcaatatcaacggtgtgactacctcatgcatagtatcatggtgggcaatgcatatgcataagaatatacagcatgatcacttttgtaagatgggaggtgattcacaatgaaccctgctgccatcctgagctgtcaccctactggagtcactctgcgctactacataccacccctggcagagaccctgaaacttacaccatatcattagaaagacaagctacctgtgtttaagagtattgcaaatgatcaattcataggctaagcaatctagaatagagagtacttaaaagacgttaaacctaaaagaaaagaggaaaaattgtgcaaactaacagaagctatatgtgtgtgttttcattcctttgatgggacactcaggagactttgagtatcagacctagtgttaagagggctattcttaagacctttgattaaatcagtcaaacttggagtcagatgctttcaatgatactcttgtataattcttacccctttacctgttttacagaaagggaaactgaggccctatgtggccttcactataatgtctggttgcttagaacacagttgcagttgtccgggcacggtagctcacacctgtaatcccagcactttgggaggccgaggcgggtggatcacttgaggtcaggagttcgagaccagcctggacaacatggtgaaaccccgtctctactaaaaatacaaaaattagccgggcctggtggtgcacgcatggcatgtaatcccagctactcaggaggctgaggcaggacaatcacttgaacccaggaggtggagtttgtagtgagccaggatcgcattactgcactccactctgggtaacagagtgaaactccaactcaaaaaaataaataaataaataaataaaagcacacagttgcagtgctgcaaaattcctctttctttaagggagaagatgaatagtgctcaatcctgatatcaggaaaagtcacaaggccctgggtctccagctccaacagttctttctctgtggcgtcctcgggccaaagcccagctatatcccagctccatgtgggcatccagagaaagcagaactggagaaagccttgagaccagccttcctgtttaagctgtagtgattgacaccaggaactttcctcacacacctttatttcagattactggcctactcagacctttgcaaccttcctgaccccacaggcatgattaactgcctgaattttttgtcacgggtcggttttcccacctggtgtcttgcgtgcttttttccttggaatttcttggaatctttacacgtttttgacacctgctttgaccttctagatcctggagcttttgcccaaaaggctctgaaacatgcatcttgcctatggagcccgcatcctagcctgccttacttgggctgccttgataccatcccccatcagtgtgacaatgatgattctgggcacgtacaagcctctttcccaggaagctggagcaccaaatgacagctgtgtttgagggatggctccgttgacaactgattcagaatattgacaagacttcattatgtttttgctcttgtgtttacatctttcaagtgtgtttgaaaaatcaagaaaacaatacaatttggtttcccaaattgaaatgacaatgaaactgcctttttatttatttaatttttgttattctcatatttctctaggcctcttctcacacacaccaccagccaccaccccccatccccatctccccaccaactttctttctggaaaagacacatcccattgtagctgtactgatctctagtcacatactgtatctttgcagatctctctgtcattgctctttctgttctcattcatagatgacacagctaaagacggtatccaggcctatgcaggtttggctgaaagggccaacatggcattttcttttcctaaagatggtgctttggtttgtagctgtttgctcctgcctttctgtttttcgggaagcctgttggctttgcttgtaaagagacagcctgtaaggctatggtgattgaaaccagtcagcccagtgcaattcaattcggtggaagaacactgagtgcctattacaaccaggaatctaaaggaagggggagattcacccttaccttgggagcccatgtggggaaatgcatatcttcagagaggggaaaaggctgtgagagttcacaagtgggagtgacttggctctctcacctagttttcaccaactctgaccactttatttcacctcccattttaaaatgctatcttgtcttggcttgattgatatgttatttctgtgattttttttcctgcttttcttcgttgctaggtcttctttctccctctctctaactgggatttcttagatttcttaaagacctcatggacattcctataagtatgtgttgccaaccttctagacccaccaatcagaaaccaaactcatcatcatgccttcccgttttgttaatgaagtgccacttttttgtccaagatagaaacatcactgtcatcttgagctattccgtcaccatcctttctctgccgtctgcatattaattgcaagttttcttgattctattaagaataaagaaatttgagagctgccagtaacctaagaggtgatctagtatggagttttcattgtctcagggagtcagaggattagtagttaagctgagactagaactcaagtctaagattcctagactgttgcttttttttttacttcacatgaccctaaaatataggtaaagttcatagactttagaaagaaatgactaagttcaagtctccactcatctctaccatttgctagctttgatcgtgggtaagtagcttaatctctgtgcttcatctgtaaaatgaaatgaaaataccttatgtaaaggaatggttgttagaatcacatgagaaaatagcataaaacacttagcatcagatggactctacatgagatcacctcagttccagatctactgctaacactcttctagacctttccatgcttactgttaaatcttatctttctaatatggaacatttagactctaaagctttttgctgttctgaatcctatggtcttaactatgtaaggaattcaaattgaagtagagtttcaacatcttttgaaaaagagagtttctgcaaatgttaatacctcagattagctcaaagaaagataaaacagagagctcattagtaagtacttgtgaggtacttccaaaattctgctttgttaactttgagaggcaagcaaaagagacccgtagctagtctagacttaagccatgtccagaaagagtggctgattggtttacttgtgaggtttgggtagggggaatagtatcatactagatatcctgtttaatagcctgttcttattttcacttaacaatatatcttggtcatgtattgtcaatgagcaaataactccttatgagccctagtgtacatgcacatttagtaggggaaccctaagagattggaaaatgcatgagaggaagagatttctggaactgcagggctgtctaaaggagtgggaatatccttggagccattgagaaagggacagagacagctgacatctttctgagagtagaggacaaagggaggaaaggtagaggaagaaggttgcctaagaactcatggctctaatgtccttggtgattgcttggcctaaaacacttcaagccttacaaactgctttttaagacaaaccagtgtcatttaaaatcactgctagggatagcctttctatgtctagttaccttagattatcagagctgaaagaacttcagagatctctttaaatgtaatatgaggaaactgaggcccagagagcagaggaatagttcaaagccctcccaatggtttgatccttggtagcataatgagcagcatattagctcattttcatgctgctaataaagacatagccgagactgggtaatttataaaggaaagacatttaatggactcacagttccacatggctggggagccctcacaatcatggcagaaggtaaaggagaagcaaagtcacatattacatggcagcaggtaagagagcttgtgcagaggaactcccatttataaaaccatcaaatctagtgagacttaccaccacaacaacagcataggggaaaccagccccatgattcaattatctccacctggcctcgcctttgacaagtggggattattacaattcaaggtgagatttggatgggaacacggccaaacggtatcaagcagtatttaactggttttgtgtgtgtggagagggaacagatgaatcatttgtattattattcctatgcctaacgaaactaagtcatatgtgtacttaagacagagaaccaaaaccttgatttttctcttgtagggggtggctaaactggagttagaagcctactttgcctgacctttttagctttgataaaggcaaccttgattcatgatgcatgagcctgggtctttgaaaccaataagaaatggtttgttcattgaacgtgcaaacaaattactttccaaagactaaaatttaaactgacattaagctccaagagcatctatatttaattatacgtaaaggccagaaaacaatttgtaaccttaacatagtaaaattaaaagagaaatcccacctatgcaaataatttatttcagtgcaacactaccctttaggattgccatcgtttgcctgtattagcagtgctggctttaccaatatttccagggcggccctgaaatatgagtttagattggaaaaaaagcagtcagagtagctcccagggcaggctgatgctatagaaccacggagtgtgctggcttccccaatttccttttttttttccttttcttctgagacggagtctcactctgtcacccaggctggagtgcagtggcgcgatctccactcactgcaagctccgcctcccaggttcacaccattctcctgcctcagcctcccgagtagctgggactacaggtgcccgccaccacactcagctaattttttgtatttttagtagagacggggtttcaccgtgttagccaggatggtctcgatctcctgacctcgtgatccgcccaccttggcttcccaaagtgctgggattataggcgtgagccactgcgcctggcctgagtgtgctggcttctaacaagatttgcctcttggtaggaggaataataatgaaataccgtctatgataatatatttctctcgggatgtatcttaggggtcaaaatgtagtagaaggaacacaggcaagaaagcacagagatctgggtcctaaattggatccagagcaactcccatctccactctggccctcaggctcttcatctataaactatgaggcttggacccagtcagtgattacattggaagaaaagggagagaatgtgaaatgaagaggatgaatcaaataaaagtggcttcgttatttctgaatgctccctcaccttcctccactccttgacatacacacatgcatgcatacactagttttcccctcagttgagcatgagagtcagttcccctcagttgagcatgggagcatgagagtcaggatatctgggttctcatcccagctgtttcttgaactctctgtgtatcctaaagtaaatctcttgccctctatctctgttccccatctgtaggatgaggagagggtgttgggttttcattggtacccaccaggagtgtgtatatatgtacacacacacacagagtccatccccagctaactaaagcagggcttcccctggggcagggctctgcaggtctgtgtgtttcaatggcttcccaggtcactctgatgtgtacttctagcttagttccctggctggccagtctctgtgggccttcccagctctgccattctggaagacgaatgggcaattttaggggccttttcaggaactgtgtgtcctgctgctgtattctggtggcacagggattagctcaactgcattttcagctcaccccttccgagcagagtgatttcacaggatgggagctgtgcagagggcaggaggcacaaagaaacactctgtggagtcacaatgtggcaagccgccatgacgctgctcttaacctcccagttgttgcccacgtgggcttttcttgaactatgcaggaacctgattaaattaattgattcctggcttttcgaaaatccctctctggtgggttgcatgctgcttatcaagatgttctcgggaagctgatgccaggttaaattccttgcactgagaaggccagagccggcttgattcagacatggatatggtagaggagggagggcagcctgttgcctgcttttctttccttgtcgctttagcaaacatggagcattacaggccaaatgtgcttgctgagtggaaaccaggaggcactgagcgggtggctcagtctggaacgcacagggcgtagtgcttcttagcacagcttctgagcacagaggagactgcaacaaatgatagctgctgtgttattgtagtggcagcgcagtgtaagggaagagaagctccctgaagaagacttggatgtaaccccagctcttctgctcttcttgacttgcagatccaaaattctcagcttccttaagtttcttggtctctaaaatgaggaggctggactcaatcaattattttcaaacttggactctcagggttctgaggaggcaccctgagggctgcctcaggggtatggaaggtggaagaggaggctgagcaggcagaacccagaccctctaactgaccacctagagcctcaagaacaaactgccattcacatcatagtctatgtcaccagttctcaaacttttccatctcaggactcctttatactcttaaaaatgactgaggacctcaaagagctttggttcatgtgggatttatctattgatattgactgcattagaatttaaaactgagaaattttcaaaaatatgtattaatccatttaaaagaacaatagtacctattgcatattaacatatttttattaaaaataacctatttccaaagtaaaaaaaaataactgagtggcattgttttatattttgcaaatgtctttgatatctggctccatagatgatacatggattctcatatcagcttctacatttgatctgttgtgatatgttgtttcggttgaagtatatgaagaaaatccagcctcacacagacatatatttggaaaagagaggcccttacggactccctgaatgattctggggaccaccagtgtctttataccacactttgagaactgcttctctacctgaattgcactccctggagatgtacagtgcccatcctgctgggcaatgaatggcagctcttctctcactccctcccccttcactgtatcccctctttatttaaagcagctcagtttttctattttatataatggagatcctggaagattttatttgaaaaaaggagtctgcttctaaaagtgtttgaaattcacccaccttaatcttaggttactgaagatataaggatttggaagctgattgagatcctatcactcggatttttctcccctaaggatgcaaactcttgggctttgaggagggtcctttggcattgtgcctcagctcttcctggacagtgactggcatgtcatcttgacagtgacagtcttagcacatgaaaatgccactgaatgacttgaaagatttaatgccacttcacaatgggactgacctgcccagggagtgatacaggctgaaggtggaggggattcaatatttgttgagctgtctgatcactgaagcagagagatgggccataagggcaagtttcagtgatatacttctatgtcgtcatctttagagctagacattcatcatcattatttatttcctagatttatgtcgaactttcattccaagggacaggagccagtgttgaataccatgggatctaagtgccttcacaacccattgaagcttcctccaatttcttgtttaataaagaaggccgtgctcttctttcccttattgccagagtcattattgatttcatgttattccttttataaaatcacctcctgggttttcctaggcttggctcttatagccgagaatgttctctcctcagccttctgctgggcctgatgctgtgaatcccatctatgtgggtcaggggacaattccacagccatcttgccaacatgcccgcgttaggctgtgagcatgcgcagaagtactctcagagctgtggaggaggggaggctcccacacccgctgccttgtccttatttgttttgtttctcccaccagcctaggcattaattaagaggcccagactcaaaagcccaccgttagggtcaatcatttgggctaattgagtgtttccaatttagtggaactcttctctgaaagtaagaaataaaactgaatccctgggagaaaccggaacccttgtccattgctggtgggaatgtaaaatgttgcagctgctatggaaaacactttggcagtttctcagaaagttagagtattatatgatccggcaattctactcttaggtatatatctaagagaaatgaaaacacatgttcacatagaaacttgtacattaacattcatagcagcattaatcatgatagtgaaaaaatgaaaacaaccccaatgcccatcagtggatgaatggataaacaaaacgtgctgtgttcatacaatggaatattgtttagctgtaaaaaagactgacatgatgattggtacatgctacaacatgcatgaacctcagaaacttgatgccctaagtgaaagaagccagacaaaaaagaccacatactgtatgattccatttatatgaataatccacaatagacaaatccatagagacagaaaacagatgattgccaggagctgaggggagggtggaagggagagtgactactttacttaatgggtacaaggttttcttctagggtgatgaactagatagaggtgacagctgcacaacatgtactaaattccactgaattacacactttaaaatggttcattttgtgttacatgaatttctcctcaataaaaaattcaaaacaaatgaacaacaaaacaaaacaaaacacctgaatccgtggctgctaccctctttcgagctagtttctcttatgaatgtgtgtggaataaggaacccaagcctgggccgtgaactcttccagagtgggaaatgggcttccaataactcgtagacactcaatagttatatactattgagtatataactattatcatgtatggagatatcatatatggtttcccatattgctgtcttcactgtaggctcatggaaagcagggaccatgtcttattcacccttgaattccaagcgcctaagcaccattcccagcacataggagacaatagatgtttgctgaatgaatgaatgaatatgtttgtgactcctctttattcatctctatgcccccccccccaataatgctagtaatagttctaccacagctggtgctcagaacagatctatggatttgtcaagtgagtggggatgagattgttttagttttagtttttttttaaggttatttatttcaaatgaaccttaaagtaaacttaagttccataaagagtcatattggggttttgattagcgtttcattactattcactaaaaacacttttttcaaaaatgagatataaaaattggacaggatgtagaaaaataggagatttggcctatggagattcaaaaagagtaagagagagatctcagctttaataaggggatgagactgattagatgcattttactttaaaaaaaaattgtggatatctataaaatggaacattatccaggccatgaaatggaatgaagtactgataaatgctacaatatggatgaaccttgaaaacattatgtgagtgaaaaaaaagccagatacaaaaggtcactgttatatgattacatttatttgaaatgtccagaataggaaaatccactgagatggaaagtagatgactggtagtaggggctggaaggaatagccagataggccagggacagctaaagggtacagggtttctttggaggtgactgaagatgttcagaaatggactggtggtgatggttgcacatgtctgtgaatatactaaaacccattgtatactttaattggatgaattgcatggtatgtgagttataccttcataaagctgttagaaatttagataaatgtcagaaaagtaaagaatacaatttgaatcaaaaacaagtgtgactgtgttttgggagagatcttcatctaaaatataaaataactgcctggctagattcaaagggtttctctaggaaaagattcctttactttttattttttattattttttcatttttaattttaattttttgtgggtacatagtaggtgtatatatttctggggtacttgagatgttttggcataggcatgcaatgcataataatcacatcatggaaaatggggtatccatcccctcaagtatttatcctttgtgttacaaacagcctgattacacacctagttattttaaagggtacaattaaattattattgactatagtcaccgtgttgttgagatatcaaatactaggtcttattcattctttctatttttgtattcattaaccatccccaccttccccctacccccctccactacccttcccatcctctggtaactatccctccactttctatctttatgagttcaattgttttgatttttagatcccacaaataagtgagaacatgtgatgtttgttcttctatgcctggcttatttcccttagcataatggcccagttccacccatttgttgcaatgacacggtctcattcttttttatggctgaatagtactccattgtatataagtaccacattttctttatccatccatctgttgatggacaccttaggttgcttccagattttagctattgtgaacagtgctgcaacaaacatgggagtgcagatatcttttccatatactgatttcctttctcttgcatatatactcagcagtggaattgctggatcatatggtagctctatttttagtttttgaggaacctccaaactgttctccatggcagtcatactaatttacattcccatcggcagtgtatgagggttctcttttctccacattcttgccagcatttgttattgcctgtcttttagatataagccattttaactggggtgagatgagatcttattgtagtttttatttctctgataatcagtgatgttgagcaccttttcatatacctgtttgccatttgcatgtcttcttttgagaaatgtctgtttaaatcttttgcccattgcttaatcagattattagatttttctgtaaacttgtttgagctccttatgtattatgtttattaatcacttgtaatgtcagtagtttaaaaatattttcccttcactttattatattattatattatattatttctctcttcactttatttattatatcctttgctctgcagaagctttttaacttgatgtgagcccatttgtccattttgctttggttgcctgtgcgtgtagggtattgctcaagaaatctttgcccaaacaaatgtcctggaaactttccctaatgttttcttgtagtagttttagagtttgatgtcttagatttaagtctttaatctattttgatttgattttcatatggcaagaaataggggtctagtttcattcttttgcatatggatattcaggttttccagcaccacttattgaaaggactgtcttttccccagtgtatgttcttggcaattttatcaaaaatcagttcaatgtccatgtatggatttgtgttggggtcctctattctgttccattgacctgtctgtttttatgccagtgccatgctgttttggttgctatagctctgtagtataacttgaaatcaagtagtgtgattcctccagttttgttctttttgcttaggatagttttggctattctgggtcttttgtggttccgtagaaattttaggatgatttttttgctatttctgtgaaggatatcactgttattttgatagggattgcatcaaatctgtagattgctttggtagtatggacgttttaacaatactgattcttccaatccagggacatggaatatctttccattttttggtgtcctcttcaatttccttcatcagtgtttcatagtttttttatagagatctttttctttgactaagttgattcctagatatttgattatatttgtggctattgtaaatgggattactttttaaatttcttttttagattgttcgctgttggcatatagaaatgctactgatttttgtatgttgattttgtaattgcaattttactgaatttgtttaccagttctaatagttttttggtggagtctttaggttttaccaatataagatcatatcatctgcaaacaaggccaatttgatttcttctttttcaatttggatgccatcatttgtttctttcttttcttttcttttcttttcttttcttttctttttgaaatggagtcttgctttgtcaccaggctggagtgcagtggcacgatctcagccgcagccacgcgtgatcccaggttcacgccattctcctgcctcagcctcccaagtagctggggctacaggcgcccgccaccacacctggctaattttttttttgtatttttagtagagatggggtttcactgtgttaaccaggatggtctcaatctcctgaccttgtgatccgcctgcctcggcctcccaaagtgctgggattacaggcatgagccactgtgcttggccaaaactacaagtttcattctcttgtctgattatgctagctaggactttcagtactatattggttaacagtggtgacagcaggcatccttgtcatgttccagatcttaggggaaagactttcaatttttcctcatttagtatgatactagctgtggctctgtcatacatagcttttattatgttgagctatgttccttgtatacccagttttttgagggtttttatcatggagagattgaattttatgagatgtgttttcagcgttaattgaaatgatcatatagtttttgtccttcattctgctgatacgatgtatcacattggttgatttgtgtatgttgaaccattctagcatccacaggatatttctcacttggtcatgatgaatgatctttttaatatattgttgaattcagtttgctagtgttttgttgaggatttctgcatcaatattcattagcgatattggcctgtagttttctttttttgatgtgtctttggttttggtatcagggtaatactggcctggtagaatgagtttggaagtattccctcttcctctatttcccagaatagtttgagtaggattggtattagctcttctttaaatgtttggtagaattcagcagtgaggccatgaggtccagggcttttctttactaggagtcttttattacagctttgatctcatgacttgctattggtctgttcaggtttaggatttcctcatggttcagtcttggtaggttgtatgtgtctaggaatttgtccatttcttctggattttccaattttttggcatatacttgctcatactggccactaatgatcctttgaatttttccactatcagttggaatgtctcctttttcatttctgattttttatttatttggatcttttctcttttcccttagtaagaaaaaccaactttttggtttttttgtttgctttttgtttttttttttttgtttttttatttttaacataattttattttaatacacctatatgtttgaatatttgaaatctcaatcaccttcacagcacaatgattctacaaagcattctttcctttagcctcactgtatattttatcaaatgacatgactgttcctaattcataattgggacctaaacctaatggaaaatactatttcatgtattcaaaaatatttgtggtctttttctactatgtatatctggcattgttctcaggactggactctattagttttattatgaaaatgttaacatttctccatagagttgttttacaaaaacacctgtttttcaaaaacattctggggaacaacctgaaaacttttaaataacatttagagcatggatttattttaaaaattacctgatcccttttttaatgcatattgtgactttctttaatcatgaaaagttttcaacattattttggcatacctgaaagcttttaactgtccttaaaaaccccaactttgcaatagtaaattatttcatgcatcacaaaatagtcttataaaccaactttttgtttcactgatcttttgtattgttttcttcatttacattgcatttatttctgctctgatcttcgttatttcttttcttctactgttttgggtttggtttgctcttgtttctctggttcttttttttttttttttttttttgagacggagtctcgctgtgtctcccaggttggagtgcagtggcgcgatctccactcattgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgtttctctggttctttaagatgcattgttaggttgcttatttgaagtttttcctcttttttgcaagaagggtaataagccatatttattttaaaacataaatttaaaagtacctacatcaattattattaaattgaaccagcaatatataaaataaataatgcattgagtccaatttcagttgggttcacactagaaaacctaattagtataattcaaccacttcagcaaaaggaaagaaataaatatttcaatggatgggggaaatgaatttttattattccaaaataattcatgattttgaagaactcttagcaaataaaaattaaaatgaactttcttaacctgataagcagaatctaatgaaagcttacaacagtcaccccaaatggcaagaagttagatcattccctttgaagacaggtttttcctcttttttgatgtaggcacttatagctataaacttatctcttagtactgcttttactgtatcccataggctttgggatgttgtgcttctactatcatttgtttcaagacgtttttcaattccttcttaatttcttcattatccactcttcattcatgagcatattgtttagtttttatatatttttgtagttccccaaattcttctcattttttatttctagctttattccattgcagacagaaaagatgcttgatactatttcaggcttttaaaatgttttatggctggttttctgacctaacatatggtctatccttgagaatgatccatgtgctgaggaaaataaagtgtattctgcagccattggatgaaatgttctgtaagtatctattagatccatttagtctatagtgcagattaagtctggtgtctctttcttggttttctgtctggaagatagatccaatgctgaaagtgggtgttggaatctctgattattatcgtattgggacctatctctctctttcactctaatggtatttgctttatatatctaggtgctccagtgttgggtgcatatatatttaaaattattatatcctctttctgaattgacccctttatcattatatagtgaccttctttttctcttcttattgtttttgtcttgaaatctattttgtctgatacaagtatagctagtcctactcttttttttttttggtttccattggcatggaatatctttttccatccctttattttcagtctatttgtgtctttataagtgcaatgtgtttcttgtaggcaacaaatcattgggtcattttttttttaaataaactcagccactctatgtcttttgattgaagagtttagtccatttatattcaatgttattattgatgagtaaggacttactccttccattttgttatttattttctggttgttttggaaagatccctttaaattgggctttcctttcagcagcaattcatgtgagtttccagatcattacctacttgatgaggggctaggggcagagtagcttaaaggcagagtatgaagggcaactgccaactgttgggcagttggagattgatcagaatgtatgtcagtgggaaactaggattcgatttacacaaacccagctgcctgatgatttctgcactgcctgtaggatatatggggtgtccacattttcatgaggaggaatgagcaagcagtctaatgatgtgccacttatacaattagcaattcagcaagttcaacttcaaataagcagttctgaattcttcttcctactccaggggccgtccccactacttcagtgtctatcagcttttctgaaagaagagacaccatggctacagggaaaccatggtggggctgtgtgtggaggcaagtactgcctagtgttggatgcagactgcagctgtatcctttgcccttaggcaggaagaaactcccacagcatcatcccagctagagagtagcttggatgtcacagtcagacaggcagccccagcaaccttaggtggtacagcagtttctgtggggagattataaagccctctgtggttacgaaggagttgacaagctattctgatggctttctgcctgttttccttggatcctgaagacaagagcagtccaaagttattcctgggaagtgagaatcaggcatcagccaaggctttgtcagatctgggtttgcagatgagggctcattcaatgttccttacaattgcaaaaaaatggacatgtgaaaactcacttgtaacttgaaggggcatcatttctaattgggagatagccacagagaaacgaaggggccaaaacattgctagtgtgaaaagcacataggctttggagtcagatcaacctgcaagtcccattctttatgtcttagatgcatgaccttgtccaaggccttcacctctgagccttgatttcctcacgtgtaaaaggagataggaaagagcatcctacaggggctattcttctaattaaacaatgtccagtcctcatgcctggatctccgccactggctctcaactcacctttttcctcctatctctctagcatagattgctgcgttcattttattgtagagggaccttggtacttttaagattcctgaactggaattcacaaggtctgagagatggttttgaccctgttatgactgtgtgaccttggttgagtccctttctctctcaggacctataaaatgcagagtttgggcttgatggtctttaagggtaccttccaactttgataggtttctaaacgatgtcaaggtcaaattctgaatggcctggttcactgtgctagaggatggccctgatcatttggcaagcacaactctttcccaaggcgacattgcccttcttaccattgtagttacatgggccctgctggaatgagtcacatactctagcttcttccagtttcttcccccccttggttaacttggcttggacattttggattctgtctatatgtaatttgattgcattttcctatagataagaaatataggtataatagcaaggagcacctcaccccccactgcttcaaagagagagagagagagagagagacctgatctgtctgccaacttctctttccctgtgggtccctggcctatccactgctacctgatttatgtcctaggggagcagcatagctatggtgaagatttataccaggttttcatcttcaaatgagctactacctctgttccttgtgtattcaagtgcttggcactcatagccaagcacttgaattctggaattcaaaatgaaaaatagtcccatgagaggcctaaagagaggcaaacaggaagcacttcagagtgtgctgcagccttgtacagtaagtaggatgcagtccccagctctcagtggaggtgtgatatgcccagagagattatatacagtgatccctctccacattagtgccttgtgtaggcatggtacacaatgcattagaattagacaaggcgtaggatttggagacaggaaatattgaatattcccatctcagcgccttcacttattaactgtatgaccttgagcaaatttctctttgagcctctctgacttccctgtaaagtgagaagaatgccgcctacctcacagggttgctgtgaaggcaaaatgaaatacagttagtacagctgagtggctcatgagcttggtcccagcaccctacaactctggatttgaatccagactctaccacttatcatgcaagtccgtctgagcctcagttttctcatttaggcaatgagtatagacttttgttcaggatgaaatgagataattcctatagtgtgtggcatctggcatatagtaagcactcattaaatgttagctaatggtatgattgttattgtttgtcatttaggtaaaatttccaataattctagaaaagatattttgtgtactgtgccagatggtttggcaaacttggtccatattttatatgcttggggaaaaagcactgggtatttttttggtcctggttttgaaactacaggtaagacatgaaactgagactcttccaataaaaggatacctgtttcctcatggaaagcaagtttgcgctcacaatggtgctacaccttcatgtagacagttgtctgcagcccacaaaactgttgaagtggtcatgatatttcaaaagtagcacctccatcgggagcagcagtgttaatccagttatgaatattacacctgccaaacagaaagaatcctttagccacgggtctcaagcacagccctggatgtgtggatttgccacagtgacaaagactactagcaaggtgcatggggacaagaacagcaatggcttaaagcctttttcatggatttttgacaatgaagttaattatccagatgtttcatgtacttgaccccggacactcagatctttggaaacatctggacaatgtgggggtagttttcatatctttcatcaaaaccgttggttgtattaaattcagcaggtttcattaatcacctggtttgtgccctgttaggtattattgatcacaaggaagtcacagttttattgagaaaaattagactaacaggtttgaagtgaccaatgaaaagtaggagagctgggatatgaacatagttccatcaactcctatgcttgtgctcacttcactctagcacatggcctcttttcatttggggctggctgaaaggaagtttcagaccaaatccagtggttcccaccatgccttgacttcagcagcgacctaagctcctttgctgaaagcaggtgacatatatccaaatggaccatttcatgtgtctccattgtctgatccttttagtgacttggtggaatattccctgagaattatcttgatccttattttagcactagccaaatcattacttgttagggagtttttcgttctctgtgttttaaatgtgtaaaaatgtgaatgaagcagttatatcttgtgttggcagcttgccatccttggtctgtgtcagcataaaatattttggattccatagagtagcagccccttgcgaagctgtgtaaaagatacaatgaaaaccttccttctgatttgaaacagtgctgaaatagcatcatttgtggaccttccagacccaacgatctgaaacatggaaatgaaatgggataaaataactcccagtacacatatatatacttaccttgtaaatgaaacttttcggcctttattaacagaaagcaggccctgttatacccagaaaatttctaagagattccttattcgttctttctttcctttaagtcaaaaatactgtatgtatatgatcaaactgaaatgcatcactggaacctaccatacaaatacaggtgcttgcgtttggagaattccaaaacacatatgaaaatcattgtcaagtttcagttgaagaagtcagcctgtacctatgcacattttttttataactcaactagctcccccacatcatgagtggaaaggcttctcagaagggaaaacaagccaggttttattttatggccttcaattttgttttatttcgttttactttgtttgttcaatggcaaaacatccttttcactgctttctgaaagactaaattgtcaaataggtgctgtggtaatgttttcagaaacaatgtatcctgccatagccaaggacaagttatagacaaacccgttttccacggaaacaagaatccttcagtgtctagattgttaattagatcagcactagagggcactcttatgatgccaaaatgggaaatttttactaaaatctgctgggcaggggtgtgagagaggagatgaggagggggcagtttctgtaaggactgcagaccacagacaaacagcttagacaagacatgtgcaactgagaattgactggatcgccaacagataaaacactatttgaaaagggctgtttggcagtgttccctatcagatccacttggtttccaaaatgcagtcggtgctttggcaatacacgatccaggtataaggcattatttctcaaaatgaaagagatataagaagctctgattgttaccatgtgatgtagtaaaagcacatttaggcagaaaacaaaatgtggagagaagcataggagaatgtgtttacaacttaacagctactgagaaagaagaatttcaaatccttggggtcttttatggttgttttccccatcttttgcagcccttgctctgtgaattgttctgaagggttgtgtgattgagtctgggagagcaggtgcttgcttgtctgctgcccctaggcaggctctgatggacacagggtggatgatgtgctgtcaagtaaagggacaaatggacttggttttgtctctggcattgatgtgctctgtgatctgtggcaagtccctgccctctcaaagtctcagggtcagggaagagttgggtgacactagaggtctctaaaagatcactagaagacatatccccgagtttgtgatttatgattgcggaaataacttttgttttgttttggttttagagacagtgttactctgttgcccaagctggagtgcagtgacatgatcatggctcactgcagccttgaactcctgggctcaagccgctcctcctgcctcagcctccagagtagctgggaccacaggcacatgacaacatgcccagctatttttcgtattttttgtagagatggggtgtcactatgttatccaggttggtcttgaactcctgggctcaagagttcctcccaccttggcttcccaaagtgttgggaatacagacatgagccactgtgttctgccagaacttcccatatcagtcatttatagcagccacttgagttctgaatcgaacaagatatggtaggcaccctggggtagaaggtgactctatgctgtcagtaggatggtaccgaaatgatttgccagcacagaggggcttatttgcctgtattagtcattgctttaggtttatggctcagtccaaatataacctcagagagtgaccacactaagccgtcagtaggtcccctcaaattcgctcattatgtccaagttaagcctgatccctcacttgtgtgctaggcaccagccagaatctcaggcatgcccatgtgtccttccctgaggagccagtgtggggcaggggctctgggcacttgatgggaagagtggcacactgaagacagacttatctactctgactttggccccagtgtttgctagagaaatgcatgagtgtttttgtttaagtctctgcttgtaagaacccaggctatccttcataggaatgttcctgattgagtcaaattcattataaagtcttagaatgttattggccgggcacggtggcttatgcctgtaatcccaacactttgggaggctgaggcaggtggataacttgaggtcaggagtttgagaccagaccagcctggccaatatggcaaaaccttatctctactaaaaatacaaaaaattagccgggtgtggtggcaggcacctgtagtcccagctactcaggaggctgaggcaggagaatcgcttgatcctgggaggcagaggttgcagtgagctgagatcatgccgctgcacagcctgggcaacagagggagactccctctaaaaaaaaaatgttatcatgaacagggacctttgggaaatcagctagtccaacaccatcactgtagagatagggaaacggggagccatcttcatttgggaatggggttgcctagggtttcacagccagttaatggcagagctggcattggggtatcagttttttatttctattccaggcctctttctgttaccttgtgctatatttttctctctcctgcaatgtccattctagggaataagtgaccaatggctctgaacctaagggtttttgacatagctagaatagctccgtgtttatggattgtgtcatttaaggtagtacaagtggaaagatatgaggacacatccctatcaaaaatatgtcctgtttaaatgtcataggactggagatcaaaccaatataggatcattcctctggatctagaaggctctgaagtcttgagatgctcttgcccaaaagcaaggatcaggttggaatccttgtcagctggcagggaacgaaaggatgggagggtaggtctggaaaccaggtttagtatctcgggggagggcagacactgtgaaaagagcagtcaagacaacctcagggaacttcacagttgtgccaaaggctattccttgggaggttaaaacaaatactcaaagaatacatatttgaaagaatattctgggttccagtattctcatgccaaacataaggagctccctctcatgaggtatgcatgatttccagtggacttggcatggaacaaggaggaattaagagcggtcaaacagtagaacacagatgcaggggacaaccctctcccatatcagtgatgtggttactttccgcatggcctttaactgcacgtgtctttgagctctgcttttgaaaagctggttcctttcccagggcaacaagatggctcaggtacagggggctgcgagctgtgtggcaggcctgccgcagactcactatgcctctagacaattctctgattggtcttcctccctaggtgacagtaataatgcctaaaacgtattgtatgatgactgtggacctgacattctgctacatgatttacaggcatgatcacatctaatcctcccaagtactttaggaactacccttctagactgaaacacatgggcctacctacccatgtcgtttgctgttggtttctcctctgatagggctgtcttttcttctgattggtcagttccgataccatatctgttgttaaagatggtgatcatcaccagtgtaggcattatacttgtccccactttgttttttgctgttttttttgttttgttttgctttgttgagacagagtctcaccctgtcacctaggctgcagtgcagtggcataatctcggcttactgcaacctcctcctcccgggttcaagtgattctcctgcctcagcctcctttgtagctgggaatacaggcgcctgccaccacgccaggctaatttttgtatttttagtagagacgaggtttctccatgttggccaggctgatctcgaactcctgacctcaggtgatccatctgctccgcctcccaaagtgctgggattacaggcgtgagctaccatgccccaccttgtccccattttctaggtgaggaaatcagggctgagagattaagttgccttttcagtgtcatgcagttggtaagtgaaagagctttaggaccagattccagtctgtgtgactaatggacttatttcatggtcccacaccacctctcaggactgtgcataagcaaaaggctgaggtcaagcattttaacactttgcaagtaaaaaagaccagcagcttgttttgcatagggccttaagaaacacccaggccctttgcctggctcctccattcacctccaccagtttgagcaacagtccttagcctgggactttgggggcaccacacccctttccatttagggaaataaaatttagcatgtattaacataaggcattttttgctaggatatactactgtatttggccttcagagatcaaatgaggaaggtggcttgagatacaaaaggaagtggtgggtttctgagcagcaatagagtaggtgaagaccagaatgatggtggaagggcattctacatgggagaacgtggaaattctaaaacacgtcagctcttggtgtggcagttaaagggagggtgagcacaccagttcagtgtcagaaagcagagaggttgaatggaccatttgcttggcagctctggaacagtggtaggcagttatttatcatagagtgtactatctgctgcagatttgcaatctgacccaaacagtgttggtgtgggtttcttaacaacttccttctctctagctgttatatggaagtgtgtggctgtggaggtctctgctgttgaacagccatcaccaatatcccaggctcctggcagatgaagaacctgcatgaacagaaagagaaatgtggagggtggtggcggtgcaagagggtcaattgttcatcaattcgatttttcttgtttttctcaattaagtttccttctataatttttccatcataaagaatctgccactctatgtttcaaattaacaaagctgtttctctggacagaatgatgttcagctgcatttaaatttggccattatgattttggacatactctcatttactcataaactcttcgaaggctgtgctctgggctctgtgaactactaatagcatgttgtactgagaaaatgactagggattggtatacttctaagtaacatcaagggaaagctattagagaatgaaagaatattggaactgggggaattttagaaaccatcttgtcaagctcgttcatgtcatacagcccactgggagagtggagaagagaatttgcccaagatcaaatgagtcattggtaaaacctggattaaaaaccagggatcctgattctcagtcaagggctcttggatttttacctcatcctgggttttccaagtcttaatttggatccttcatacaaaagtgaatcgtttcactttcatttctcaagccctaagcacccaccctgagaatgtaaatgccaagcataagtgtcatggtctgaggttcctgattaggatgaatccacatctggagcttttggattcccaagtctcccgctattcccattactccagtgctatatatgtgttctcttcattttcatcttttgccttccctgcttattggatgcttagtcagttgcctaagtaccatttgagtgacatttagtcacatcttctggaacctggctcagaggaaggttattcctatggctttttctccagccagtgtctgggtcatgggcatggtaaccacagctccttttgtccttccagtgctgctgctttcccaggatgtggcttgctgagggctgatgaatcccatcttagagtgtcagccaggccagctgttaaagaacatgacagcaacaaatgagaaagactctgttgggatgtgggactacagtattatgaaactgccacttagaggcttcctgtttttacagtatttcaaggtgcaagcaagtggcattctctgggcagcaaatggcccagctgaaaagaaacctgatttacagcctgttgggagggctttccacaaggagaaattatgaatttgtaacgtcccttccaatccaaaagagaattctttctaatgcaaatgtttaatctgatgccatcgagtatgttctccatacataaacaaaggcataaataaaacagggagaaactctttcctagaattgataatatacagtatatttctgtagaactcttttccaagcagatggcctaaaaatattccacaagattgtaaactctgtagagtcagggatttttgtctgttttattcactactcagtacctctaacctcagtacctctaacaatggctagcacataatagataataaatattttttaataaaacatcatgattaaagggcctttttaaaggatttcattaaacaaccttcccaaagagagtgtgtgtgtgtatgcataaaatgggttcttaaaattaattcattctcttctaattagtatgtatcttttgttttaccttttccctatgaactttggctcacttctgatgactggccacccttttgattgatgcacctgtaacgtcttcatggatcgtcactcaatactccacctcttcccacctgggctcccaggtaaggcaatgagcttccaaaagtcttctcagtgcaatcaccaggcaaattttataaggcagtcaagaagtttacctagaaataaaaaaactcaagagacaataatagtgattaaagttaaatttgatcccgttcccatataaatcaattatttatacacttaacatcatttgagaatttctgttagtacagtgaaataaaaattatggctttggaaactgctgcatacttaactttggaattttctgatcctaggaatcaatatatggctttatgttttccttctaaaaatattttcttgtgtgtgtgtgtgtgtgtgtgtgtgtgttttgtcttttcacccaaagttgtgttgtttttgttcacaaggccaaattttgtggaagggatcatagcctctcttcactgtgtagggactctaaatcatggggtaggtcagtacattgtagattacttatttcttgcggctggagtagaagacgagcacattgggctctggatggtaagtccactaataggagtgtcttgtctaacagatttgatgttaggcctcaccaagtatatcgcttttgtttctcatgacatttgcttccccagcagtcttaacagctcagaaacagggaaagggggcttaaccgcaccagagactgataataaaagagccatgtattgcttctcaaatgatgattcaaaggctctgctgctagccatgctattaaaaaaggctctcttaactcacttctaaggcctgcaaagcgtatttgctgtaaagaaacatttctcccaagaaaatgcacaggctatatagcccacttcgggcataaaagaagtgttgctacattgtaaaattccttgttctggcataataaaaaacaaaaggctaactgagcccatttgaaccctcaaattagcaactgacctgtgtataacttcacagtctccgcctgctaataatatcagtaattcacacagtggaatgagtgttttgtgacccttaagacatacattataaaaacagctgagcatgttttttgaatggggagacattgcttactttgatggatgtcttgtgtttgggtggaagggactagagagatgatttatatatcaccttatgtgtgctttgaattttcatctttttaaagagcatcagtaaagtttaattgttctttattttccttttgttatttgtgtttcgtatattcctgataatatgaaaaatccctgccaattcctcctaggacctttcaatcagtcatttccatttcagtgatgccacagggttgggtttggtttgggttttgttttattggcttttgtttttttacctagattcccattgctctctgtgaaggggaatggaattagcatgagtgagtggtagatccatcattcccagaccacagcactccagggatctggctctcagtgcagccttgccccttttagccttctgattgggaatctccccattacttgagaggagccagtggggaacaaagtggagaagccatctatgagctgtttccctaaggtttgggaagctggagaaatatgctcttaaagcacaatggaaaacttttattattttatctcctctcctaccaagctcttgctagcgactggttttactgttcctttaacaggtggaggatttttcagattctagatgcagcaaggtaagtaacaatgtatttttagtttgactgaacccaagtaagctagaaaaaagagactctgcagttgcctgtccgtttaatttcagtacaacaaatagttaagtttttggcttggacaaattctttccagggctttttttttttttttttttttttttttttagtttaaaacagctgaaactacccaggcttggagtctcagttctgaaggctgacttagttcagaagggggatgaatgttcagggcgaccaccccagacaggtgtgcagtaggtcattagctctttttcctctttttgctgaaataggatgacacagtagagtgtgttgttgagaagaccccaaccgttggcaaagtgttctttacagtgcttcaggcacgtctgcctgtccctaggctggattgtgatttagagaacaagtaggtcagcatttccttgaagggaaatcaattatttgaaaatatcagggcttttaacgtatgtaaatacgtagacttgcatatttacaagtaatcccataggccagaggcctttttgacatgaagcctgcaggagagcaaatctaatcaaatacaagaaagttcctctctgtggggaagacggacgctgagaatgctcccagatgatgcccctgcaggcaacaactgttgctaagagctgtaccatcatattgccaccagaaccggagagtctagcaagaaccataagtcattttggaaatgtgtgctctagtcgcttggcacattgttttctaaggtcatgatgctcaccagtactgtctttggctttttgtaggcttattggctccagaaatatttactagtgcctctgttttttcttaatacccacctacaatccaccctgtgctccctggccaaataggttagcaagagcaaagactgtagctctggcatttctccacaaggacagactcccattaaaatagactacttgagccattttggggatgcccagtttagctttctgtagctgggcttccatactcccattagagcctcaatggatttacttgacagctgagaatagtaaatttagtgtttaattttgtagtcagattataatttattgagctaaatggcacagacacacatagacacctaatcacacagtattagtatgggagaacatttaaatatcatagattgggtgtgtcatggaggcaaagtaccaagttctgttactaatgaggtgacttttgtcaagcactagctccactctgagccttaatttcctcgcctgtaaaataaaatggagcggatgaccattaagacaatggtcaataacataggtaccactatccctataatagcttttatggggaagtcttgagaattttgttttctttttgctttaaaattgctagatgataggaccatctctttaaaacagttttgctgtataacaaagcaaatcctgacacactctttatttttactatggtgttgattagttggaccagattattgccagagcaactaatacctggtcttaatgagagaaaacaagaggagtacagatggtgagatgggaaagaaacggttttggtaaatatcaatggggccctttttgaattttggtgagctgaatgatgtatgaaaactatttgcaaggctagcatatttttcaaccactagtaaagcaataaaacaaataacatttttggtaatccccattgtatatgcagtttcataaatatacaagattatgattatcgctgcctcataattaacaatttgcataagtacttgctattttttagttgtctgaatagatttttgtaatccagagaaagaagggaacaatcagtggaagccatcccaaatgcctagtattattgctacacacttgcacaattaacagcgatactaattgcttcagaccagaacctcatttgtttttctaaggacagcaaaaacattaatagccagagtgcctgtcaatctctctctctttttcctatagccaactgtatcatagggtctgcagttgactgtaagcaaattattttgttggattttcagtgtatcatcttgtaatggagtttccaagtttcagttagcaatcaatgccttgaacagccagacttatttttataatattttaacaatagacctctataaagttaatgaataaaaggatgctgacatgccaatcagttctgctgctgcatttacattctactacatatttcatatctttaaaattattggcattagacctgcatataagaatcatagaaagtccaggctggaggggagctttaagatcatcccgtcacactccctcctttttcagatgagtatgattgtcagtaatttgaatcttgataacaaccaccaaatcaatgatgccacacttttttttttttgtacctttcaaacgttgggaactattatagtaagtttgaatgataactggttgtttgggaatcatatagtttcaacttattttcaaaacaactgaatcagaattttaaaaatatgccctcataaggcttacctaaacatagccataatgttgatggtatatgtgtgaaaggagatgttctatgcaaatcacctggcaatgagacactcaaccaatatcagctctctttccttcatgcatagattacctaattaacattactatagtggaaacattacatcagtgactgacagtctaggcgtttagagtcaaactgacctcgggtccaatcctggcgctgctactttccagctgtgtgacgttgggtaatttagttcatctctgttggcttcaggtagttttcttatatgtgaaatgtagccagtatataggcttgttttgaggattaaaatgagatcgtgcatatcaagtgcttagcactgttcctgtcacatagtaaacagtcgataatggtggttattaccatcgttttttggcatacccagcggcagcctcactcaatagtatatttaatcttacagtgatttggggtacttacacatacacctgtacacatgcatatttgggcacacaagttcataagatttgcatcagaaagactgctttcccaaaggttacctgtgaccaccatgtttcacaattcaatggcctcttccctggcctcagtcttcttgacctctttggagattctggcacttttgcacatattctcttgcttgaaagggttcataatctatcttgatgtcttctctacattccttaggtttcctttgttgggatctcttttccacacgtacacacacacacacacacacacacacacgcgtgcccacatcttctccctcccccactgcccctttaaatagagcaattcccaaggtcctgtcattgatctgcttctcttctgttgctatattttctccctgggtaacttcacctcctcacatagcttcacctttaacctctacactaatgattcccaaattgacctctccaacccttaattcattccggagccccaggctaactccaatttccaattgcctgctgagaatctccagggcaggatgtcctaggagactgaaagcgtagtctggcttttgtcatccttctcaggaatgcagatggaggaatctagcttcagaagtattaagggttgaaaacaaggcacaagtatggagcattagtctgagcagaagtaacagtggtctaagttagcaaagtgcttcaaactgagctttccaggggaggcataacagataaactgtgaatttctgttattatgcactggagatgtcaattggcagttggaactttaaaaggtttatattttctagggataagggaacagcttcctaagatgaaaattgagttcagtttttaggtgctggaagattggcatgtttggaagaagtgttaattaaaatcatctttcttttcttttctttttttttgagacgagtttttttcgctcttgttacccagactggagttcaatggcgcgatctcagttcactgcaacctccgcctcctgggttcaagcaattctcctgcctcagcctcccaagtagctgggatttcaggcatgtgccaccacacctggctaattttgtatttttagtagagacagagtttcactatgttggtcaggctggtcttggactcctgacctcaggtgatccacccaccttggcctcccaaagtactgggattaccggcgtgagccaccatgcctggccaaaatcgtctttctttggacacttattatcattaatcttgtttcagtgttttgtttaagaaacgcacgtgccaaggggaaagatgatgtactgaacttgaatgatgagcaggtgggaattttgtgagagcaaatgtgtgtgtagacacatacacatatgctgggtcaggtgtgcctgagattttgaatgtgtgcaaataattctatcagtgatagatttttttctttcattcattctgcagatatttacagaacatgccaagctctctgtggagcaacacagctgtgaatatagaacatatagggtctctgtccttaagtgtctaatacatttttttttgttatatgcaggtacattgacaatttaatttagtttagaaatatctgcaacatgtcacaaattgttcaatggccataatcttgctgacaatcttaatgaccaaagaggaacttaagggaaataagacagtgttaaagtgggaaaggaatgtacataaatctgaattagaaattgattacttcctttaaatttagtaaatattgaattgctttggggttttacatttcaagttggcttgccagtgttccaggccagggtaagaatgattatgtctaaccctaaaacttaattagagtaaaggaatagacaactcctggttaatgtgtgtactattgtcaggagaattagttgtaaatgagttatttctacagaaactgcaggctcagggctgatatctttagcacagaggacaatatccctttttgcagaagaatggtcccattctctaccttctcaaaatgcagtacagtcactcctgtttgagctactaccatatggcatatttgaagaccattttgtcctccaagtgggaatcatctacttgtgagttccttgacttcatggttgcatgccattctccccttcagaaatttggcatgggcctttgtctgtaagtctcaattccaagtgttcttggtcccagctgtcagtttcaaagtccccttcatggtccctctcaggtcccaaggatccctcattgcatcagtaaacctagagatctacttggatgcccagagctcctgtcagagctatgtagatggcagccaccctctgttccactatgctagcttctccttcagatctctcacggcacaaaacctctcattataatgatgtgcacattggccagtgcttctatttcctttgccttgcgtgagttagagacattctgttattctcactggaggtaagaatgattaaaaacatccttgaatttagagtctcaaatgcctttattctcatggttttcatcaatcataatataacttctctttcctttcttagatttattcattcaatatgtatctattgagcacttattatgatccaggcactgttctagacatgggggacaatacgacagacaaggtcccttctcttgtgtttcttaaagtgtgtgtgtgtgtgtgtgttggagggaaattgaaaacaaagtacacaagtaaatgaacaagattatcatagggagtggtaagtgccatgaagaaatcaaacacattggacagagaatggtcagacagttggagagtgatcagagaaggcctccctaaggaggtgaattttgctctttgcttttgttgattttgtacagacttcagttacactttgggtcctttggtttcctccatttcatgatatcctggactcggtatgcattctcattttgttgcttcttgccactgtactattaggacaacctcccttcagctagtcctgaagagtaaactaatgtagcctcctgtcaaatatgtgttccacacttttcttgtcgtagtcagtattagaattcagcatgttcacgctcttccctgttatagaatataaatggatgctaatcctttaaggatattttacttgattactcagtgcatttttgttactcaaggcaaactacctattgaaagaaaaacgcaagcattaagagttagtaagcatttggctttgcctatttctgtaaagggaaaagctattgttaaaattagtgttcaaagttaaatagatgatcctggaggttctctttagttcgaaagtagtacaattagttgttttcagagacggagccaaaatctcttttcaatatgctgtttaattttgtaaagtggatatgcaggaacattttccagtgtatcagaagtgcttagattaagcatacattttccgacaaaagctagctttacaattcttgtaaatgtcacaggaacttaaaacattgtgtcttgttttaacctctgccagctagagcagcaattcagcacagcagattcaattgtcagtttcttaaatgtgaatatctgaaagttcattgtcttttcagcttgaccacagggaatcttcaaaaaactaaaaagccaaacaccactaaaatgtttggtggtttcaaaatgctatggcataggtgttgcttgctagtgagttaggtgccaagaaaagcatgttaactcttagaaggccattcggattcttccagccatcattttgttgtcttcctcagcacctagttaaagccccaggtaggaactgaggtaggagttagaaagtttgccttccctaactcctctcacacctcccgtcctgtcccattgagctctgtgggagaagatggggaagcaggtggggtgggtttggagaaggtgcaccagaatgttgccaatatcccaagtacccttgcatctcccttctttaaaacttctgtgtcgtcacttactattccacttatcactcagatacttggctgtgttctaaatacaacaatcaactccatgactagattttgggaaagcagttttttaaaaatccagagaaaagctgagcatgattctgtggtaaaggaatcttcaggagaagaggaaccaagagagtttggaaactcctagaaatgcaactctgatttacagtcacagagattcttgacatagaaaaggagtggggtatagagaaagaagtgaggaaggcacacagcacagtgagtccttgtatgattttaattgaaaaggctgttattttctgcaggtgagaaaatagatgcacatcaaggcaatgacttatctaagtacgtgcagctaattagtggcagatgcaagagaagaacacaagtcaactgaatcctatccagtatcttgattggtaattaactaaactcgctgaatttttggcttgcttttgccgtttaattcttagcgctacgtttgttgccagcacttttaattcattatgctcaaaggactttatcaacaaaggtggacaaaatcccttagaaacaggtaaaaggaattttgttttggaggggttggggccagctgacagatagtacaggatcgcatagaggtgagagtggttggattggaaataaagcctaaaactcaagatttagcttaaaataaaatgaagaaagagaggattgcggctatagactggggatccatatttaaaggtacacatcatctctttaatgctcattcttaatgacagctgtagcccattctccatctgaagattgaaatgtcttttgtttagggttctcagtactttgagtctctttccaggcatatttgtggccttctccttgtctttctgtttttctattctgtatggtttttcatctctaatgttttccattagtttggtctcacggtcttgaccagggcactcatggcacaaccatatatatatatatatatatgatcttatgtgcacataaaatggagaacactatttaacaagttagaaactattagattatttctgttcctctttcggaactgaaagatttcctcttgacaaatggctcttctccaaaatcttaaaattgcacctcagaaaaaaatgacggtcactgtgctaccatgaagcttcctgtcccttcactttcattggcttactattcaatgagctccattgattttccagacctccattgattttctcaaccttgcctcatcagccagacactagaattacaagggagcttcatcaatatcttgtgtggtttcaaaacttttccacttttctaatttgggcaatgggtatggtacaaaccatccgtaaacggcatttggtggtgcattggtctttcttctcatggcttctacaattctaacttgatttctgctcaccacagggcacagtttgccttctcttccctgggagctcttgttcatttgtcaggagacctaaaagaaggctactatgtacagtggtggaatgtcagagtcatcctaaactggcataaataggtctttaatggcctttactgattgtttctatattgacatataaatccacatgaggctgtgtgaggagactgtgcatagtctttctcccgttttttcatatgaattgatttgacaatgtcatagatgatgcatgagacaaagtaaagtgtttcttaagctcactgctgcttgtttgcatgaaaaggaataaaagctacagggaagaaatggacattgtgtgatgctttaggcaggagccattttctgactcacaccttttagaccataatccactttctgaacctgtgcaggggaaagtggtcactgtgatattcttttgctggaaaacctcctaattaatagaggttttctgaaattcataagagatgaaatacagagtctcaaaaaacgaattagttgtaattataaatgcttgcatcttatatgagaaaatgaaatgggataagagctttttgaggaagagtctctgaaaataacacaatgttttattgttgaagagccatgtgatttaatactcagtgatcatgaaatcacatgtaaagcaatccaccaggagagtccagaaagcctcatttattcctctctatatgagcagattcagtgtctcctttacaatgctatcaaaatatgtataaataaaacaacactcttggggctgattttaaatttaacccacagtaactgtaatttaacatgagtacctgaatatttccctatttggagtcaaagtgggataactggggtaggggttggggagaggcccctagctttctgtcctacaacaatctcaagcacaggatctctgatttccccttctcatgcaggaggtattttatgtcttggcaatgggtacttttgttcactaattttcatggcctacaatcataggtcaattggctctgggtcattctggggctgagggaaaacaggtagtgtccttcaatagatttggagaaactggagggggcctcttaacttggtgattttccagtaatgtgattgaaaatgtactactacattaattaattcagtcattacagatacacttattgagcacctaccataattcagcacgattcttaatgctagagatatgacaattgaataagacaaatatagttccttctctcagggagcttatattctggtggcagatatagataatttggaggaagcaagtcaacaaaatgtgtccatattgtgatgaatgttatgaaagaattaagtggagtgctagataggggatatgtagcctttggaataacctcattgtggggcaaacttatcctttgtggatggatttgatttttggaaacatcaaaaatgatatggggccaggtcttataaatatataatggaagatcaaattgattgataaaagttttgcccccaaatgagggtatatatgtaattactgtaatatttttgagtgtcagtaaaaatatatactacactaactagtgataagcacgcccatgtttttaaaggcagtgaaagggctccagcaatgggtgttatcctttggcaagcatttaggcatctatagctaccaacagcactgtctccagttctctgcctctcctcaattctggtcaacccttgtcatcattggcaaatgtactttagctgttatattggtacataaaataaacattcagagacattccaaactatgtagtacagcagtaacatgtgaaatttgattctgtcacaattataatttagttctctcatttcattagtccaaataaagtggagtttcatttatgctattttgtatcaaataaatctgtagaatgctaatacaccacttcgatgagatacaatcaatttgagtctaggaaaggcaagaatgttataagctagaatgtcaagatgaagatgaacagacaaaggaagccatgataggagaattgaggaccccttgtgtgctccttcttgtactaacttaagtgatatctaccatgtccgtttagtgatcgttctagacatgtccccattaaaggatatctaatagagatggttttgtaaaatgagaagaagccaatgatagccatttaattacatctttagtgtgacgttagctccctgtcttgagaagcattgatattctccatgggtgtttacttgagcaactactctgccaggcactgggagtacagaggtgaattagagagagatcctgtctttatggagctcacattgaatttgggagatagaactaaccgttgtggtagaatatggttcatactaatatgtataaacgtagatacttggtacttcaaggagtctgctctaggttgagtcgttgggtcagaaactactaagggaactattctatggtttgctaaagctagtgatggggcaggtatgttcatttcttcacctcatataaatatctttggactcttggcatgattcacatgcatacactttcaatctatctgccagttttaaaggcaggtataatggtgaggtctagtttcaaaataagtagcttttataggtaatattctgtggtttcttcttgaatgtagaaccagaccgattcagaataactctcatgtgacctgttgtgaagagccggccttaatttttctttctctttttttctttttgcaacaccagctccatttctagtagcaaatctgagccaaaagcacagattcattgactgtttgcataagacactaaatagacactgaacagaggattaatgtagccctgtcttctgggagcttatagtctaaaacagacaacaaactggaaagaatatccaacacacctgatatgctcatttcccttctcatataaatccaaagaaaacagaaagtggcaagtcacattctacaggattgggaaaatcccctagagagtattttctttttgtgacttttcaagttaaaaggtattttgtatatgacatgtaatagattacagtgttatttgatgaaaatgcaagcaatgttcttcctttcttttttactatcaacaagttacattggaaggtgtggatcaaattaaaagtgaattcttgatttgccatggggaaatatgtgcagtattttaaatactctaaggtaagggtcaacttgtgggaagaagaggtatcataaaaattaatttaagaaactagccttgagatatttcctaataatcccacagggaaagcaacatctgtgtcataataaaggcgcttagtgtgacctttttgcaaaagggaatattaccgaaacatgaccaaagtttggagctgaggtactgcagtaaaataatgggagtctactaaatatttataaggatgtattcatttgtaagaaagtagtgaaacagtagaacatctgccaaaccaaggttaatttcccaaagctcatgtgtttgtgagagacacagagacaggcacaggaatagaaatgcagagataaagagacacagagagagaaagtagcaagaggctgagccagaggtggacagagaccaagaactgaaaatcagccaccctattgattaccttccaactctgtcatgaaatttactgagagaccttggtcaggtcactgctctctgggccttggtttcttcatgtgtaagatgaagggatggactagaatatgactctatagaacttaccaactccctggttctactcttagctgcaaggtaaatgaaaaggcaggcaggtgggtaggtaaagatatacacgggcaggcatggagacagacagactggccacatacatgcatacacaagtttcacaaaaatagaacaaagcccaaatcatggtagaccagtgaactgtgaatcacagagagcagcagccagatccacaaaatcgtctcatcgcttttgatactgccatggtgaaaacttggcagatttccttttacctagcacttgcccagcttcctggaggccagcattcagaccttttctgactggcttggccgaccctttcctccaccgactcagaggattagttatgtcaggatctgcaaatgacctctgatgcccaaatggaagaactcagcctactcttctaactcttaacacttgaggatgaaaaaactcacataacctaccatgcatattcttgtccaactttctgtctggatatctgtctggttgtaatgttctatggataattttaagcacgctgtgttcaccaggctttcaaaggtaaccacttttaaacttttgtgagtcttgtttgcaggggcatggaaatgaagagaataattagtacttgtcgagctcccagccagcgaatgactttagtaaggtgctaacaatgcactcaagtgagtgcagcaaaatgatgaggacttacagatggattttagtatctggtttatttcacttccattggtttttgcaagatgtaatatagtgtgatttttcttactttgactgcttataatttatcagccttccccaaaataatacccccatagtttaatctgagggcacatgagctgatagtaggtacccctttgggaaaatctgattaagcatttgtttctcaagaaactcctttggtatctgggacaccattttgaatacatctagagcttcacattttgatgctagtacattttataagaatctatgaaaagcaactccatcaaaattgtgtttccttagagaaagatagtgcattaggataacaatctgtattgcacccattaccatagtactttcttaagaggtttttgccatcactggaagccttactcttccaggacaagtgagccctgagaacacaggctagggtgggcatgatgtgtgaggatgaagaagccaggctggctgcagtcaagcttgctcttataccaagtggcggatgggtttggttgagtcattgtagctagcgagagaggatgctgaaagacacaagagaggcttggcttccacatatatctccagcgccacctcgtccctggggtccagactcctgcaactctcacaccactcctgtctctactgggaggtttagttgggatctcaaacttcacctgcccccagacaaactcctgacatttccccagaacgtggtcctctcccaatcttccccgcctcagtgagtggcatctctgtccttaccagttgctcaggggaaaatcttcaaggtatcttttgcatatctttttctcccccaggccatgtctaatccactagcaaattctgtctacttcacctgcataatatatctggaatttgaccgcctctcgccaccatcagctctgtcatcctagtccaagccgccatcatttcttacatgggcttctgtaaaagcctactagctggctcccctgcttcctttattggacccctacagtcttgtctaaccacagtgataacccttttaaaatgttaattgagatgttgtcattcctcttttcccagcccagcagtggctctccatctccttcaacaaccaaccctgcaaggttcctgcaagctccatctctgactttatattttattaccctgcctcaggcccatttttctctaatcacactggtctccttgctttaccttaaatataccaggcctcttgctgcctcagggcctttgtatttgctcctctttctacctggaatgctcttcccctagatatctgcagggctgggtccttatgttcattccagtctttcttgaaatgtcataggaataggattgccaaggagtccaattcttaaaaagaggtcactggtcttggccagcaggaagtcactgatgactttttagagggcagctgcagtcaagtggtagaagaggagccacattgtttttgaatcatctgtatcccttaccaggctgtgcaccgctcgagtctggtgctgttgtctcattcatttttgtctgtctagtaccctccacagtgcctggcaccagtaggcactcagtgtttgtgggatgagggcacgagtcttattttcaaacaattggttatgttaaaacacgttaaattgctgaatgtttgtgattgctttctcagtttttctcagggaatatgtttgaaaaacaaaatctgtgcatttattgtagacccattccctgagtattgacgggtgacatggtgctgtacatgtgatttagaggttttcagtgcacacaggttgtgggggaggctgagaccatcctcagtgtcttagggagataagaaagttcaatctctgcttgtgtatttactagctcacttcccttttaaaatcccctttctagactggaagggctatttaaattcaaaagctatccttgggttcaagcaaaatcttaatgactttagggacagatatttaacaggtggtttagatagttaacactcggctggtggtgaaaaaccacattgaaccacattgaacatggggttccctaataattttaactgagctcaaccttcatctcctttatcgcctctcctttatttaactatctactggagttcaaaacaccactgtaggaatggcttttcttcttgtatcttgccccccttccaggctctgccctctgagatctttccctagacaccagttagagaaggttggccttccctgaaactctttattcctagatccttttgacaccactagtaaatcctgctttctttgctgtctgagaattttatgaaggtcacttctgcagcatcggcctctacaccaatggctaggaagccgtggcaggactctgatcccatttctagtattgctcttaaaccagctctgcctgcaaatgtcagagttttagacctcaagccctctatctcctgaaagtaattgtgacttgtagcctatcacctgggtcagtccacagggtctgctctgcctgtcctgatatctaccatattcgtcatatgagacatttacctatgtgggagggaaaatggtatcacgagtgtggccaagaataggtagctatttctaccgggagtggaggaggtcatttcatacccctacaaaagaggatttttctgttaccccctctgctataaatcaaatacacacttaacagttatatgccatccaggctcattcaacaaacatttgccgagaaccacacagcctgggtgtaaaggagttgggggaaatagggacatgagacatggtccatatgccctcaaaaagcctgcaatccacagaaggtggaaatagtgagaaaggtacagacagagcctatgaatcagtgcaatataatcaggtctgagcaaagtggagccaagaggaagcaatttgttgttgcctgaggctgtagagaagactattcaacaggaaaggcagatgtgggttttcaaagagaagcaggattttgtggagaggagaagatggggaagtgctatcctgttagagaaagtggctttgtaaaggcccagaggcaaggaccagcatggaggatctgggaagggttgtggtgtggcatttagaaaatatgtaaggccaggttccatctcggagggtattgaaagccatgctgagacatagacctgattaagtaggcaataaggagctgcgtacggttgtcaagcaggggaaggagaaaacagctgtttcttccaaagataatagtagcttaactgtggagcaaagaagggagcgggttggcgctgtgatggataaataccatactctcaccatcactgcactgaccacactgagcaaacaactctcagtgtgaaagcggggaagtgatagtcctaagggctgtgtcacccgggcggaagaactgcagttgcatcacttgtcctgatcattgttaaactgagcgtgggctgggagctccttgttcctaggcaaaagtcctcagtaggagactgtaatcatgcctaaaattacttcattattggaaccagtgtttgatctgtgattaagagctggatgaagaaatcaagtaatcagccattgaaattgtaaccataaattgttctataaacaactaacttcccctgtctcccggactccaagcaacaaacttgaaaacagatacttttcctgttgtttcttcacccgatgggttttagccagtgcttttgagccttgcagaagtcagagggtaacacctgccagccacagtgcccctttgtccctcacatatggatcactcatgatgttgtaccttgtcagactaagacaagatacccaaggagtgtggagctgttaaaaatatgcaacttattaagatttgtctagtgagggtaaagagatttatttttaacagaactggggagaaactgcctggatttcaagataaagaatagagaaagccctcagcggttgttgccttttcaatgatgtgttagaagtagcttttgtcctgaagggttttattttgcccaaagcattcaaatactacagcccatagagacatttctgtaaaacaacattagggcttattgactttttcttgtttggggttgcgctgtgcttaaccttccagatatgtaataaatagtaacaaattttaagaaagatctaaactttgttttggggaagaccatggcagcaaccaggcaatcttgacacatgaagtaactgactgtggaaccacaacctgctttgctcctataatgcctagggacaaccagacaagagcggttaagggagttatttcatgtgatcatttttctgacgttaagaggtagcacctagtagttgctcagcaaggttcattttcctcctctgttgtcatttacagcccaaacccttagagatcataacatggaagagcccttaagggtctgcccaaacctttccattttgcaagataagtaggaaggctcacagaagttaatgacttaccctttgtcctcgactggtccttagcagaagcagagctagaatcgggtctacaatccagctgctttgccttcttcgatgggagcagtacttcatctgtctcttgggaataactccagtagcccagtgaaaacattgcctctttcacaaaaattcactttcacaagttagcatccttggcacttggcataataatgcgaccaacgataacatagataccactttatagtctgcatagtgcttttcaccataacatcttgtgttgaactcccattgttatccatggctctactggtggcattttaaaggacagtgtgttgtagactgggatcccttacccaaagaggagtttgaactccttttttaaaaagagggctgagaaaggtttcactttatgttcctgtaatttcttaaaggatttatagataaaaacattaaaatattctgggtgtaaaataaaattgtctcagaatgggaatagacttaaggtacagtgaggagatataggagacaaatcaatggaagatttaaagtcaggaataaatgctgataatggatttctagatacttctcttgaattccaaaaacacgaaaaataaactgttgttactggggtggagacaaaacagaagaagataaagagaacaggctaaggagaaaggaagaggttaagggagaaacctctgtatgaggaacaaaccaaagttgactcttttttcaaaattcctacattctctgggataaacagctaatgtttgaacataaaacagctgaatctcccagagcttcaactactttctgttttggaagttagtactttgggaaattgaagactctttccatttcctagggaagttgccaatttagggttttacatcagaggttggcaaattatgtccccaggccaaatccagtccattacatgtttgtttgtttgtttttggtatggccagtaagctaataatagtttttatattctcaaacaggtgaaaaaattaagaacaatgttttgtgacatttgaaaaatatatgcaattcgcatttcaatgtctgtaaataaagttttgttggaacacagccatgcattcatttacatgttgtgtatgactgcttttgtactgtaacagcagagtctgcaactctgaaaagatttactatctggccatttacataaagagtttgtcaaccgttgctttaagccaatcttttggtttccctgggtcacattggaagaaggataattgtcttgggctacacataaaacacacgaacacaaatgattgctgataagcttaaaaaaaaaagcgaaaaaaatctcataatgttttaagaaagcttacgaatttgtgttgggctgcattcaaagccattctgggctgcatgcagcctgcaggctgcggtttgtacaagcttgcttcaaactgaagtatcttcatgatctgaaagtgttaaataactttctctagagcccagctcttaaccagaggggagtttagacattgggataatctggttcaatataacttaattcaatgacttgtacttagaatcaagttacaaaagtggaatattatgcttcctgtctaactataaattgtattccatagaggtacgtcaaatatttcaattttctaaaatgtaatattaagcttcccagtaattcaaaatgagattaaggggaattttttttcatttgctctttgtaacaaccagcttcatataaccagcagcaaacaatggggtccccagactgtttgaggacacttttgtatcgattagctgtagttaaagcctgaatggttaagtcagcaatttgacttaaaaaaatgctgtagattctaatttataatacctctacagcaacagacttcctatcaggcagattgtggagacaagcagttgtttgtaccgatttctggctaattacttatctatttgatatggcatctcccaccaaaatgccataccaagctgtgctttccaagggcatttttgaataatgggattcaaacaggaatttaaatgttcacccgaaccttctctctcgatctgtgcactaggatgaaggagggttgattccagcttgggacagatgaccaggaggtatgggacagatgaccaggaggtaaatgaaggggttgaggatcagtattggaaggtcaggaaggacacattttacaagttgggacattcaacctatgaatcatttcttatgcagtttcaagatatattttgcattgattagctgtctttgaagcccatacagttaaggcagttttctgccttctgcctcttcactgagcacctgtattagctagagcttagatctaagaattctgtgacttgctgaaatttattctgctagctaagaggaccaagggcctttaagcttcagatttgcatcactgtctcttcaaactagattactttaatgagtacttgatatggtttggctgtgtccccacccaaatctcatcttgaattgtagtttccataatccccacttgttgtggaagggacctggtgggaggtaatttaatcatgggggtggttaaccccatgctgttctcatgatagggggtgagttctcaggaggtctgatggtttcataaggggcttttcccccttttgctcagcacttctccttgctgccaccatgcaaagaaggatgtgtttgcttccccttccaccatgcttgtaagtttcctgaggcctccccagtcatgctgaactgtgagtcaattgaacctctttcctttataaattacccagtcttgggtatgtctttattagcagcatgagaatggactaatgcagtactgtacttttgtaattttcataattgtttcttacattttgaatcaatagtttcataccattatgaccatatattttcaattacatgttattttggagaccatgtcatttttcatgggttttcatagctctcttacttttggctctgtggagcctaggagaaaggttcctgtcatccccatcccctggcttttctgctctgctaaaatcattataactagcttaaatttatatttcaggaaccttctgtaaaatcacaacagagttatcttctgatgagtctggttgctagactaaagatttgtatgaggattgtcagaaatgttggctgggcatggtggctcacgcctgtaatcccagtactttgggaggccgaggcgggtggatcacctgatgtcaggagttcgagagcagcctggcgaacatgatgaaaccccgtctctactaaaaatacaaaaattagctgggcgtggtggtgggcacctgtaatcccaactactggggaggctgaggcaggagaatcacttgcacctgggaggcagaggttgcagtgagccgagattgcgccattgcactcagcctgggggacaagagcaagactttgtctcaaaaaaaaaacaaatgttgactagtgtcttctgtttgggctggttatagacaacacagcttttgtcatgatttcttgtagggccactggtttaagttccaaatgttgcacctgaatactctagaaactatcgtttagctgataaccttgaataatttccagtcagcccttttttattccaaaggggtgtcacttaagatcaaattcattcagagaagtattgatccgccagctgccactctccattaactctcccctcccccagcggctgaaagagtgcccttcttggggccaataaatgtttatattgcccctaggtacgattgttcctccagcaagagccttcattaagcccagcaacatgataaggtaatgaggcttctgctttaacatagcagaacatatatatccaaatgagcatggttccctggctctccttttttattatcctgccttctcccaggagaaagtagtgcattgaggggaccatcaaaactcctcctcccttccccttctgctgagttccccaagacacctggtctcaactcctattccaaattgcccagagaaagagagatgataagtggacagaagacatacaggcggcatggcaaagaagctcaagactggcaaagaacgaaaagcgctgaatacaatggtcacaacagaggactcatattggtctagaagggatgcagaaagccagactggtgtggactaattatttctttatttcttctaaacattctatgactgagcttgaagggtcaaggaagatggctcattggagtgtcctagaattccatattacaattcagtagttttctttgaaagtatggaacacataatagatatatctttgtatcactagcattttgcccgtagcaggtggtaagtgggttgttattgcaacaacagtagatctgagctgtgaacttatacaataaggcctatactgccataatgagtatagcaccagaatcatcaccacattttaattataaaaaatattattgtactctgccatttcccacttataagcatcatgactctgtgaagtcaggtggcaagcttggattatttttatcctatttttcatttgtgtgaaccaaggcataccaatcacttggggggactggtgtgatggcttagaataagagctccaggttttcagctctgcatgtggcactcttctcaacaatctggatgaaatcaggagctagcatcacacactgttgctatttacaaaagcctaattaatacctctcattccctaatgagatactttttctgactccacagacaagcagagccaagcaagtgatgtcagaatgccagagtgaattattgggcttgtgtcaacccaagcagagatgaaaaatcacccctgtgaacttgctccaggagcaatcaaagggccaaagttttaattagtgagggttgtgatttacatttgcattcagcatcctaagaatctacattagtcttcaagctcctgcacttccctagttgttgtctgacactggttaggatagttaatatgcttttaaataacattatatttaatggacctttgaaagcactgacatatgaatccattttctcacctgtcagcagaactgttttcattaaagaagtcagtgaaagaccacatgctgagaggagctaaaagttggtggcagggaacatttcagcttggtatcttgtcctttcacctatatctactgtgaaaattaatgaacagttatctaggaatactaatattaggattgatttctaatcaaagggaaaatgatgtcaaagcactatagtgaataaaggaatgcaatggatttatttttaacaaacatagcagaactgacataatggaaaagggtgctgatttcttcaacatattcaacatttgcatgttgctgtattggttagtacatttgacagctgtagcatgttctcttgactctgcttggttgagagatatctttgtcctttgagagtggattgaattttgggaatcagtcaaatgtcctgagaaggtaatgatgatgtactaattggatgatcagactgggtcctatggttgggggccagaagtgaggtgtgactacacagtcatgagtgatatttctcatgtggctcataactgtctatgaagatagttcccagggaacagctctggaaatgtgaacgccagcagtatccttggaatctgtatacagcttctctgggtaacaactttgagaggaccagcatgcattgggtacaacacaggccctcgtgcgcttgctaaagatctgcttcaatactttgtcacaccgcctacactggctccacatttgccaagtaactatgagcatggttctccttccaacaatctggatggagctagcatccttcatgagtgtaaatttacaaaagtttaattaatatatcttgcttgctaatgagttattccttttgactccatagacatgcagggccaaatacatgatgtcagaattccctgagtgaattattgagcttgtgacaacctgggtcagaatgaaaaatcaccttagtatatttaatccagaagcaaataaagggccagagaattaattaatatgggttttaatttgttaaggtcttaagagggagcctctgtttgctctggtacctttttgtgtgtgtcctctttgattacaggtgaacatgcctttgggaaaagatatctacttctttactgtgctcctcggtaacctatagacaagaaagaaaaaagtgggttcttagtcttcagagagcatcaaatcattgaatttattgtttaggtgatgagccaatgccctgttcccaggaataggtttcatgaggaattgctaggaggcatagaaaaagaattgcacatagtggaagtagatgatgataaaagaaaacaagtgctagagctggacaacagagcaacaccccatgagtcctgaacaaagaactagaaagaaacccaaggaaaatcagagtgcttctttgcagcctttggctaagtctccctagctcccaaaaggatgtagacagcagataacactgctgatgagagggcaggatccagacaggtgagctgtgctagggaaggggctgccaaggaaagccccaaatgcaatggtacaaggtgatccagtgggagcaatccttcctattgtcccatgagcaggtgctttagggagccactggtccaaggcctgcattcaaattcatgcctcctggtttttcaccatctttccaggatcaggttagatcacagaaaggccgcccatttgccactttagcttagctgttactggcctaccttccaatgtggtatccccagctgctattaaaagaaatggacatgagtaaattttactgaatggaaagtatatcccaattaacttgactttttaaaatgtctctctatatacatacatatatatgtatatacatatatatacatatatgtgtgtgcgtgtatatatatatgtatatacatatatatacatatatatgtgtgtgtgtatatatatatatatatatgtatatatatgacactgtcctgtggagactgctcctacatatcctgtaaaaatcagtgcttcatagttttggcaccaggaataagtttgattctcctgacaaaatgataccttctctttaatcacaagttgagaatgctattatccagcgtgtttcttttaatgtttattgccttcgttgctgggaaactcagagctaaccccagcattcaatttcagtaatcttgctctttaagattttgagaattagtctcttatcccttctaaaatatttctactgatcttgttcttccccagggtcatattacaggtacgctttaggttaagctttctcaaaattggggtactggatgggttataaactataaaaaatagtgctctgaccctagtctgtgatggtccgaacacaccaacctgtgttcttcctggcccatgctacttgctctgacctggtgctccttgaaataaaatggatttctgttagttacagcccctatttttacactagagttgatgcttttttcctatgttagtcatgaattataatttctgtatgcccccaaatatcagaacaagtggggatggggaggcaaatagcggcatgcatttctctaatatttattcttatctctggagctggttgtataaagctgtcaagaagaaaatttccacttaaaccagaaccttccagcactaggagtgctgacctgtagcaattacgggtgctaggattgttttacttggtgtcttacttgactttcagtttgtgaccatcacttgacaggattaaaaattgcctctgttctatctgctaatttcttgaaggggacagcctattccagaagagacagtctgagcaggaaacaaaggctctgtactgtgctcagaaactaaaactagataggtcagggcccatgcctgaaagcagttggttctccacagcccattgttatccataggtcatggatacatcctggcaagcaggctgtaaaggacatgaccccttaattgaaataaaatgcccacctaggcatacaaaggatgagtagagaaagagtccttaagggaaatttttaattgtttacctcgattgattgattgattgattgattgagacagggtctcaccctgtcgcccaggctggagtgcagtggtgtggtcatagctcactgcagccttgacctacctggctcaagtgatcctctcatctcagcctctggagtagctgggcctacaggcaagtgccaccatgcccggatcattttaattattattattattatttagagacgagccctcactatgttgtccagacttgtcttgaacacctgagctcaagcgatcatcctgcatcagccacccaaagtgttgggattacaggtgtgagccaccgtgcctggcctgggaaatttttaaaaagaaacagcagaactttttgagagtaagaggggcatactccccttctggggttttatttcccccttgggcttctgaaactttaatgctgaactggcctctcacaagccacagacaaagctgagaatgtcaaaggtaactaataaactgctctgaaaaaaaaaaaaaaaagtaaacgtcattagagtggatggagtctaaaaatccataattctaagaatcccaggagaagcactgaacagctttttaaagccatttcttttgcccccaagccacaaaggattgtttatatccttttgaggcagctagctggatgcccctcttcccaattctgggattccctgagataaatactatcttgttcccttatatgccaactctactttctgctgttggaaacttctttgctacttgcagggccttctcctttcagatctgaaggtctggtctacttccccaaggcatgatgatagactgacgttcttgagccccagtgaaggttctagcctttcacagcttacattatcttcccatctcacatagaatcattctgtaaaatgtatatttctgaggtgtctggactcatacatcctccattgagagggggtctgaaaattgtttaatatagtttaacatttatggcatctcttccttgacagtgtcagtaacagagtgaagactgccattttctcaccaacgttaagggaagtcagggatagggcaggttcttcctacagtagcatctggtccaccagtactgagaacattctctgcaaggagtttgctctttatgtcatttagacattagacattttaaataataagcatgatttctacctttcatgtttttatcactggagttttctacctctccactcctccatctgctctaagccaagaagtgcctccagacagtgacatcttgcactgtgattaaagtgcttagtatagagaaatgagtggacaccaggtttgtataggtttaaagactttattaagtaagaagttgattgttttgtggctggagagaaccagaggaccattgtttgaaagctgacaacctatattacaaagaggtgacggagatgatatcatgactttcaggaagcacaggcttttggaagtgttcatcaagtgggtcgtggcataaggctgacttaaatttttttttaatgttttaatttgttgtagagacaggggtctccccatgttgctcaggctggtctcaaactcctggcctcaattgatcctcctgccttggcctcccgaattgctgggataataggcatgagccaccatgcccagcccttaaattctgattatatcagagccaagactttcttgacgttttgaagccaagttgagagcaaaacgacccatttctgattttctacataataaaggaaacaaaccaggaacaataatcaaaggtggattttttgtttctttgggaagttataaccatatttgcataaactttaaaacagttatgacatctagttgaggtactaaaacagtttctttttttaattaacttttgttgcaataaataaggccagactaacaaaaatatatccaaagccaataattctatatttgtttggcacatgttgcttccttcagcatacttcaggtcatctttgccaggaattgagaacaggttgcatgtaattacaaaggctccttggtgggatgaaggacaggatgactgacgaaataccacagctaatcagataagtgcaccagggaaaaagcaacatgtaatggctggaaacccaaaacacaagactttttttttttttttaagacagagttttgctcttgttgcccaggctggaatgcaatggcgcgatctgatcttggctcactgcaacctctgcctcccaggtttaagtgattatcctgcctcagccttcccaagtagctgggaatacaggcacccaccaccatgcccagctaatttttttatatttttagtagagacagggttttcaccatgttggccaggctggtcttgaactcctgacctcaggtgatccaccgactcagcctcccaaagtgctaggattacaggtgtgagccaccatgcccagccatcagcaaatgagtctattatgatgggaatactcatgcccccagactagatctagtttctcctttgatcccaagccttctggtgttgttctcctttgagcccactgtcccttctctggcctgtcctccttaatcttcttccaaggctattctcttctcatgctacacactctcctcatgtaatctcttctaaaggtttgaactaccatagactcccaaatctctaaagaccattcttcagctgagatctctatatccagctaagttctgcatccgtctatccaattgccaactaaacatcttacctagaggtaccaacaggcacacaaaactcaacatagctcaaaactgaacatgtcatcttcttccacatactctccccaacaaaaaaagaaggctgtgttgcgggaagtcagggaccccaaacagagggaccggctgaagccatggcagaagaacgtggattgtgaagatttcttggacatttattagttccccaaattaatacttttataatttcttatgcctgtctttactgcaatctctaaacataaattgtgaagatttcatggacacttatcacttccccaatcaatacacttgtgatttcctatgcctgtctttactttaatctcttaatcgtcatctcgtaagccgaggaggatgtatgtcacctcaggaccctgtgataattgcgttaactgcacaaattgtagagcatgtgtgtttgaacaatatgaaatctggccaccttgaaaaaagaacaggataacagcaatgtttaggaaacaagagagataaccttaaactctgaccgctggtgagccaggtggaacagagccatatttctcgtctttcaaaagcaaatgggagaaatatcgctgaattctttttctcagtaaggaacatccctgggaaagagaatacgcgcctgggggtgggtctctgaactggcccccccccaggcgtggttgtcttctatggtcgaggctgtaggggtgaaatagaccccagtctcccatagcgctcccaggcttaataggaagaggaaattcccacctaataaattttggtcagactggttgctctcaaaaccctgtctcctgataagatgttatcaatgacaatggtgcctgaaacttcattagcaattttaatttcgccccagtcctgtggtcctgtgatctcgccctgcctccatttgtcttgtgatattctattaccttgtgaagtatgtgatctttgtgaccaacaccctattcgtacactgcctccccttttgaaactccctaataaaaacttgctggttttgcggcttgtggggcatcacggaacctactgacatgtgatgtctcccccagatgcccagccttaaaatgtctctcttttgtactctgtccctttatttctcaaactggctgacgcttagggaaaatagaaaagaacctacgtgactataggggcaggttccctgataagactgccaacccttcttgtatggctgatattggcaaatggagccacaattaattcatgttacagcatctttgatcccacaccttctggccttgttctgtactccgtggtggctatggccctgtctgctatatgctagctaagttctgtcaagtcagtactgcatccttggatacttaccttgaatacatcccttctctctggaccttacttttctatttctaaggattcctctaactctatatttctaggcgtctttcccttgtctggggaggggtcaataaagagcctcactctttggctcagttaagcatcttgggtttaaccagactgtgattaaaaactcatgtgcatgaagcgaagtagattggtttaagttatacaaggtttagcgtttaacagtgattagtggatgatataaaaaagatgtgctttgtttccataaattgtcagaattttagtcttctgttttcatgcacactaaaataatgctcaattttccaaattgtaacacaatacaaagaggctgacaattgggtttcacttggaaaggaaaattaaaagtggtcaatacagatcacagaatagataatatttgcaaaggagaccctacttagaaataacacgcattcaaacaaaggtatgatgcctgaatgtgtgataactaagtagtttaaaaattgaaatagtttcatctgtccctgtaaataaacgtgaagagaaaagtacaaagtcctttggtttaaagggtcagtgtttttaacagacacatgaacgcatagtttaggggaactttcctttctaccccagaaggcattttcaatatcttgttggcatggcccttctacttgatttctaaggagccagatgcactgtttgcttttaagacaaggtctcgctctgttgcccagcctggagtgcagtggtgcaatcacagctcactgcagccttgacttcccaggctccagccattttcccaactcagcctctcaagtagctaggatgacaggcatgtgccaccacactcagctaattttgtttttgtttttgtagagacagggtattgctatgttgcccaagctggtcttggactcctgagcgcaaacaatcctcctgcctcagccacccaaagtgctgggattacaaacatgagccaccacacctagcccagatgcacttttaggtatagatgcatttggccccctagaaagtactcaagatgccaagttcagcaacaaggaaatatttgaatactcttggctttgggcacaacatggagctagagaatgggtaccccatgccccaatgtcaaaatcagcagtcttggttaagtaggaccaaccctgcctcaatgacccaacttgttcaagttctagctataaagacagaatatgacctcagctcttcctaatttcagtgcccaagctttttccacaacaccagggctgcttccagttagtatggcaacaccattctccagagttgctaattttcactggttttactctacttgagtttcctatctgtgggcactagagctaagaaatacttctgcaataggctgtcactttttagtcataaagtgtgagttaacatataatttgaacaaaaagccaaagccacatgactcctttagtaaacctctaacctagtttgcgtcagtcagtcaattcaattcagtaaacatgttagaagcccaatttaccaggtatggttttcagtcagcaggtgctgaaaaccttgtatatggcaagtgtgatcagagatattgtgaacagatgtgaatacaatttgcccttgtccttaaagaagttaatatgtaatgtgcaggcagagtggacattcttgaaaatcccataagaacatattaagtagaaagtgaaacaaagtggtaattcaccagggaggaggaaatgagcctctccaccaacacttagttcgtatcattctgtagtgtaaaatcagaatctcacctccaaatgaataggctgactgacttctctttgttctccgtgtgctaattcttgccattgcagttggctcctttggcttttcctaaaaagttcactgagaattttctggcctactctggggactccctaatgtgtaatgttcaccaactaggctccagttgtgaatttttaattatgccggatcattttcagtaaatagaacttcgggctcaactaatgctgtcagatctaatctttgtctcacctgctatggagctccactctgtggtgtttgcagtaattgccacttccccaggaaagaggagcttttgcagagatggatgtcagcagccctttgcattctcatctgccctcctcagaagccctacagcggggcactttatccagcagatttgaattttgatgtttggaaagtagagacaatggatacagctgattgttctctttcaattttcaccaagtgtgattgtctcatgcttcctgtgaggcagtagttctcaaagtgtgggccatagacaggaaacattaccgtcatctgggaacctgatagaattgtaaattctcaggtcccatcttagacctgctgaatcagaaactctgggggtccctgccacctgcatttaaaaaatactctaggttatctgatgtatgattaagtctatgagcccactattgagagagaactgtttcaaactaaggataagcataatttcgttctattttgtgaaaattctcataactcatttttctgatttacaattcttcaaaaacaaaaatcctaattttcataatggaaactcacatttacctttgctttccctaactttcccaagcataggcagttgtttcctgttttatttccctagcattttttcacacttgtttattccacttggtacattacattgttatgtagctgttaacatgcttgccttctccactagccttggggccacctgccggcgggaaccttgtcacactcatcatagtatccccaaggctacatagtaaacacacattaaagggcacagagtaaacacattcaatattttctgagtggataaattggttaacattgtataattttcaaaactaggtaatggccttaagaagtacgactggcagaataggaaactgagacccagagacattaaaggattcagttggtaagaagttgcagaggcagggctaacaacaaaagcttacctcagtatgggaaaggtgatggccacaggtccctcaaaactggcctaatacactaaactccactcaggaagcttgggatactttggctcttcaagggcaaagcccttgatttactcccagacaggttgctttctgccccaaaaccaaggatgctaagagagggtagctgaggttgccagttagtgagacacgtgcagagactgagaatcaagagggaagggaatcatgtaaaaaaaaaaaaggagattttagtactattggaggtataaattctagtactcggttaggccgtggtaaagagaaaagatgtgaactgcaagtgaagccaaggtagaaagctcaattttgctcatttgccagagtgtccttcttacaccaaggtgaaaacagcataggatgtactctgtgaggtatttgttataggaatgggctgccaatgattgccaccaatctcttggtacccagcttgccttgtcatctgtaagcaatctgggtgggctgggagaatggggagaagcagactatgggcatgggatgaagaaagccactggcctgcaccaggaacgaggccttcactttccctcattaaccttagcattaatctctacataactaagttacctgatttagatgcttttacttggacctctggcatacaagtctttgtaacgcagttgtaaatcctcatagagtggggtgggagtaaacagattctggcataggatgcttcttgaaacactccttaatcatagtggatcactgtctcatcaggcctcactgtttatctcatggctttgagtcccactttggagcaatgaccgcacatctgccttgtctttcttcttgagctccagttccatttctctaattgcctactgggacactgtccatcaataccccaactcgataggccccaaactgaatccgtcatcttctcctctagtccagatctccctcccaactactctctctttcactggcagagtaaatttgttctcagtcatccaacttgcaaaccttctcagtgactttcatttagggtttattctcattccccaaacatagtcaatccccaagttctgtcatattttcttttgccatgccaggcatagttattttccacccctataactgccattccagcccagcctctcattatatttcagatctcaattaccccaaaccatccaattccataactatggtttctgctcctcaatccctgatgtgatggagaagcccagagttagatgcgaacgcaacagttttataataccacttacaattgttagataccgttctattggcctctgatagtttgtaactacggtccatactgttggtaaagacacatgggattagtcagcttaaatgagaaaataatataatttagaaactgactcatgttctttcttgatcccaatgaggcattcagggacgtgactgtcactctctgggcaaaaacaacatgtaccaagaggtgaagagagcaaaatagcaacaaaaataaatgagcccattgctgcagtccctgatgccctgtggtgagctgctagagtgaaaagttaatggaatgggagagggcaagataatgtgagcgccctggttgccttttccaagagcttttcaattccagagtaactgtgagcttcattgtgaatggtttacctgatcagtataattccctctcctttgtagataagaagactaagacagcaagaagttaaatgccttgctggcagccaggattagaacctgggattcctgaataaatgctttgaacttatgaggctgcttctgagagatcatagttacactgggcttcatagcaataaaaatgagcttttcccttccctcagaaatcctgttattatccatagttaggcaaagggaaactagaagaggatgctaaataaaagcacatctcaatgaactgaactatctttgccaggtgattatcagaaatatagataatgagcgtaagatacttaaaggggcaaggactctaatttagacacctcgggcaaaagaagtgaaaaagtttggaacaaagaaaaccactcaggacataacctaacaagatagaaaaaaatgaaatgcgaaagtattatcagctttaattaaaggaaatcaatatttgaagaggtgtcttgctcaacaatagaacaagggcaaacatacttcagaaatgtgagtctcttagaaaagagaaaagcaagttttcatggggaaacaaccacgattgaaaaacctttcaaaagatgacgacttggtgtatctgttggagaggggcctgaagcacctgttggggaggccgactagatgagcttttatccctgggagagtctgttttaagtgcattttttcagtcagggagtgttcaggagcctagaggcatctctagggagtaaagaatagccagtatttccctcagagagacttgaaacaaaccctcaacaataaagtgggtttcatctcagttatcacttacaagaacacacattggaaaacattaaggactatacaaatgcaacagatgtgttatttcagaggcactctgcaaccatccaagcaagcttgcttgagaatcctttctaagctcacgttttttgtgatgcacatgatgaccaaccttcagtgactggagtccaattctcccagaccattcctcttcagggatggaagatatgtgacatgtgtcaccacttccttctctcaaactggtgcaagacattaatactcaatcatgacacttctttccattgagcccaaatgcagctttttcatttatttgttcaatgaatacctcttgactgcccatttaaaagtgagttggagagacagataaataataaaatataagcaacactacgagcaccacatgctaagtgcctagtaaaagatatgtagacaataaatatcatagccaaacctgttctcttgaaatacaatttcaatttcctgggaccctgaaaattaattcttaaaatttcagtactattgtagttgtatcagcacaactatttttcagggatctgagatgaattaattccgaaaagagcttacaaaggagatgcagaagtttctatatgccacccatcaaaaaagtgagtcaggtgtgttttaagccacagggttcttctcccacaattagctttgaccaaacagcaaaactcagattggagtgggtctgattgccattttggtttaagtacactggataccatttcagcatcaaatcattcaatcagaaacactgaaaatgctgaagagttgggttagttgcaattttcccacctgaatagaatgtgcataatactgcaaattgttttttcacttttgtagtgctggagacatttatggaacctgtgggaaagggttttcttgacagatggagatggacagccaaccagacagaaggagagctagcactcattaacttttcccaacagaaactcacctgtaattgttttcacaggcctttaatgaggcttggttgtgaggcactagagagaggaaagcagcttatccatagaaaaggatagctactcaggtgaggtagaggaagcctggatccatagccttggaaattgtaggacataaggtttgagattacaattcaaagacaagatgaaagtgatgagggctgacaagtagtctagagatgggcaaatcaaaagaataactactggggtagatctgtttcggttatgtaagttaggaactctaaatcaaggagcacccacccccccccaccaatctcatatatccaaaattatatctatgtgtctttgaaacaggttggatttattcttgtaaatccctgggattgcgggatgtttcagtgaccagagttcttggcaggatcttaatctttaggtctttgccccaaagatctttgaagttcccagacagtctgcagctgcagtattttctctttatttttcatgggacccttctagaaactgcagtgtccttgatatcactgctttagatctccttctctctcaaagtttcagaattatggcatcttgcccaggcttatctaactgacctggattttggtggaggaatgaagactttttctgtcaatgttaggtaaacttttctataccacagtcattagtacatctacaaaattaagctccgaggatccaagccagccacaagttcttcttgatccccctttcagatacatttcatcactgttaatggatctgttatttgcacagaacaaacatttccagttacttgattaattttacccctattcttggtgcaatgccttccctgtgtgatttattcctgagaatgtttttgttttcatttccccaatatctgtacttgggggatttggcagtaggttagaggggcccttattcctatcttttaaaggattactgctccaggaccacctcccgctagagcaccagttgacaataatgaggctgccgctgccagctgatagctttccctgatgtcctactgtgtcctgcattgagcttaaacagggtcaattataatgtaaactatagaggaccctagtgcccaaggcgcagacatgggaatttagcagtgggggattttgctttatcaaaaaaaaaaaaaaaaaaagtgaatgaatgaacttagtgactcagcacttagtgatttagtgatgacttaaatgaccacctactctgagcccagtagtgtgcatgagacacatcaaaaacatcccttgtatctgaatgcttccagccaagtttcccactgcctactgcttaagtgaggggctaggaggaggaaggctcagtggccagtgaccagggtgcaagagtgacacagagcatattagcatattgcattctttgcatcaggctatgccaaacttctggaagagacaattttgaatttgtgaggaggatagccaggatggtccctggtctcaggtccctaaggaatcctttgccaggaagtcatcgaggacggatagaggcagcaccaaatgaattcttcagtccccactcagaatgtggccacattctggtgagtctgtgagtggtacggggtaatggtccctgcactgtgcaggaatcccagcacttcattccagtggatttctgccccctcctctgggatagaatgtgtgtccactctctccagagccatccactccagcagcagagccagagctcacatgggtatctcccacttctaagagctgcttttcataccccctagacgttttttgttttgttttattcttgagacggagtctcgcactgttgcccgggctggagtgcaatcgcacaattttggctcactgcaacctccacctcccgggttcaagctattctcctgcctcagcctcccaagtagctgggattacagacgcccgccaccatgccctgggtaattttttattttttatttttgtatttttagtagagatggggttttgctatgttggccaggctggtctcgaactcctgacctcgtgatccgcctgacttggcctcccaaagtgctgggattacaggcatgagccaccgcgcccagcctagacactgactcttaagtgcttggacagttgctatctctctgacttttcctgatcagcctttttccatgcccacacacatctttattacctttgcaatcaccaggaacccatcattatctcttgttccaatcatatccatgaagtcatttgaagctgatgggtgcatggcagaatatcttttgtgacccccagcccaccccacatataaatacagctacttgcagacatctattttggagatacttaaaaggttcataaatatctgaaaagatgtttgacattttctgagacaatattctttgccactggaaggttctattatacacattaaaagcaaagatacatatttttctttcttaccttcactttttataaaaggttatgctgacgtagaacttactaacaaaaaaaaaaaaatcttcctgatgaaatcaggataaataattccacacatcttcaagtggagagaaaggctttgaattggtttccatggaaatctgaagatgaagtaaaggaataatttcaaggcagagcagctgaactgaagataatggtaaaatagtttgataaaggaaatagaataaagtaatcaagaagactccaatcaattattcctttttgtttacctttaggtgattaattcgtctgcgtttattaacctgatgagattaagcaggccttccttgtgatttatttcgtaattgtttccaaggtttgacataagctgtggagttattgaaggtggagatttaaattcaattactatgaagcaggtggtgattctcctgaaagaatatctgaattcacggacttcccatgtaacattatgagtgaaaattattaattcatctgatagtatctcccaaagacttttagaagtcatttggcatccacatacttcaccaaaagtcagcagcttcagaactgaacatgtaatgaagagaattcagtgcctggaaagaaaggattttattttaaagactagttatttttatacttttttttttaaaactagaggcccccttggggcctgggctgtggtgctatcattgatggaatccatgagctcaagctttgaatgccaaaaggatagctttctttgaacttgaccagtggttcccactctctacctttaaagggcacaactggataagatcatactttgacaggagagagagagagagagagagattggccagggggtggtggggggatatgcaggctggccttgagagtctttaaatgaagtgactaattgctttttgtctctgtggtccttgttgtgtatatgttttctattctttctgtgggtatagtaaggataaacggggttctccaaacactaacgcaggcgccaactctccgtcatccacaaagacccggaacacatctaagagtgggaagtaagtgaaaaagtgctcctgtacatctgacatagctgtcaaaaagtcaagtgctgtcctccttttgtcatttattcatattcattcaacaaagatttgtggaatgtcttctgtgtgcctcccactgggctcgtcactggggaattgaaacgagcaaggcatgtgtcagtaatattgggtgcatgaagaactagggaagagggaggagagggatggaaaagtcaggagatgactctggaaagatagcttagggctgactgtgaagggcaaggacataagtccataagggcaatgtaagagttggattacaagttttaagaattaaagcagcagcagcagcagcactgatttatgacttacaaagtccatgaaaacctgtcctgatccatacactgagtttaggcttgagttagaagaatctggtaagcttttccataaatttcctggtttaagtacatttatgttttaaccatatcactgatttatatgatatgtatattcttttcctagtaactaatatgcaccaagtcctacatgaagctgtttttttggtattaccaaaacttgtatgggctgaatatttgcgatattagattgaccttttctgggcttattccagaagacaacaccagccgatctctccctttggcttcagcaaagtgtggcaaactcaggcagtgtgatcccacgcagatgacatacctctaattagacacttccccttggaagttgcttcaaccctgtggtgaatggctcgagttctccgtaagctctctctccagggtgtggggcattgtgacacgcagaaactcagtccagaaagagcacccagcctgcatctaggagaaaatgaaagataccttcatcatgctaaaagctctaatctagcaataagatatgtcactacaagagcacagctttgcaatgaaaggtgaatttgtaatggtcatatattttatgtattcagcattggaccgtaaatgctgcactttgaatatgatcttatattcaattcccaaagtgaaagatctactggctgcctttttttccttcttttcctctgaataccatttcaggtttgcatataaagttgaatgcgggttatcttgcaaaatataaaaaacggtgttaaagacataaaactaaatctccaagcagttagaactcatttcagttatttattgctgagcaccataatcaaaatgctgtataaattatgaaggaagggaattgatgcacacattcccaggcagctgaatgttttcaaattagtcccaattcattgttaacacgcactcttagttaacagggatggcattgcagaacttcttttaactccatgcttacaacaatggcagaccctacctgggcaccctgtacctacctgtcacaccaaaaaccacagggcacaatctccatttattagtccctgatgtataattatggatgtttgtgatttgctgttgcctttccaaaggggccttcccttgtttcttttggctttgcaggagttcactgtcttactttttgagtgaagaatctccatttgagctacaaaaggagcaattggtagaatctgagttaagatgacatagagaatgcatacctaataccatacccaggttttcaacagtgggagggctgaataaatacattcttaaggagataaaaaatgatctatatctcacttgccatacttggtcacatcccaagcttctgccatggtgaagggtctctctctttgcacattttgagataggtaacttttacttgacatgtatagtgactcatagactgagctagttctgaattcttcattgtttttattggttgttagtgaaaaattacaagttctccgacatcctcttcctagatatgtgtgccagggtttcttgcactgttctcctcctcttagtcctctcccatcagttttcaggagatttttctttttttccattagtgtacattttctccttcttgggatatcattttcaacaggagcagtactgaccttctgtgcatatggtgagactatgaagggcatttttcacactttatagaacagtgcctatggatgtttaggcactgtgttctagttcagagagagttgtgattgccagttcctgctgcactgtctatgcatttccttagctttggtgtgtgtggtggtgaggaggggataggtagatgtctccaccccaaggcttttccccatggtgtattttctttcacaacaaccagcccagaggatgccatgttctgatgttatttgacctaatgacaataggatatagagcagtttttaagaatttccctatgttattttgaggccagacacaggctgggagatagaaggagggttctttccttctctgaaaagaaattcagtcttctctgtttttgaagaaaacaaaaaagcaaaagtcaagctgccccaaatatgcatcatggctaaaaataaggaatatgtgttgactgagtgttacgggccaacctgtgtcccaagcacttggtacattttgtctcattaatccttgcctaccaaaagctcatgaaacaggcactattatttctattgcacacatgaggaaattgaggctccaagaggataatgatatgcccacctgaggtatccaaatgaacaattttggtaaaaaaccttctttggcaccaatgataataatagtagtagtaattaaaatatattaagcatttactttgtgccattgcactagactctggggccatataaatataaaatactataggtgcccccaagcagttcacagtcttagtagggaggacagaggatgacaacgtggtatttaagtgctacaatccctagctgatgccagggttggggtgggaaataggtcatatggggatatcaataaaggctcctgagaagcaatccctgagctctttaattttatccatttacccttcatgtagcaaggttaggtcagagaaagaaaatgcaagtcggtcactccagaggggcagaatcctctgtgtcttggtcagaacacgttggagttgtggattaggtcaaagctaaaatgaaatgtctaattccacctttttccaactttcaatccatttggagcctactgagattcagtgtagcatgctgagtcgcttaggaaacctacagcttgaatgttgcgtcagttctggttgctctatttcattgcctggatgtgaagctgggtagccagccctctgtttcagggaggaacagatggaatgggatatgtctgagcagcagagccagactaccctggaaatgactttcagggaggtgcaagcagtttcttctatgccaacagtgagccaaattgacaagacagaaaaaaaaaaaacttcagtgcagaactgtgtcactgagatcaggaagcataggttttgcagaggttgacccatgaccaatcaggccagaccactgcatttagcctcacatatggttccctttggtaatgtgaacctgttattctggccaacacagcagaacacagtcaatccatttgctgacccattggattatccccagaaagcaagtaactgtcaaagctgggcatgtgtagtagccaccaagagcctttataatgttcatttggtattggaacattttcatactttacatgagaccaattattttgctgaacacaaggacactgagactcaagaaaggtaagtcactttccatgaggcacacacctagctactagcagagggcagcctagacacctggtcttctcatacttgtcccatgatctttccactgcaatgtatgctacagttcttctcccagagagcaagatacttcagctaattgcaccaagggaggccaggagccagatctcaggatgtccagccaggtgctcttccctctttttgtgtgggctctgccagctactgtgaaaatggagactttttggaaaaattagaatcatcctacttttaaaaaaatgtagcagtagcggtgatgaaaggaaaaagcatgtacttctcaactgcttcattttttcttctaaaataatggtatctctggttctatttggacagctacctttcctcaacagtattgttgagccatctcaagcctctaatctactccatcaatgaagcaatagagaactcatatatcactatagctattctctctcgaatcagccaaccaaagctaaggagatgtagattagataggtagatagacaaacagacacacatatatctacatctacgtatgacattcagaggcatccacttaaaaattaaattgcccaaagttgagatgatgatggaactcgatcactcctctcagtctgagatgtttttcacataggctcaggctagggaataacaaggaccaagtccagttttcaagtactagtgaaggccacaaatatggggccagggcagagcaaccaagcacagtgcctggcaaacaatactataaatgttgaattaagcactataagtgatgggttaaatgaattaagctaggggaaggagggatattaaaatggagaaaaagaaggtgtacagaaggggaatatgagatgatcaagtcaaaccctgcttactccacaaatctacttggagctgactctggtaagaccggctctaacctgcctttgccggaagtaccttatagtgaacaaacctgtttatctattcagtagtatccagataagagtagtcaagagcacatagcttcataaataaacataccagcacccctttgcttttggctggcaggagtcaaatgaaaaacttttcagctttagaaaaataaagtgaaggctgggcgtggtggctcacacctgtaatcccagcactttgggaggccgaggtgggcggaccatgaggtcaggagatcaagaccaccctgtctaacacagtgaaaccccatctctacaaaaatacaaaaaattagctgggcatggtggcacacgcctgtagtcccagctactcgggaggctgaggcaggtgaatcatttgaacccaggaggcagaggttgcagtgagctgagattgcaccactgcattctagcctgggtgacagagtgagactccgtctcaaaaaaaagaaaagaaaaaaatgaaagataaaatgaagtcttgcttgctctgtttggactcagcatggtgcattttcatgtttgacttcagctgtttctatgtccattgctggcaccagagtcctgcatattatatcgtgattatgttttttcctctaattgagacccatgtattttttctaagacattgggttgtgactgttgctaacccccactaattttgccactgtgtgtgtatgaaagtatgtgtgtgtatgaaagtatgtgtgtgtgagtgttctcttcaaaatggttgtatgttgcatgaagatagcaatccactggccaagtatttgactttgccagtaattgctgtagttttatgtgatgataatgtcaatagttccttagtttagctactagactaagtctaatatcacaaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggttgtctgcttttgccagttactgaaatgtggaagcaaaagccccagcaccataataacaatataacataataacataacataaacagtgcccatagattagatgctacaagaaatgagtaacagatccaggaagaaagagtccagccatggaaatgtttcttagcaagttcacctgcatctctgtgatggttaggatatacagtacacttcgtgacataataaatccacccccccaacccaacatatatgactttccatgctggtcatgcttctatagcttagtcaagaagagtgttctgttaatcaagccttgaaaagcaggaaccatttttctctcccttcaactgccatacaaaaatcagggaggcaatgtgctgctgctctctagaacaggggtcctcagtgactctttttctacctctgtgtcatacatggttgagaattctcacttatattgctctagcagagctcagggttctgtccagttcccaggcactgtctggaattccactcttctctctccctattgggaaagactaggaatgcaaggaagagtgatgttaaacagtatgctatttttttccacgtaataaaaagcaaatctctctctctctctctccttctctttcacttttccctccttccttccctcatctgtttgttcattgatctattaattcttccaccccatttttctggctctcaactgagctttctttgaactaccttggcaactttcttgaagatcatttgtccatatgtatttgggtctatatctggactcagtgttattccattgattgatatgtttatcgttatgccagcaccacactgtcttgattactatagctttatactagtattgcaattagatgttgtgagctctccaacttcattcttttttctttcttttttttgagataagactgtcaacccaggctggagtacagtggtgcaatcatggcccacttcaacctcccaagtaactgatacgactggcacatgccaccatgcctggctaatttttttgtagagatggggtctcactatgttgcccaggctggtctcaaacaatcctcctgccttggcctcctaaagtggtgggattacaggtgtgagccaatgcacccaaccattcttcctttataacttgttttggatgttgtacgtcctttccatttccatatgaattttagaatcggtctataaatttttgcaaaaagaaaaaagaagcctgctgggattttggcaaggattgccttgaatctgtatatcaaatttggagaaaactgacatcttaacaatattgagttaccatgaactcagggtatctatccatttatttgggttttttaaatttcactcatcagtgttttatagttttcaggatacacgcttttcctattttttttgtcagatatatccctaaatatttcacacttttggtgctatggtaaatagtattgttttatttcaatttctgattatttctaatagataacagaagtataattgatttttgtagattaatcttgtattctgcaaaacttactaagttttaggagcttttttttttttggtagattccactggatattcattggatattcaacatagatgattgttatctgtgactaaagacagatttattcttccttttcaatatggatgtctttttcttcttgccttattgcactggttaaagcctttagtacagtgttgaatagtgatatggttaggctatgtgtccccacccaaatctcatcttgaattataatccccataatccccatgtgtcaagggagagaaaaggtggaagtaattgaatcatgggggcggtttcctcgtgctgttcttgtgatagtgagttctcacaacaactgatggttttataaggggctcttacctcttcgatcagcacttcttcctccagccacgttgtgaataaggtgccttgcttccccttcaccttagaccatgattgtaagtttcctgagtcctctccagccatacagaactgtgagtagtcaattaaacctctttcctttctaaattactcagtctttggaagttctttatggcagtgtgagaacggactaatacaaatagctatgagttttttggtgtgtaaataatttctacccacttaagtctggaaaaagacacatacaataatggagagatagttgaacaatggaagcgtcctccgaagatgctattttgggaacaaatggttgatccctgcctttattgcatgtccaaagctagattcccatagcactgcacagatatatttcatcagagaaaagtagatcctattcatggggaggagggggaggtggaggagaaaaagtgaaaaacaagaagaaaaataaaccctaaagttcatagaatcatatatacttttctcattattctcattctttcattcatgttctctctctctctctcttctttgaaagaggtagtatagtataatggttaagacagcaaatgctggagcctaattactgccttaaaagcctagcattgccctcggaaggttaccggctctccctctgcatcagtttcttcacttataagaagaaactattagtagtgcatgcttcatagggttttcttgaggattaaattctttattcattcaaaaattttactgagtgcatagtaggtacaagatgctactctaggctctggggatacagcagagaacaaaacaggcaaaattccctgtccttatgcccattataatagagggatacagtcattaaacaagtaaaagacgtattattttaaaagggaataagtcataatttggaaaaagcaggggagaggtataaggaatcgtggaggcaagaaacttgtaaatttaaagtagttgagggaaacatcactaaaggtgacatttgaggaagggtttgatttatattaagtcagttaatgcatgtaaagaaatgggaatagttctttacatacagcaaaaatatagtacttttatgaattataatttattgagtactttctgtgtgtccaacactgtgcgagatgctttacatattatcttgtttaattattataataggcctataaagtaagggttattagccctttctactgaggaggaatctcaagacattggcttgtccaaagtcacatagtaggtgatagggccaatactcagatcacatctgagcttgtctcacgaggctaagttcatctaccccttctgaagacatcctgcatgcttagggactatattagactagactttgattcacaaatattagaagactggtcctgctgctggaggcctcagatgggataggattatgtagctaaaagcttctacaagggctgtggggagtggtgaaatatcaccttatctttagtatttcaacttgagaataagggcaatattgcctggcactccaataccagcacctggctctgacactttcactactatgtatgttgtgggcaagcaacctaagaatgggaagtggggaggacagaaataaaacaacgttactgggcaatagctattactccattacaaaagatgatttgggttttcaggatggtcgcttgctgaagtttaaacgaaaaaagaaaaatgaggctggactcagctcactgatgactgaactataaattttgcttggaaaatgctggcaatgctataaaattcaggccaccatctgttagtgcttgcttaaagtagcatttgcactggataattaagatgtcacatgcatttgaagcacaaatcatcagtgcatgggtgcctagcatccctggaaagattgtggatggtgaagatgttctgagaggaatatcatgttgcttgaaggatacatttatatgaaatcacaggagctagtgttttggatcacctgagtggggttgagtagaggaggagatgaggacactgagaaaactgctttcttgagttgactggatcatttaatcaaaatgatcaactggctaggcccatgcagtatggcaggcgtaataatatgtttggccatcactgtctgcaaagctcatagtgaattcagggatataaggaagaagggaggcaagtctggctaagcctaaaattcctaattaaaaaagaatttgcttgtaaagcactttataatttgcaaacagccttctcttttgttatttcatttaattaattttacccaccatcctaggaagcaggaattatatctacatcttacagactggaaaactaaggctgagggaaatagcatatttttgcccaaagccacatagatagtaagtggtagaaccatgattcaaaacagggcccttttaactctaaatcctaaagtattttttggccaaagcacaacgtgctctgatattagagtcaaataattttacatacctgaccaaaaaaaaagaaaaagaaaaaaaccatattttacaactttacaggcaggtagagaaacttacagacttcaattccaacaaagatgccagagactgccaaatatagcaagggcctggaatttttaaataataagaaataacatttattgagtgcttcctatgcaccaggccctgttcggagtgctttaaatgcatgcattatttcatttaatcctgagaactactccatgacgttgattcagggagagttcatcagtagcttagatggtgttgcccatacccaaatattgaaggttctctttggggtgatgtctgggtactttcagcagacacagcatggctggattgtggagctgagccaaggtaatgattctcccagctttggagtctaaagagtttcgctgttttggcatcaaagaccataattaatggaattaagaaggctgggcttgcttccaagtggctcttcaagagtgtccttctttctcatcatggttggggaggagatttgtgctccacgggctttaatgagatgttctgtacccaacgtctgcatgtttatcttcacttccccaatacgtgcctatggacccttcaaggatgatcaagctattttgtgccttcaccctaggcaccagggtatgttgttcagttgtgatatttgtcagaaaaatcttaggttggtgcaaaagtaattgcagtttttgccattacttttaatggcaaacaccacaattacttttgcaccaacctaatagtatgctgccactgcccactctcctagtactgctcccccttcttctgtgaaatgcaggtaatcattctcatcactcctcctggcatcaccaggaggatatgaaaacaagcaatataatgtctccaaagaccttacaaaaaataaataattacaaaaacatacttcatggtggttttcagtaactttggggggaaaaaatgcatctccatataagtaaagttgacagactcttacccctttccctgagaatgtcttcttgccatctatgtgccaggtttgcagaggttgccccttttctcccacagatcgttatgtcctttcccaaccacatgcctagtgtctcaccgactattcatttctcacttgccctccattggcagccatattttcaggggctaactacacatacccagctttgtcctaaaaacacacaccaagtctggaggccacgagtttccttacctgattatctgggtttctattcccccacttggtggtgaggaaacacatgcataatgttgttatttttttctgcttgcttgtaatttgggaggcagtgcgaccattcattactgaatgcctacaatggacaaggcatttgtgttagtcaacaggaataccaaggaaaaggcatattgtccctctcccctgcaaatgcctcctggtggggaatctctgcctgctgtagccattcttcattccaattctggcttctagcagatgaaaaaggacgaaaagaggtataaagaagccacccaggccattgagcctgagttcatagagccattgtgatgcacttaccatgtccttcctctgtgtagaccagtggttttcagtctatgttctgtacagcccttgggttctgagggaggacctcaaagcctgccatgagtgaaagtgatggggtagtctggagtggtaaatagatggggctccaggccctcactctacctcttcctgagtgactccattttaatctgttttacatattgggatctgcctagatttcattttttaaagccctgctgctgctagaatggaaaaccaaaaaccatatgttcacacttatacatgggagctaaactatgagtttgcaaaggcatacagagcaatataatggaccttgagactcaagaggccagggataaaaatctacacattagatacaatgtacactgcttgggtgatgggtgcactaaaatctcagaattcaccactgtgtaattcatccatataacacaaaactacttgtactccaaaagctattgaaataaaaataaataaataaaaataaaaaatacaaaagccccgttgctaagaaggaactgataactaccagtgtagacccagccagagaatactcagggagcaaggtttttattggaaaaccgcctttatccaccatgcctcagctccccagtgacaggcaaagcagttctggctattggacaatctcacagtcccctttctcaattctgcaagcttttttaaaaaaagaagaaaaaaagaaatgcttcctttcatatggccaaattgctctgaacagatgaaagggaccagactgacaggtgattgttccctaagattacagcctacacccaggctgaatctgaaacacttggaggaaaaaaaaatgctacaggttttgagtaatgctccccgactggcatctgctctcaagactaaatgaacacacactatttccactccatttccttaaactggcctctgtgctaggctgtaatgaaacctgtaggggaagaaagaccatttgcttggggaaaggattattttagttgcttaagccatcctctcccaaaaaataggcggatggttaggctggagtctttgtttttaatttaaatgtcattaggaggtccatgagttttcctcatatttattgtatgctatacatacacattgtagctattttatataaccctataaacaatttttaaaataaattttaaattgtctctttatattatattcactaacaaattcaaccttatcaccaacaatataatgttatcatcaggcccaaccttcatccccttcgttatactggtcttcttcttgtctataaaatgtctgcttttccataccattgcacctatcttgaataacctgtgtccttcaactacccatgtccaaacactagttcattgaaaagagctcattctttcaaaatagataagatatgtatttctatcccagctctagtaccttggacaagttaatctctttgagcctcagttttctcatttgtaaaatggggagaataactggaccttcctctctgctagaaattccttgaatgttcactgagatgacttaggcagatcttctggtacatactggtactcattaaatggaatcgttgttattacttatatttcaagacaattactgtgccccttactccatcatgtctcccttgatgcaacctgagggcatctctccctcctctgaacagcatctatttagcattgaaccagacactaagatgtgccattcatttgtttattaattcaatgagcaactatttattgtgcatttagaatgtgataggcacattaccagatgctggggcagggtgggcatagagaggtggatgtgaaagaaggaggagagaaggtggagacagcagggctgaaacagatactgctcttaagcacctaattttctagtaaagaagatattcatatacaaaaataactagaatacaaggaacaaagctatgtgctttgtaagaaaggtgcagctggagactcggctggaggactgtctccactggaagaaaaagttctggaaatgtcaactgtcttctttcttgttaactttccctttgtttgcttatctctccagcaaagttctggctgtggctccttgaggaagagtgggagtacttctttatcttccacagagcctaccaaagtacaaaatgagctctcagtgtatgcgctgatgtgagtaaagtatctgcagtatctgtagtaaagtacctgcaaagtatctgcagtaaacagaataggtatacaacacatgccagaaaagaccacctattctcttattccatcttatagcatctcataaaaagtgcatgcactgcaactcgatatgtgaaaaagttctaaaaaaaatggatacataaagaagtattcttcctccttgaactttaaagattcttgagcttattttaaacaaagagcattttgttgaggattttggtattgagccaactatagtacacattgcatttccctgaacctcatgatgttacagagaggggctaggagcacttctggggtacacttaccctacaggcacttctatttgaacctactgcttgtccctgcctttctgaatctgagaaattatacctgagagtactttttaaaaaccagttgattgaagtatgattgacatataaaaagctgcatacatttaatatttatttatatttaatgtatatatctcattgagttttggaggtaaatatacatctatgaaatcatcaccatcattaaggacataaatatatctatcatgccctaaaggtttcctcctgccccatgattattattgttttgttttttgataagaacacttacaacataagatctaccctgttagcaaattttacatataaaatcaagtattgttagccataggcactatgctgtgtagtagattcccagaacttatttatcttgtgtaattgaaagtttgtaccctttaaccatcaccacccccttgcccagcccctggtagctaccattctcctttctgcttctatgagtttgacctgattgtgcttttgatggatgttagaactatcttccttgacctggcttcagccatataagactgctgcagtgtctgttgaaagttgcatcccctaccccatctcagcacaacattctcctcctcctgttcatcttcatccctctttcaacccacagtagtcctttcattaacagagttgcttattcagtagtgcacagttcttttaaggcagattccaatgacttagggtttgtcctaattgactaagctggatgcaaaaaaccctgagagtcaaatgactgtggacatctgtccccatacctaaccctaagcaactctgacaccttgagaaagtcacctagcctctctgaatctgttttctctgctgttaaatgatggggctggctttgctgactaaagtacaaacaaatcgtgagacaagcccccgtcaccactatcaacacaaataatggagctagaaacacgagatcctttccaggtaatttaatactgctgcattttaaaagtcgtgggccgagaagatgagttttaaaaggagggaaaaagtaattcacatctcccaagatagtgtttataatggtctattaagaacacattgaaaagaaatggactaattctgtagtgttttacccaggacagcaggccagttcagtcaaagtgttttttgaatagggctataagcaaatctctttcggtgaaacctagagctgctttgcagaaagcagaaaagtggagttttcccctaatactttaaaaaatggtcacttcaccattgccaaacttcattaccactcccaggagctaaagcttcgagattaatgatcctcatcttaaagagaaggcagtgaccgctaaaagaaaaaaagaaattacaagcacatggtatttactgttctgcattctttgagaattaatgtcagtaatactgttgcaacatttttcaaaataaaggatggcgttttctaattgtctagttaaaaaaaaaatctaagtctgaatccccagagaagaaacctgagtttaaatcattaacaccacaaatctctgataattgtggcatgtttgcaagtgccttaatcaggatggtatgtcttagtggcctgttttaatttgatcacactgattaagcttctgtaagctaatatacgttgcatttccaattcaattaaatgagaatctcctggccttactagatattaccaaaatgccctgatgggtgaacactagacttggtattttcaattgctaccgactttctgattatataatctttgtattaaatgaaatcgatgaaagctcaaattaaattcagcaaactttaaggagtaaatatgttttccctgtatttttggcatactttcacctcaaggtgtggagcatgttagtcggaactcattgattacctttagtgataaattttatagggctctctcccccgtataccaattcctagaacagtctatcctgttagaaggcactgtaaatgtgggtgatgaataggcactctctctattatatatgtattatagttgtgcctttttcagctgtagataagagctatcttatgtaaatgtgattgctttgtaaatgtaaatgcctattgggtcatcgatcatcttggagatagaagaaacagaacaatagggggaggtgtgagagaaactgtctagggacagaaatgaagaaaattgctaagtgggtaacagattgaatcattagagctggagaactttgtggaggtggctaggatggaaacagcagccgcgaaactactggaagcctggcttgtgcctgcagagccctccaaaaggcttgcttccttgaggttctgaggactgactgctaaatgagaaatgggcctcttcagtgtaggtttgaagcaggaaggaactgaaaagaaaagcccaacttcattgttaggtgagcactgtgggtgcctgtcgtttgcctgcgcataacaggtttggaatctctcaaatccttcccactctcaacaacccacacaagttgtgagagtactacctaaaaacagccccttggtgtgccagtcatatgccaccccctggaggaggagggtactgaataatacctactgctgctgattcccatgccctagcagttctctcaattttttgggtggtatcaggaggcaggcaggcccagcagtgaactcaggaaccatcagggtgaaagtgcctctggaattttctcacaatctgttaggccctttttatggagtctggttttcaaaacctgctataagccaaatgtgtgactcacagagtaataaaggcctctaaatcaatttgtaagacatcttgaagttaaacaagaaggaaaggctgtttttgccccacatatttttttagatcctgcctacttccacaaaggatttgagatgacttccaaagcctttcttactcatgcctaagagtatttaagaactatttctgaaagttgaatccatgtgtaccatataaatagaggagaatgattatatggaaacacaaacagattggggctctctcactttatacaatagatcaactctggggaagtggttaaatgagggaagtatttggggcacttgctccagtcttcccttggttgtccttttacttccttctcccagcatctgcactctccaagtattgcctgcccttccaagcaaaacttccctgtcttgtattccatacctgcaaggaactttatttactttctaataaactctgctaataaatatgaaatagtgagtactagaggcttaatacatatgttagttgttctaatgttcaaaggaattcctacaatggtaggagagaaatttgaggccagaaataatgccattaagcatttatcccagctgggcatggtggctcacgcctgaactccaacactttgggaggccaaggtgggaggataatttgagaccaggagttcaagacaagcctgggcaacatagtgagacccctatctctaaaaaaaattgttttaaattagtcaggtgtggtgacatgtgcctgtagtcatagccacttgggaagctaagatgcaagaatcaggagtttgagtctgcagtgagctatggtcacaccactgcactccagcctgggcgatagagtgagacctcatctcttaaaacaaaacaaaaaagaagagagagagagagagagagagagagagagatccctcctatggatttaataatcatatcctgcattggggcaggggtgggttgaggtggaaaagggggtgtgaaagccatattatagagatgggcaccaagaccgagttttaaggaaagaaaaagaggccaagaaggatcactgaggaccccaaaggcaaacttggctgccttagaattttgctggggctgaggactctctggtttaaaaataaatatgaaagcaaagatattaaaggcaaagcacaaggatttacagagaaaatgagcagactgatttttagttgaaagatgtccacaatttatcactaagttattggtccaagctcatattccatcctatcactgttctcctgcacagtgacctccatactctaagcaaaccaaacttcctgagccgcacattgccaccccataccttggctcatactgttctctccagacacatttcctgctctacctctttgtccaaataggactgacttctcaagacttcattcctcctgatgttcaacagctgaagcagccataccttcctctgaacctccggaatgggttttctggacttctcttaggggacgctgttcatctggctttatcatgtatattcatgtccaagtcttctcttcccttcaaggctgcagacatcttggaaggagggcaagtcctctttatatctttactcctctcttcccatggactgagctggcccagaatcttgaaaaatagccaaccactgataaatgctttctagttaagagttcagactctggagtcaggaagttctggcagcaagcctcagcttgtgtttattacttcacctctctaagtcttggtttcctcatctgtaatcacctacttcggagttgtgttttttttttttttttagatagagtctcgctctgtcacccaggctggagtgcagtggcatgatctaggcttactgcaacctccgcctcctgggttcaagagattctcctgcctcagcctcccaagtagctgggattacaggtggccgccactgcgcccagctaatttttgtatttttagtagacacaaggtttcaccatattggccaggctggtctcgaactcctgacctcaggtgatccacctgcttcagcctctcaaaatactgggattacaggcgtgagccaccatgcccagcctggagttgtgatttttcaatgagataacccatgtagaatgcttagcatggtgcaagacacatggtatacattccacaattatttgttattgataccatttttcccttaaggaaaggtgcagtcttctctggctccctgtggcaataatccaactgagccattattccagaaggaaatcacattagggggcttttgggcaagggtttgctaaatgccctgactcacactatgtctacagtgacatttaccccatcaaaatgcagggaaagacaggaactggtttcaacttgaattcgatatttctgtggcccacatgctgaatgccaccaaagcctccactcccagagcagcagtttgtagagatggaatagtggcagtttttcattttccagagtccactcatccttccaagaatctcaatgcctcattgattcataatacagtgcataaagatttcatttttcctgcccacagtgatacattatggaggcaatctgttttgccactgaaaagtttgcttagtagaaaaatttggagttttgacattcaggaaattacagtcatctgtaaaacacgattgatatgccgaggctaacattttcattgcacttgcagagccagaataactatgataaaatatgtgttaccccacacacatttcaggatcttttagaaacattagctctgagaacctcctcccagggctccaggactagaatagctatccccattagttgtttgtttgccactcacaaggataatatctccattgacccaaccaagaatcagactgtaagacaaagtgatggctttcccgtaccaccaggttaaaggcatgaaagaaagtaaaaagatagagagataaagaattccaccccgttttggaattgttaaccagccacaaaaagcgcaggtataggttaggtagaactagaagctgaaggcttacaaaagagaaattagactgttctacatctgcctacaatttaaacttgttctctgtatttttacacccaaccttttttttttttttttttgtctctttccacatgcaattttcagtgttaaatgacatcaaaagcctagggctccggaactatccacttgttcaaaatttgatttcagaatgataaatacagttgttttagctgagagatgtagttgatttccactggcatactgagaaagtggtccattcagggtcagatttggccaggttgtgagcacttttcacttggtcctcatgcactgggacccacgggaagtgcacaaagtctgtggttccaaggcaaatgacaggtaccactgcttttgactttggaagtggcttagagtgaaccccattcagctctgggacagcttcttcaggcactgagaacacattctgcccaaagtgtgtaagtctgactcatgaatcaagcagtttttagaggtgtcattgaagtcctgcatgcaaccctatgcaaacaattattgccagtgcttactgaccttatattatgtgtcaaacacaattctaagtattaattcatttagttattacagccactctatgaggcaagtgatagaattatcatcttcactttatgaagaaactgaagcacagagtctgagcatctctcccaaagtcacactgctatctcataagaggtagagctggattcaaatcctcaacagaatggctgcagagctcatgctcatgatctatattatattgccttgcataaagaaattttataaaagccctctgttgtcagacatgctgcctggattatctcacaagtgccccatgcccatggtaggaaggctttcttgtcctcctaaaacacttggccaaacttcactctcctcctgtcccatggttaagcctcttgcatccaacaacttggcttcattcatttcctaccagtgtttgcacagatgctagaggagcaagaataaagccaatgggtatagggaggagaggagatggatgccaaagacacacttgggcaaagaccatgcctgcctaggagttttgggactctccagcaggggaataaggggaaaagtgatttcccagaggcatgttgaggattcacttgcttgtccccaggctgaagctttgggggtacccatattcagctttctctcctgctgctcacctctgggccttatttcagctgatctggccactgacaagggaaactaagagacagtggagcaaagaggactcatcagaatacaatgaggggacatagaggctggaggggtggagaagatagagggggagaaaggggagttatggcgtcaggacaggaaaaaaagatgaagagagaatggcaaaacaaccaggaggaggaggaagtcactgaaaaagaagaggggatgcacacagcatgaggtgggatgtggagaagactgagagaggaaggaaactgaggggaaaggctgatggagatgttctctctcctcacttctgtgatctcagtcctgtccatatgggcagtctgatatggtttggctgtgtccccactcaaatctcatcttgaattgtagctcccaaaatccccatacgtcgtgggagggacccagcagcaggtaattgaatcacaggggtgggttttccatgctgttcttgtgatagtgaataaatctcacaagatctgatggttttataaagggcagtccccctgcacacactgtcttgcctgctgccatggaaaacatgcctttgctcctcctttgccttccgccatgactgtgaggcctcctcagacatgtggaactgtgagtccattaaacctcttttctttataaattacccagtctcgggtatgtctttatcagcagcatgggaatggactaatacactctcctcaccaccagtagtcttccttgactgcctgctgggcaccactgaaaggctcttacgttgcacggtgttccaactagatggccttgctcttttccttctgtgagctccaggtacacttagagatgaggcctgtcttcttgtcctgaatttggacacatgacttttttttttttttttttttttaagagacagggtcttgctctgttattcagactagagtgcagagctgctatcatggctcactgcagcctcaacctcctgggctcaagtggtcctcccacttcagcgtcccaagtatcagggactacaggcacatgccaccacacctagcaggagggatatcttagaggtcatttagtccctcccccatgcaaatgaccaataagtcttcattgcttttgaccccgtactccttatctcctatcatcccctacgcacaggaggcagattcttaaaccaaaggaataaactttacattgtggattgctggccaactgtgttggggaggggctgtgcttcccagcactcctgaacttatgccaccccacaaggctggccctggttgcctgtcccattatggtgttgtagaaagctctccgctgtcatgcaaattaccttttaaaataaaatgaacaaagtggcatggggtagaaaaatgagtctggatatctagacttgggtttaaaacatatgtaacttgatgacttactggctgtgtgacctttcacctctctgtgcactaatatcagtgtctatgaaatggactggaactgtctatttctcagtcatggtgtaaggctctatgaagaagaagatgtgttttgttaaaaataaatatatatttgctataaagaactttttagaagtagaagagaaagagggtgctattcctttcaaaagatttggaataatagctctttaatccttgaaaatgaactgagaaatataaatacttatgattatttaaaaacctcaaaggtgacctgctcatcacctgaactgtgcttggtatgctgaaatgcagcaatgccagtctcccaaaaatgtacctgcccatatttcaactgtcagcacattctttccaccacgtagaaggtgaaggtcgacatgttctccctgcgtgcatttctagtaacaccttaactcatgaatgttaaatggaaggaggtgggataggggaacaacaggacttcaaaaatagccttggggaaatcaaatcttgctttaacttagtgtgttcatgaccgattcatggctctgaaaaggaaaaagtgtttgatcaaaactgtcaccaaaagacctcattttaaattcctctactttctttgagcagaaaggaataggtatcctgattatgactattgaagcaggctttacctgtgcataatagctggtctcctatattctgtgatttttggatggcctcctgccccatagaacttgccctactgctgcctgaaattctaccataagagggcatagcattgccccttaggggctgcccctttaaaatggaaatgcttctggtggtgctaagtacatgacactttgacaaaatgagtttttctaatgactttccttctaggtctcagattttgaacagactaagcccagagagagagtccagtgggggaaaggctggaagaagggggaggtgtaggaggaggaatggagaagcttggagggccgaggtctcccagctacaacaaaggaccaaagaaatagtaactaaggatgggatttcaggcctcagtggggtacatttggaggagaaggggcctcctttacccttacaagttgtattgtgggtgcagcagtctctcctgactggggaaatgccaacctggggacctgaggcactgcaccagccagaggtggagtcactttgggactcgtttcagggcctgtgtagtttaggggacaatgccctttgtttctgattggtgggaggaggaactgatgtgcagtgggatgggagaggataaaatggagcatcctgggtgatttcaaggcttcatgctagaaggctcatcaattaacccaccagtctgagttcccataaggtgctgggccctgtgttgagagacaggagagatatcaaatagtttggctcttaaggaatgtctagcctggtttgcaagacaaaataagagaaatggagtatgcagccatttatttgaggcttaatgtgcaacagagaaaacatgggggaaacactgaattgggagttaggaaacctgggttctggtcctagacccactgctgaccaactatatatccttgggaaagttgcctcctttgtttgaggttcagtttccttagctgcaaaatgggaattttatatcttgtcctgtatacttcataggattgagtgagaaactaactttataaaaacagtggaaaccttttcaaatttctcattgtgattaatcagccctccctccctcactcctatcttcccactttccctttttctgtccttccctccttccctccctcccccctttcttcctcccttccttccctctttctgtcctttctctctccctcgctccttcccatcttccttctttccttccttccttctctcaggcactgatatcaatgaattttcttcagatgacttttctgaaaaactattttgagaagggcaatgtcgtttagagtaattatctctggccttaaatccactttgcagtgagtcactatttctgagaattaagctcaattccagacaaaaaagcccaagccaggagggaaagctctgtaggtggctcacgcagcacgcaagcagatctctcttctcattgacatgtcctcacagtaaatgatgacttgaagaatctaagggaggttctgccctctagcatttgccttagttggaaagtcagggtcaggcatctgtcttaatgtgagcattgactttgagtccttttttatgggtttaaagtcttgcagtaaagaataagtgaacgtcaaccaaatagaggggttgcctttgcctaaagccgattcctgttcattggtcatcttaagggtgatattcaggaaagtgaacaaggagtcagagacttggttttgggtcccttctgtgccataaactggccaaatgaccctggatgagtccctatccttcacctctgggctttagcattctcattgctaaagtgattggagcaggtaacctctgagaggtctgccaaaccatctactctatgaaaaatatgagtttgtcactttcatctttcatttgtgagtggctctcattggttccattcacaggaaccttgcccttcatcggttggccagtttccacacatgggacatggctcttactcaacgagagagtaatccagagctcactgtatgcatggagggaggtgtggaacactctcaggctcccccttggttgaactgcccccaaccatgatgagtaaaatggcctcacccactttcagtgaagtaagatcccgttttgcacaagatgaggtttgtaaagtgcccctttaaaaaaaaaaagattctattctgtcaaaaattatggaatgttcatgctttcatcaaagtagagccatggcttatattttacaacacgcatagctgtctaatttcacatactgtttttctattctgtcacattttggacaaaaatgtcttttctctaggattcaggacattgcagtgtgatgtaaaattgcaatctggaggaatatactgtgcgtggagaagggatgatgagggcaactgccccgtgactccccaatactaggccactgatttcagggaaggtctcctttttgccttaaaggggaaacacagttgtccaaagtctctatgccatcaaaaagaaacctctgatgcacgaaacttatagaacgcttgtcagtttcagcattaacataaccttcaaaataattccttctgctcaatcaggatcttcatgtcttcagtcctccttcctgtacttgccccagtgtgacatcacattccttagctagagaggtgggatgggggatggatgagtttttttcaccacccagtattatcattgcaaagaaacaaggctgtgcctgttactgtatagaatgcttatttccccacacatgtagcccagccatgttattcagtaattatgccttttgcagcttgaatatctgaaggaaaaactttcccaggtgaaaggaggcatgaccctgccagcccttgaaattctgaatggcttcaattctttacagttcaaatggttaaaaagttctgttcccccacacccccccagaaaaagccagggtttgcacttcatatctctcagcaccttgaagcaatattagagctcattaaaatcaacccagggctcaagaagggaagccttcatttagggggaaaacttttcccctgtgctgctctggaaaatagcacaatgctgagagcaggcatttttcctgactaggtttcctctaacgatttctccaaagcacagttagggtacctgcctcccagacagcacatgtccagcaggcccaggtgaatgcgtgggactggctatcactagctcaaaattgccttaatatttattgacggcctaccatgtgaaaaaggcctcttacttgatttcttgtctctgtggaggtccctaaagaaatgattctgtgtgtctctggatttctcacaatctagagacatggaaagggagctggctatctggttcgggatccgtagaatacgaagtatggtctaaaatggtgtccagctatacccctgcccccaggcccctcagctctaaaatgctcagatcccagccctgcggttctgtaaggggcccacaaaaaccacagaattggatccctcatttcacatcccagcatatccaactgcctcctactcaaatgtcctgctgcattcaggccagttgtgctcctggcctgtgactcctgaggctgtgctcaggcacaaatgagaatgaacagcccagtgggtgagagcacacacattggaggctcagacacatctgtcagtgaggacacaaagaccaaatataaagaccagattttatcttcataaagactctatggttttcatgcattgtaaatgagaaaagtagaagcacagagaggttatttgcccaagatgacacagctagtaactgccagaactggaatttgaacacaggcagtctggctgtagatcagcattgtcaaatagaaatacaatgcaatggatgcacctggaggcgataaacgtaagcgaattaatgcaggaacagaaaaccaaatattgctgggtgtggtggctcatgcctgtaatcccaacactttgggaggtcgaggcgggcagatcacttgagatggtcaggagtttgagaccagcctggccaacatggtgaaacctcatctccactaaaaatacaaaaatcagctgggcattgtggtgcatgcctgtaatcccagctactcgggaggctaaggcaggagaatcacttaaacctgggaggtggaagttgcagtgagctgagatcgcaccacttcactccagcctaggagacagagcgagactgcatctccaaaaacaaacaaacaaaaacaaaaatccaagtatttcatgttctcgcttataagtgggagctaaacattgagcacacatgaacacaaacagggaaacaatagacaccatggactacttggttgggtgaggaaggggttgtgggttgaaaaactaccaattgggaactgtgctcaccacctgagtgatgggatccataccctaaacctcagcatcgtgcaatatatccatataacaagcctgcacatgtacccctgtatttgaaataaaagttgaaattcaaaaaaagaaatgtgatgcaagtcacctatgtaattttaaattttatagtatccacattaaaaatggggatacagatgaaattaattttaataatacattttatttaacccaatatatccacattattatttcaacatataatcagtataaataataattaattcatgagatattttctctacctctaagtcttggaaatcttagtatgcttgaaaacttaaatcacttcttagttcagactagccacatttcaagagctcagtagtcacatgttgctgatggctaccatattggacagtgcagctctagaacaagcccttttcatgatatacactgtgactaaaatgaaggcattaacacctatttgataggttttctgaaaaagcttctagcctagtgtctgacatactgtaggcacctgttaaatcaaaacatctattagtttcctgtgtgttttgctctttgctgatgtcagaatgccgtccacccaccccaccaccatacacgcacctagtcaaatcctttttgtccttcagaatccatcatattcctcctcttctatgaagccttccttgatgaccataatacagtcaactctcttctccccactcatttctcacttaatctctgtatgacacaattagcactgaaatatactgtgcctctatctgcccccgccccctccaattctaagcccgttgaaagctggcacccgtatacatgcaacttcctcaccatgcctacagctctaattatggcgacttctaggtcagagttgatacgttgttcatggattgattaaacttctgtcttgcaacccaaggccaagcccctcacctccagggctaaaagggcactatgtaccctctttgcacatgcctgtttctggattgagtttcatgaaagtaccagttttattactttttagttaagacctgaaacatgcagggttttatgtggatgtactaatcaatcaaaaggcaggaccaaagcaatggattcctgggacaagaggcactagggatgtttatctgaagagcaaaccatgatagtcccagtggggacacttagaaatttccccaacctcctcccatccactgtggcatggagcttatgattcttcccctctgtgcactcttgtttcagggttgggagaaggaagagaaccaacccctagctctggcagttccagatgccaatcctcaagggatggcaatttgacagaagatgtcacatagaaacactcagtaagctgagaagttccatatgtggagggaggagttcctagaaggaaagtcaggcaggaagcttgagtgtgttaatcagtggcagatctggtctccatgtgacttgggcagatcatatcccttcatgggaccccagtcccctaatctgcatgctgtagggtattttcataaaagtttcttccacctcaagaatacactgactattaatgaaccaagactcacaaaataattttagaatgcaaaaaattgggagaaaggcagtgtaatctacaaaatttttcatgatgtcaagcaattggatggattctgggtaaaggcctgcaactatgggtcataaagtttggaatttcacatcttgttaaagaactcagctttttcactatttgcaaaagcccttagagttatgtactttgaaacctactgggctttgggaaaaaggagagtgatttcttttaaaaagaagtaaatatcaccaggactcattgtgtgaagaattccaccttgagtttgaattcaaaggcattagaaatcttctttattttcaacaaaggaaaaaaatttctgctttgttaaagaaaaagaatcgcatagaaaaacatccttctgtttaatgaaagcccatttgtgctcctttgagcactccccacaatacacacagatgggtttacttttagttaatcagaggaaaagaatcaatgaatgaaggtgttactttatatacacagaactggtcctttgggtgaggtatgaagaagagcagaaaactccttcaaggagaactaatagcatgtttggtgggtgcaagaccttcagcctcttcagatttggttttgtgtctggtagatcttttgtctaataagtcttgcttgtctcatggatcactgtgctcccaagagttcaccttgctccccacctcctgtgggtagcccagaaagtctggctaagtcagcagcccacagcatgaacttcaaggggaaaggaagaggttcagcatccagatcatttaggtctttctagtgttgtgaagacaattaaatgaagtcatgtgtcacactgctctatgtaacccactgtctgcaaatgcaacagctcactcttctcactaggtaaagcatgactactaagccataaaacttgtgacaaatgtgccaaaaacaacacatctacaggcacgtctgtctgcttcaaagtagtccccttgtgaagtcccacacttcttttatgagactgctgccactgctgataacagcatttattaaactcctgtttggggactactaatatgagctacacaagaaaagcacttaaaacagcacctccagggcttaaggggtccagctccatcagaagcatgtttgcctttgattcaatttaccatacttttatttagtttgtgctcacatattaatattgtttgatttgaacgccttcctccttgctttgacccagtcatttacatgcaatgggaggatccatgtggttgctttagacttcattagccaaggaaggagaccagaccttcaacattaatgactcagtgtcatatacaaccaccccaactattggcagagttacttaggaccaccaaccacagttctttttctaccactcattgtttctccaagaacaagatgtgcaaaggctgaacttttatatatatatataaaatattttatatatattatatataaaatattatatataatatatatataaaatattatatataatattatatataaaatattatatatatattatatataatatattatatatatattatatataaaatattatatataatattatatatataaaataatatataatattatatatataaaatattatatatataaatatataatattttatatatatattttttatatatatatagcacatatatatgctacaggtataatagaatgttcactcctattgatttgggataagaatttgtttcctttcttaaattaactttttattgatcactcctatgaccttaactgctacgggttttctggccttcttctattaaaaaatgtctttgatatttatttcccctttgagtagtgcagggaaaaccttatcatggcctttcgtgaaccagtagcctcaaaggaaagtaaatgtttacagcatgatcctcagaactttgctcaagtaacattccctggactttcccttgatggaaatgggtgcccccagggtttctccaaggggtagagagaagatagggcttgcatccgggggcacagttggcttgtctacactctagataccacctgggatttctgagagacttctgatctctgaagccacatgcctaggacagtgattctcaaactcaactgtgtgtatatcagaatttctggatgggcttcccaaaatgcagattggcaagccccagcctctgagtttcagattcagtgagtggacctgagagtgtgcatttctaacaagttcctaaatgatgctgatgctgatggttctgggctcacactttaggaaccacttttttagttaactcatagaattagaagtcctgggcttgtgccctagcaccaggatggaaagaataccatttctagagtgagagagacctggattgaagcctgaacacacctacttaacttgaggcgtgacccagagtcacatcatctctgagtctcagtttcttcattctggaaaagggaataataatatatgattcacaggattgttgggagttaacgtataagtgtcaggcacagagcacccccagttcctggctatgtagttggtgtaagaaagtgtcctctttgagcagccaaatgtttacccttcatgggggttagtgagttctttcaggcctggttgagtgtgccatcctaggtaactagcagacacaaagagggtctgctaaaataacaggacttcggcccagaaatagttctctcaggtagattgattctcaagggctactggcaaggtgtgatttggggacaagtccttgcctgtctctctctgggcctcagtatccccacctttaaagtgaagggtttgacctaaatgatttactgtctcaaaggtttcctcctgttctgacgagtgtaggactctgtgacttagaacttgggcacttatttcagaatggtctattaaaaggagaataaaaaataagattcttgtttttaaccatttagttatttttaacgtccttaaactttccagccttcttttaaactgggatactgcacaaaaagtcagggacaacagctaaatataacaatgtccttcacagctacatctccttaaaatgctccattacaggtataaaatggtatatctgttatttcatagtgacatctagtggcttttccttatcaaagaataagatacgcattttcctatttgctcatcataagctctgctgcttctcctgcagaaattcattcaacaatcttttattaattgcttactttatgtcaaacattgtgctaggccctgaggatagatacatggttcttaccctcccagagctcatagtccagcggaagaggcagaaaaatcgcttgacaatcccagcacattgtgatacatgttacaatgggagaacaccagggcgtctggagcagagaagggggtgcttaactccatccagggaggtcaaggaaggtttcgcggaggagacagtctttgagttgagttttgaaagactttgccaggtaacctacaaaggataaatagaagccattcaaaagagtgggcactccatatacagaggcaaagcacctgtggagtcactgcctgggactttgatttggaaaattcagcatatagggtatagagcaaggttcctcaaccttggcattattggcatctgaggcagggtatttctttgttgtagggggactgtgcatgataggatatttagcaacatccctggacttgacttactagatgccagtaccaaccccctccccaagtcattacaaccaaaatatccccagatattgccaagtggcccagagttgggggtttggggagtggagatggaagatcactcacaattgagaaagacttgtatagagggagctcacttgagaaggctggacagaaagaaaggtggttgctggattccacaaggctgtctgtagcatgtggaggagcttggcttcatgtcatagttgatagggagccattgggagggcttaattagggaatgacaggtcaggtatgtgccatctgggggtgtggaagtggcatgggactggagacctgaagagtaggacgggatgctactgcaatgttttagtagagaagtgatgaaggcctgaccccaggcagtggtgcaaaggatggatttcagagctattagaaactggaaaggacttaagcgaatgtttagctcttagtagtgaggggagattagaggagtcaaggatggccctttggtttcttgcttggacaactctttcatttgttgctattatttcgacaattgcttatcagtgacaggaaaaagttggcctaaacttgtagacacaaagcaggttcactgtgcattgtttataaacttctatgggtttggtgagacagaacacactcataagcaacaagttacatgaagtgggtttattacttacagataggcagcaagggacaaaagaagcctaggatccactgtgagatggtttcccaagactcaagaaagctgcctgggtgaatgagtctcgattaagcatgcctcacttgcaccatagctgagagaccccaaaaggcagcctttcctgagttatatacctcaggggccatgtgactcatttagcaaagctttgaaggacatcctgcttctgagagaaaggaacaaaggctgggctgtcccaggcagttcctccctatctcaagatgttagattctccaggaaggactggaacaaggcttttgctgtttcaggcagttcctccctatctcaggatactgcactcccagcacattctacagttattcttaagaatgacaagcaagaatgaggggagtattgtgttggtccaaggccacccagagaactgtcattcagtagaaggtggtaaacctttaactgtgtagtgcctgtaaagtcaccatgggcatacagaagcaccaatcagccattcaattaacccatgtaacccaatggggagtcatggctccaatttaaaaatgtgacaccttgtcattttaattaggtgatacatttggtcacaagaaagtcctgtccaattactactaagtgaaacaggtggcgtatgattttcctggggctgaactggcctcattcagttaaaattcagtcagtccattcagcggcacccttcagtttcatgtcaacctgaagaaagatttccagcaactatcagagacttgctctcacctgcatcttgctctgttttgatcaatgcctgaatccaggcattgccaacaggaacaggaaagtatggtgaagatattgggggatataatcagaatgtagatgtcttttgacaggcttagatttcctccatcaagaagagattaaacagggccacaaatacactgcatcagttcctgacaatatagattgcgttccagcgtggcatatatgtgaaagtatgaaacaattgagcttactgtgtatcagtggtgtggtgtggccgccaaaatggtccatgtgatctgaggccacattaagagaaatggtgtcaagaatgaggaaggtgataggctgtcccttcttgttgcttgtcagatcgtgcttagcaggccatgttccaataaagtggaatgcacttgcaggcagacaacaggatagcggggccttgaagctatatagagaatagttgaaaaccatttttagcataaagaagagaagccctggggtaaatgctgtcttcgaatatctgaagccacacaagtggaattttaaaaaggtccctaaatagaccatgatggtctggaaattaccactttgtgctgaccactccgtaccttatcttcagcccaggttgctctctgagtgccagatctgttcattcaactctactcagatgtcccgcaggcacctcagtccttcctccagagctctaggaggcatccttaagtcctcctcctctttctcccccgaatcccttttgtcacttttacccgctaaatatttctctagtctgctcctccttctcttttgccttgtcttctgcagtggcctcttaactaacttcacgaatttcatcttcatatacataatgatctttctaaaacacagacctcatcatgtcattcccctgcttaaagcccttcaaagcctctctgttgcctgcagaattaactttgaatgctttaatatggcatctgtggcctttcacaaccaggtcctgggctccctctccatcttcaattcctgccactactccttcactccccgggaggttttttgatgcacgtttctcttgcacaataggctggtttatgcctctgtgcctctgctcatgctgatccttctgtctcatactcctttcctctctccttgactcatttttttttttttttttttgagatggagtctcacactctgtcacccaggctggagtgcagtggtgataccatggtgcactgcagcttctacctcctaggctcaagtgatcctctcgcctcagcctccctagtagctgagactacaggtgtgcaccaccacgcccactaatttttctattttttgcagagacagggtttcaccatgttgttcaggctggtcttgaactattgggttcaagtgatctgcccaccttggcctcccaaagtgctggaattacaggtgtgagccaccgtgcccagttgcctcatctaattcttgtttttcaaaataaagctgcagaaacccttgtcttatctttaggctaggttagaaatcagtgtgaggtgtttttttttaatcataccctgcacttgctccaagcattcatggcacacacaattgaaacactttccccgggtttccatgtcttatccctgtctgtatccccagtgcctgccatagtgccaggcacacattaggtgccaagactaagcaagtcttgacctgacctgaccactgagggaaaactggccatgtctctgtttgcccccgaccccagctgcattccccagcgtgcttctctgatattgccctaaaagctcttccttggatataatgagcatcctggattctttttctgacataacctccaaggtgttatctttacctgccttcctacttccaacacaccatgaaattcaggagacccctggaccctggacacctacccttcagcagatctttctttctttctacacatggaatatttctaagcagcatcaagtgctttcagttgaggcattctgggtccccaaggctatttgccctggaagaagggggctgttgacactcactgaatctctgcaggttttgtcatatgagtctaggtggctgttatcaccaaggcagcagtgtgtgtatgtgtgtgcccctctaacttctctgctgcagtgaaaatccctacagtgtagacactgaggctgcctacgttgggctgtccgtatttcttaagggcactaggtgaccttcaagttgaatgcatactggatccacacacccacaacatgagagaccctctctgaaagtctgtctctgtgttgccttctctctatccatgttggggtaggggtggtgcttatgaaacattgattgtgtcattaaccctggtggttgggatgtatttgctctgaaaggctaggaacaatgtttaggaaggagagctgcagacttccactgtggtgcactcttaatatttaccagaagatgtcactgtaggcttaaaccaatacaagaagttagggcaagaagacttccagctaagcatgaaggtgactccattttggggggttagaacaccgagcagcccccattacaatgcatgcctggaaaagctggttgaaaggttaatccaaatgtgtcacagaccttaataaatttctttttttttttttccaaataatcagactaattgccactaaactgttgcctcagggctagcataaaggctcaataagtatgcactgaatggatgagtactaaagctaggagtggaaggagggaacccagggctttagtagtcatctttgttggtaaaggctactggagaacaaaagctgctactctttagcagtggcttctcatagagatgaattttagtggcaccaacaagatcaggtcctagggaaagtagtgagacaagtgaaagtgctcttggccccttttccatcctcactcccagatgcttctcctgtgcccaatgcttgtttcttcctgaaaaaatatataaagtgatttattttaagaaaaaccttcctgtgattttttgcaaggcacttagaagattatccagagtttttatgtcatgaggcatgtccctagctctctccttcctcttccccaggatagttcatcaagtaagcagttaaagaagttactgagattctgctttatgccagggatgaaggccaatgtacaaagctggaatggatgggatgagggctatatagaagaataggacagagcccctgtccttgaaaacatagtttaagtggaaatataaacaattaattgtaattcagtatcacacatttttgggggaggcagtggggtggaggggtagggtctcactctattgctcaggctgaaatgcagtggcacaaccacagctcactgcaacctccgtctcctgggttcaagtgattctcgtgcctcagcctcctgagtagctaggattacgggagcgcacaaccacacctggctaatttttgtatttttaacagatggggtttcaccgtgttgtccaggctggtctcaaactccttacctcaagcaacccacccacctcagcctcccaaactgctgggattacaggcatgagccaccgtgcccagccccagtatcacaaatattttaacaaaggctaagtatagaagtgctatggcaacacagaggaagaaatgataactggcaacacagagtggggtacattttttcacaaaagagatggtacttgaactggtattgaaggatgagtagaattttccagccaaagagggaagatcatggcaggcagagcaagcaccatgtacaggatagaggcataggagatagatttcaggatgcctgaggtgatggaagccccagttgggagaaacgtttcctcaatgaacatcagccaatattcagttaagcaggtggctgagcaggttccctgtggctcctcatgtatgtgtagagaacaaccactccctcagatgggaatgaatatttcagaaaagttgcaagccattctccgggtttcctttaagaagctaaatgctaatattcaatgtttattgttgctttctttccacaatatgcccttctgtggcctcgtccttcatcttctgtacctgagtggtaacccatttctcatgaaaagcacaatgacacggttctctccttaagtatgcctgattgtatcatggacttgatgtttctggggcgtgtgcctaccatgtatggtgtgagtgtgttaacatgtggtttaaatgtttgctagtctgctatttgagcaaagaactttgtttgaagccctaaagagaagacagccatacagcaaagcctccacacttgctgacatccacgtgcccttttagtagataaggaaaagggacattttgaagctgctgatagagttaagtttcctatcctgggaatattatcataggagcaaaggtggaaaccaaggtagtagcttgcatacatgccattggcagctaccatgtctatttcagtcagtgactaaccacagcgtttattgctggaggccctgggctactctgcctatctctacattccacttccataatgtatgagccataatatgacaacagccagaatcaagagtatcatatcatacactcttttaatgagttttttaaaaacaaaaagatatgcagattagactggatattagaaaaaatgctattgcatatttaataagattcgaatttgaacccacttgtcaactccatttcactccaataaagtatgtgcttccaatgagtctccatttcatgatcactaaatggtttagagtggggggcatgaaataaagtggttgcctagttagccaatggtgtcattgggaagattttgtctttggttagagagggagaaaaagaggggaagggggaacgaacgggagtgaagcatgacaaggtcaatgtctggaatctaaccttttcatacctgttttagctgaagtatcagcaaattggttgaaaaaattagctatctctaggctagtgagactcagagaggggactgcagtacagtttacaggacaaatgccatcagatccctgtcatttttgctttgccttcctttttagccagtgaacaccacatatgccatgtacctccatgactccacttatttcgcccatatctctgactgttggtttttgtgcttcatccataggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattacaggct

SEQ ID NO: 5046 - DNA, 335379 bp, human; identical to SEQ ID NO: 5040

SEQ ID NO: 5047 - DNA, 329093 bp, human; identical to SEQ ID NO: 5041

SEQ ID NO: 5048 - DNA, 331310 bp, human; identical to SEQ ID NO: 5042

SEQ ID NO: 5049 - DNA, 328428 bp, human; identical to SEQ ID NO: 5043

SEQ ID NO: 5050 - DNA, 333425 bp, human; identical to SEQ ID NO: 5044

SEQ ID NO: 5051 - DNA, 331320 bp, human; identical to SEQ ID NO: 5045

SEQ ID NO: 5052 - DNA, 9160 bp, human; identical to SEQ ID NO: 3731

SEQ ID NO: 5053 - DNA, 8731 bp, human; identical to SEQ ID NO: 3732

SEQ ID NO: 5054 - DNA, 9950 bp, human
ggacggacaccaccccacgctcacgggtcctctggcggtgtcctttgagctgccgggacggcgcaaggtggctgagcgaagctttttgctcggtgcttacagggagtacctgagatggtttgggaaaggaaacagggggtctcagaccgcttgggtgcagcgctctccccatgcgtttgagtgcagatctgtcgagacgccccagccctcgccaccccaccaagctctcaggtagagaggccccgggacagggtgagccccatagtcctttggtgggcataacacagagggaggagcaattgtttacacatgtgcccagtacaagaagggaaactgatatttaagactgaagtggggaaacgggagggaaaggagcccttatcctggatgttagacgctattaaggaccatgctattttgtatttgtgagaatgatattgaaggtaaggaggtccttatccttgaagatgcatgctgaagtgtacagaagtgaaatgtcacgatgtctgcagttttcaaatgatgcagctaacatacgcacacattatgagagagagaacagaaaggaagcaagtattgcaatatgttaacagttgttgcatcctgttgggggtggggggtaaacagacgttcgttgtaccgttctttcaacttgcctaaatatttgcaaaatgccataatgaaaattttggaagagttcccttataaaatagtgcctgaatgctaagaaaatgaacgcggcttcttttcctttccctgtcccgggtgggacaaatctgcgagcaagcagggctcaaggccagcggggtctggacgggaagagcaatgggtagagccggcctgcagctgccatagccctgggcaggccaggaggggccatcggagcctcggggcagataggctgccgggcgcaaaactatgcggaggagcagccgagcgcgttggccccgggggcggtgcggggtggggacttcctggcggctctcagcaacccctggtccgaccagactcggtgggctcggctgcaccacggatgagcaaagaaaccggcgggccgcgggaactgagccgcgcgcctgcagccgtcgccacggcggcccgcggccttcccccgcattccccgagggaggccgtagttgtcgcggcctgcagacagcgcgcagggtagcccagaaccgcgtgcgggcgctgggggaaaaaaaattaggtgccgaaagaaagcagcaacgcacgcgcgcgcacacacacacgaaatcagtttacaaaaataaaaccgcggaatctgccgtgctcggcgcccgagtttgagctacttaactctcgcatgcattttactgtcatatttctgtagagctgatggaaaatctgaaatgtttttgcaagggcgatctcgcagacccaaggcgttgcaagcgttgcgcagcctttcgctggcgtctgcggctcttttccggggcgcgaggagggaaaagagtagtgtctttcagggtctgcaaagctgttttgaaaagttaaccaaaaaggttttaaatagcaagattttcttttcaggaaaagtttttaaaacggctgatactcgtccagttttggtgggcgctaaaaagtcttattactaagctacaagtttccctgttaagattttcaaaacccctcgtggacagggctgaaagtttgccgggctgtgagacgtgactgaacacgcttctaaatcctcagatagatcatttataaagctctggtgcccttgggatgaaaggcttcgctgagtttttaagacttgccttcgtgggtaaatttgcttgggttgctacacgtaagcattcatttccccacctaaattagtaaaagggcagaagattccaacgacgtaagataaaagttgggtttatggcatgttctctaaagacaaattgcaacagctttctttattaaactccttttgctacctcagcaaattggagagccagttgaatattgatgaattctttgagggtgagtaatattgctacaggccggagaaagtaagggaggacaagcttaagcatttactcaagtgaacaaccttcaaatgtttttcaactatgatgtctcaaggattttcttaggacctttgaagcaaaccctgattctgcaaatggcttcttatttggtaggcccttcccaacctgacaaaactcacaggatataaattgccctaagaagtggtgagaaacttaccctagcattggaaacaggcacagcccaccacctggggtgttaggggggcctccaactggtagtcaggcaacttctcacggggcaactaggaacctgaaatgaaaattgcacaccatctattgttttttttggtcccttctgaaatattgtttcaaggcagctgttttcaggaaaatagcacatattttcctttctctttttgttccgtgaaacgttcggaaattatattgataaggaataatcatagtccgccgagggagcaatagctttgaaggctctgaaggcacagctgagaaaaataaattagctctagactagagatactcagcaaggaagttatgcataacatggtatttggcataaattttggaaaatgttttctggaaagcaactgtgaatgaatcttgggaaatagatactggagaatcaagttgcattaaaacttatttttttgtaaattacaaagaagatttctagaactttccatttttattttaactagaaatggtgtttaagattgtgtttttaatgaaggccttgagttagggaaacaagattttccttatgttgtaaatatccagaagtctttagagagataaaatcaggatagagttacaaatttaacagaaagaaaacaactggaattgtgttatgaagcttctattgtgtttttttgtaaaggctttttttcatggttcaagcagtggctagcagtgagtagtaactgtatactataatatataatgtaagaatgcttgtcctactctcagattaaacaaaaaagacagtgtcctttggtaatttttattttatgaaattagttataaaaatagttatttgcaaaactcagaactttgggagaaaaactctaatcttaacttctcctacccccgtgatcccatcaggaaaaagtagaatgaattagtaaatttttcctttctgccaaagagaagcttagtaagtcattagtagctgttgcttttgatttctagatctcttttccctcctcaaagacgcagaatcactgccttcagtgctgcctggatttcttctttaaaccaggcttttttttttttttttctgggtgtgtactattattgtcttaattattcctggatttttgcccattaaatcaaaaattgtctcagatgacggcaatgattggaactttttgctaaggagggcgagaatgaaggggtgtaggacagtctcagcgtctctttacaccgtgctggccctatagtgcaacctgtaagtgggcaggacttgctgtcctttgcacagagcgtgaactgacagagcaaaatgtaatgacaggagcatggagaccaaaaacccatctcttgtaggtgtggtggccataatggcggttcaagtatagtactaggctagatttagtcacttgctttcaccataaaattatggtaatcagtttcacctcacacttctagaactttcctcgaacttcagctaattacgaaaaagagaaaagaaaaaccccaatatatcagtgtcaacctgtcaaatgcaatcttgttgagggaaactgaagtgcctttggaaggcacttcattgatatcaaaaaaattgaaacaaacaaacaaaaacaccaaccaaaagtgatcagcaccaaggatatcctgtaaaaagcacagagctctgctttgtgatgtctgaatgacatcgcttttgggatcttgttatgtgaaaagaaaacactcctcggggcaaataatatcttgctgggtagaaagaataggagggaacaacaaattgaagagtgctaagggatgctatccttgttcaaaaccaagatgcagctggagtgttttccaaagcatgaaatacattgttgaaatagcagagagaaagtgaatgtgcatatctgaaatgttcacatgagagatggtaacacggcatcatccagaactgaactcactcgtggttgccattctttcccctgaagctccgtttgcattttaaaaaataaaacttaagagatagagtgtcaattcgccgggcatggtggtggatgactgtaatcccagctactcgggaggctgaggcaggagaattgcttgaacccgggaggtggaggttgtagtgaaccgagatcgcaccactgcactccagcttggacacgactctgtcaaacaaacaaacaaacaaaaaaaacagcgatagagtgtctaggactgatggataatgtcatttcttttgcttcctgtttcttaaaattattcttgggcttacgatcgggtgggattttgcagttcatgaccagagtaagtcccagccctccgtgtagaagaggaagtagaaatccagatcctgtttttaattttagcatttctcctaaacccagggcttgacagcttctttagtccagagtccccaggaatgcctacgccataggcagggaagagtgaaaatgagagtagggtggagagcaagggccagggcagaagacagaaagaaagaagatgaaagaagagaaaaaaaaaaacaagtccttctcctctgtccctactatctgtcctcaagttcagagtctccacttgccaccatgatgtcatcaaggtgaccttctcaggccccccactgatctctcagttgagttctgctcctctcccagtggtccacggagttctgctgggaaaacacaattctggtcatattaatcctcggcacaaaaggcagatgactaaaaagcttaactccttaatgtggcattcagggcattctacaatctggctccaatctgcgcttctgcttgcatctcctaccctccagccacaccttctttatgtgtttatgctggatacccctgttcctcccatttccgcatccttcttaggcccagctcaaatgccacctcttccttgaagccttctcagatggcctcagagttggagttaactgcctctgtcctgtcctgtcacggcactttaattaacttagttgttctgaaattctcttcctagcagacagtaagctcctagagggtagggacatgtctgtctataggtatcttctcagcgctttgcacaataatttgcatccgttgatgtccaatacatatttgtttttttgttttgttttttttgtttgttttttgagatagaatctcactctgtcgcccagcctggagtacagtggtgccatctcggctcactacaaactccgcctcccaggttcaagcaattatcatgcctcccaaatagctgtgattacaggcacgcaccatcacactcggctaatttttgtatttttagtagaaacggggtttcaccatgttgaccaggctggtctcaaactcctgacctcaagtgattcacctgccttggcctcccaaagtgctggaattacaggcatgagccactgtgcccagccaagttagaaagaaatccaatacatatttgttaactgaacgtatacctgagaagggaaaaaaggaaccggaagaagtgagaacaaggtgctgtgctggcggtaaagatgatggctaacatcctcaagagttggcttaggcaccatttggtgttcttggtgctgaccaagggttgttgagctcatatctaacatgttggcttcacaaacatccatctgggactgacacttggaacacatcctctggaataatatagaattaatttgcttttaaattagctgctcagtactataaactctctcctgaaaatctatcaccatcattttatacttttaagcttcaagctgatccttgaagggaaggtggaatttggatggaatgggcaaaacagcattttcagaggccaggaggcagagaagaactgaaaggagatggacctagttggacagagcctttctactggggaattagagactgggctggacaagtagggtgatgtcagattattggggggtggggaggcaggcgcggtggctcacgcctgtaatcccagcactttgggaggccgagacgggtggattgcttgaggccaagagttcaagaccagcctggccaacatggtgaaaacccatctctactaaaaaatacaaaaactagccgggcatggtggcgtgtgcctgtaatcccagctactcgggaggctgaggcaggagaatggagagtagcttaaacccagggggcagaggttgcagtgagtggagatcgtgccactgcactccagcctgggtgactgagactgtctcaaaaaaaaaaaaaaaaaaaaaaaaaaaaaaaaaaaaaaaaaaaaaaaaaaagaggctgggcatggtgactcacgcctgtaatcccagcactttgggaggccaaggcaggtggatcacgaggtcaggagttcaagaccatcctgaccaagatgatgaaaccccgtctgtactaaaaatacaaaaattagccgagtatggtggcaggcgcctgtaatcccagctactcaggaggctgagacaggagaactgtttgaacccgggtagcagaggttgcagtgagccgagattgcatcactgcgctctagcctgggcgacagactgagactctgtctcaaaaaaaaaacaaaaaacattatggggggtctggaagtaggcagaggagttgtgactttagttgcaggatggtatagaacctttttttttttttttttttttttggtgtgatgcttttaaaggggcaggggcgtgatgtaatgaaagccgtgttttttaacagattcacctggcttatatggtataaccctatgaactacaaactatggtaaacctaggactatttgaataattagaatatcccattctccatgccacactggagtgaactttcttatttgagaagataaagagtggaaaaatactatttatcatatacctattatgtatcaggagatgtactggattcttcccccaccccaggtattccctccctctctcccccttccctccctccctctctcacacacttgcacttgcacacaccagaaatcccaactaggacttgattttaattgacctttaaagtaatcaattttttgttaaattactcatacaaagcatgctatgaaataccagtaaatatcgggttaaaaattaactgaaagacagaaacttactattgtgtgctgatttgatggaacagaggagtgaaaatatagtacgcaccttctggattgagactgtggttttcgtttttgtttttgttttttggtagtggcagagcttcaaactggagaatgttctttttcatgcgcagtttttaaaaattgtcattaaatattttcacaaagttaaaacaacattgaaagtaacttgggcaacttagatattccctgtacttgctgtaactcaaataccaaaacatatttagagtttaggtgcatctatcattcgaggcatgtgatttctttacctgggtgaagcgaaagaaagttaaatcgatgaaatatgaaatgaaaatgagaatcaatttgtagaatgaaccataaaagaacgagatttttgaagagattattttattttgattgcagactgtaaattatcacagggagttgctgtaggaatgacattgaggcttacttttgggtcaatttgttcctgtcctgacccacccttggcagtggagacagctagaatttctctaactccatagaaaccagtctcactgttgctttaggactcgattctctccctacactgggcttcctttagtgctttgttatgtaaatacagcttcaaaaatagaataaatattctgtaggcattacttggaaaacgagcttttattttaaagatgtgtgcttatttaagtcgcagacagagctttaaagagctcttgatagaaagaaatatatttggcgaagagtcaaaacttttaaagtaactttaaaaggtgaataatttacattcgtatagtgtttacataatagggtgtgtacgacaaagccaaaacaacattgaaaataacctgagcaatttaaatattcttcctagtaactgtaaaataaaagtgccttcgaatggtacatttgctggcaggaaatttttttcatgttcccaggtggcaaggattctttcatgttcccttatatttgaaaactggtattagcgtttacttctcggactcagaccaattcccccttacctgtcagagaacatctagcaataaatgctgacaaagctacatagcaaagggcaaacctgtcacttccctttcagaaacctgtttatgcaccctcctgcaatcccaccacctgcccaggccaagtgagcccctctccgctactggtgtttcataatgctgggagctactttgatttcatgcattgcccttcaggtaagccacaggaacctcaccactggccatgccagatggttgtgaattggataagaacaaagaaaaatggaagtagcaagtggtggggagtttagtgtactatatgacttactcatatgcaagtcaataagcaaagtcccctgcctcttgtccttggatgctggataataataaatataaatatacataatatatatgcgtacatatatacatgcatgcacacacacacagacacacattacctggatcccccacctcctcaccccactttgaaaaactttagagtatcgttggcctcatcagaattacattacattagaggattgttgaaagatttcatattactgctaatgtggggaacataattagaaccaacgttagcgcctctactcagtatcatcattgctattattttatttacatcttatgcttttttcctttggctttaactgtcttcatcaatctcctgttataaaaataaataaaagcttcctatggaattattttcaccagtcaagtcctgtaacttgttttccttgaagagggaaaatataactgatggacacaaggaaacagcagtggcatagcatgtccttttccacccagtctgtgttttgacatcagttgtatttacacacataaactgaagaacgttgcatttgtggagtttgccagtgtggtaagattgaaggggtggtaggcagcctctatgctggtccccactgatccctgccttctggtgttcccactgttctgtaatccctcctagtacgtgcgctggacctagagactcttctaacaagtagaatatggcagaagccatgggatgtcacttctgtggcttctaacttgggccttttgtcatccccttccccttctctctatcagctgccatgttatgaggacacttggagaaagctacaggagaggaactgaggtctcctgccatcagccacttgagtgagcatgggagtggattctccaaactccagttaagacttgagatgtccacagtggcagccactagcttgactgcaacttacgagagaccctgagccagaggcactcagttaagtcatacacagtttcctgacccgtaaaacctgtgacacaatgaaggtttgttgttttgggggtaatccgttattcagcaatagataacgaatacagaaggcttgtaattgtataaccaacgtgagtttataagcggatatctgacctcatttgttttctcctgaaaaagttatagaaaaatcacaagactgcaagtcactctctctctttcttttgtggggaataaacaagtataattacaatttctaaacctattgttttattctcaaatataattacaatttaaacaggatattgtagagctccatcatagggattaacactaattagaattaaagaacgtttttgtgaa

SEQ ID NO: 5055 - DNA, 14431 bp, human; identical to SEQ ID NO: 3759

SEQ ID NO: 5056 - DNA, 13501 bp, human; identical to SEQ ID NO: 3761

SEQ ID NO: 5057 - DNA, 13501 bp, human; identical to SEQ ID NO: 3761

SEQ ID NO: 5058 - DNA, 555 bp, human; identical to SEQ ID NO: 3763

SEQ ID NO: 5059 - DNA, 18356 bp, human
gttgccggtgagcttgggagaaccgtgggcgctgaggcggtgagtccccgagcggccagagggcgtggccgttccctggggcgcgggcgcgggtagcggggctcctttccgtggccggggccatgctaactgggtgattccagctgtgccccgggcggcgggcgccggaaggagtggtgggcggtgggcccctatccggccagggtccccgccaccactccctgcgacccgaccgggccttcccgggagtccttctgggctgggagctcccctccaggcgtcggggcctcgtcgcccaagagcgaacaggggccgcgcccgagacactagcatccgaatttgaatcagcttttacactttttagggacgtgtcactcttgccgttcctcaagtgctctctttacacacatcgcttttcttataggccccatgagggtggattccctacgagaaggtttggagagaaatcactggtcccacagtgaaatgaacgtttctctgggaagggtccatcgaaggaaacccgaagggtcaattccctggtagacgtggtggaaggttttgggtcagtcagggaagggctgaccagctgtgaggctggcgcagattaacgggtgggtccagagccaaaaacagcacagttcctggatgccctccagcaacggttaggtgcctagactctgggaaatagaggccccctaggaatgactcctgacaagcaataaactttaattgagtgcttcctctgtgccgggcatgctgctattcgcttcgcatgcaattggatccatgcagaacattttataaagtagatgctatgattatcttctgttacaaaagaggcactgggtgtcagggtcacacagctagcaggttattatacctaaaccgatctgctaaagtcgggctaccatcatggtaaagggggatacaaggacagagtgctgatttaggttgactggggaggaagagagtcatgagtactttttttcccttgaatcccctccagagaagaggacaactacagcagctgtctcagcacatgcagagagagaggacccaaggcacatgggcagatacaggtcttgagacctgtagaaacatgtatgtgactgtctctgtgacctcaaagactataccaagaacattttgatgtttttagaccttttgattgctggagaatatagattttgacgtaatcaccatttccctctggcatttaccatgtgaccttagacatgttgttcaatccccctaagcctcaaacctcaattccctcatctgtatccaggggataatactagtacccagctcctaaccttgggtgagggttaactgacaagtatatgtagaatgcttagaacagtacctggcacatagcatgaactcaataaatatccgttgttgtgaatgcatagcaaattcctaatggcctccctattgcagtgtatttttcacataggagatcctcttggaatgctatggtggaggggagtggggaaggaatggcatggggttactgggggaattacgcagactcggtgaggacaagaatgagagatggacaatttgctgcctttgcaaaccatggctctacctaagttcactttggtcgaaggccattaggagatacttaaagctagatggactttcagagttttttggaagtattgttagtattccttcgccatttcttttgagatctacatatattcagaaacacatgacaattggaattaaactgggaatgggttaaatgcaaagagatctataagggttcatttattaataaattcacggtccttagcctgggaccatggaattctagagcagaactgtccaatagacctttttgcagtgaagtctattaagcatttgaaatttagctaatattactgagaaactaaatttttgactaaacttaaagtgtcacatggggctgttggctaccatattggacagcaagcgcaattctagaggctttgagattttataaacttttgaaactagatgcagaaaaggatgtgtatgtgtatttttctaggaagtgagtctgaagctttcatcagattctcaaaaccaagagaaaaataaagaactactttaggtctttggtaaaaaagaagttaacaggttctttggtaaaaaagaagttgaccgaggtaagtaagccctcttgtgaccactcctgtttctcctttctcatttttttctgtccttagctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattgaaaaaaagaggaaggagaagaactgacagtgaatgtgccccacagtgcctaaaatatttactatttggctctttataaagtttgccaaccctgaatcaagtctagaaggaatataaaggaaaagaaacatagtttgttataaattgatagggatttgtacatatatgtgcttgggcctgaccgaatgtcatgaagttgtcagatgtttgcatctatgcttagaatcattgtgaatgggacagccagaaattcagactgataaagctcaagtactacgaacagtgttgctcctcgtcatgtgattttccaaaatggcatacgactctaggtaaatctgaacaataagcagtgtagtctttgcttttcacattagtgcattcctagaaaatttcatttgtgctgaaactatgcaaaacaaaacaaacaattgtacttatttgaccaacaaggtggggttcttgacaggttctttttactcacatgaatgtttgagtgggacattccacacttggtagggacctagaacaattctgcattgtaaattatgttccattaaattctgatagccaccacctgtcagcatatccaaaactccccatggggacagtggcactgtctgccattcagaatgactgtgtaaagcctcttttcagaagtgccgtgactgagagagggcagtatctttgggaaaagggagcaggagcttccagatgggcatcagggatactccagtcttgtctatgggggttctctgcaggagctgttagcttcagggctcctgaacaggagtcttctgaagttttctgtctccctagggtacttgggttggtggttgcccttcctttctctgtctccttggttttgtttactatataagattttatcttcatgtggtctagacatttgctgctgaatacagtcactactagtcatgtacagctcttgagcccttgaaatatggccaatacaaattgagatctgctgtaagtatgaaatacacaccacatgcagaagacttggtatgaaaaaagtaggtgaaatatctcactaataattgttcatattgattacatgttgaaatcctgattgtttgcactggattaagtaacacgtactattaagattggccttactttttaaaaaatttattcatatggccactagaaaatttaaaattacatgcatgattctcatacaattctactgggcactgttggtctagacttgagagtgatggttctggcatttcccccaggttgatatgcatgacatgctcttggaagaactggcaccagtgggaacggcacacataccaccaaccatgcacctagagtcacctgcactccaggtaatgggacctgcccaggaggccccagtagcagaggcatggatcccacaggcagggccaccggagctgaactatggtgctactggagaatgtcagaactttctggaccctggtaaggcaagggtttctctcctttcttttgtttctgttttgagagttcaggaactctcaagggttggggttgggttagaaacaccaattactcaatggaaattgaccactcagataaagaagaggaaaaagtctctctgggaatagtagggaacaaagcactttggatagaaccctgggattaggaaccctttaagctaatgaccctgataaggagtcttttgatcaagaatgttacacaggaaaactatgggagtttggattctggataaggactcatttctcagcccaattttaatcaacaggaactgtgatgtggtgggccccaagggcctcggttgcttttatggcatcagagccttattcaaacttaatactttagtaatatagtctatttagatcctgtaagatcaaccacttactgcagtctaaaggaaatatctacctcattaaatcaaaacctattacagtgtttttcaaactgtagtaagcagaccatttgcagcatgaacaccacaggtgcatgtttagcaagctctgcaggtgagtgctacacacactaaagtttgagaatcactggcccagacaccacagggattagttctagaaggagaaagtccaagtggagaaaggcagcacgatcacatagtccagttgctcctatattttattcccctttggggttttctattttttttttttttttttctgagacgggagtcctgctctgtcgcccaggctggagtgcagtggcgcaatctcggcgcactgtaacctccacctcccaggttcaagtgattctcctgcctcagcctctcaagtagctgggatcacaggcatgcactaccacacgtagagacggggtttcaccatgttggccaggcaggtctttaactcctgacctcaggtgatccgcctgccttggcctctcaaagtgctgggattacaggcgtgagccattacacccggcttctcctttggggttttcttacccagtgttccctgtacctcttctacccctcacattaaagctttggcccgagtgtggccagaatcctctccccgactcccccaggtactgtttcaacatgttcgcacgttcaagagactgttaaatactgagaccacagaagacacataaaaaatgaaaataagaactgtccaagttataaaatataaatgtctgatccatccataactagctcagtacccaggattaggaaccatgcccctttccacatcatattaatatcatttattcatttgtacactatctacgagcacctttgaggagccagacaccatgccagaccctggggattcagtagcacacaaggttggaaagcagctctggtcatcttggagattacagttcagtggacaattcagatatgttagtaggacgttttgtcctgtatgtaacagaaatctgacagtaaatggtatgttgggaggaataggatgcccaggagcatggaggagggccacctaaccagcttttggctgagagggaagtctggaggaaggaggatctgggttaaaacctacaggatggatcaaagtgagcctgtggagtggtgtacatgggaagcggagagggctgggatcaaaagcaacaacatgtgcaacgttctgaaggcagagagaagacctcctgctgcagtgcaagggacatagaagagcagtggggcaggagtggcaatagaagaggctggagagagaagcagggtcctgggtcacgaagaacttgcagcctcatggagaagtcacacttgattatcagggaagtggggaaccattttgaggttctccagtaccagaatgatacacacaaatttgcattttaggagattattctggctatagtaggaatggatacatactactgaaagcagggaccccatttgggaggttgttgccatcattcaggtgagaagatgttgttctagagcaagggcatgttggtgatgatggagtgaaaatgtaattcaaaagatacttagcaggtgtgaaatatagagcttggtgattgggtgtcagggtgatggagaagaagggagtaaggatggaatccaggtttctggccattgaactgggtagatggtaatgttattcactgacatgacaaacaaaagaggaagatcagattcggtgggtcaagttgagtttagatttgaacatacagagtttgaggtgcttatgggtctccagcatatttttaaataaaagtgacaaaagaggaaaactttacaagtatgcatattgtggtcaaagcagaactatatattgccatttatgttccaagctttacatcatctacatttcatagtctattgaggaattctaaaaaaaaaaaaaaaaaaaaaaaaaaacaaaaccgggtttatgtgtatatgcctggaacaagtagtaaaacttagctagtaatattttgaagtataactctttctgcatttgcattctgattctccatgttaattcgctccttttgtcaacactgcaggtacaaataccacatagtagcaatatttatctggtgttaatattttgctctctaaagcacatggaaatctagtatatttaacaaaggataggtagaattaattaatttaacagataaaaattacaaattggaggacaggaaattatccttttcttatcaccgtttaaagtgatatattatgctttgaaaaatgttgcaaggcttattttattatttaaaggttacttaaacttttactttaaacaaaagtatatttgatgtattacatgaaatacattctattgtggactgaatggaaagcacaagatgccagctgagtggaaaagaaattcaaaagtaatggaagaagtcaattgattttatattaatgtttggaacctatttcctatgagcaaaaaattaggttgttgagtatatatgaattgtgcatatatattttttcatgtaatataactgaaaacacatatacacattcattgcaaaataaaagagaacttaagtgaacaatataaagtgacctaaggaagacataaactttaaaacaaaatcccttatttgaattcatgctggacactttgatgccagagataggcaataatattagaatgtatgcaatcagaaagaaaagaggcaaggagacgctagtcttaaaaacataaaatatatcatgcttatctttgaaaatatggagttcaaaattcgtacaccaaaactggattgcattttgagttgtcaaagctttgggtttttcatttcaattgatgaggtttcatttggaatgtgtgtgaaatgtaaaagatcacatctttttggtgatgaagaatatgagagatgaaaatttaaagtaaaatacaggacaaacaaatgctgtctagaaagcatcagaagattcttataacttaaacttcttcagattattctactataccaaaaaatttaccataagctaatatctaacccccaactatagtaatgacatttcttggtgtagtgaagctcttacgagacagtctttgctaatggggtttaatgaagccattccctgagtttaggatggggggaacattcaatgaagcaccttctttgttaatctccaattgcttttccctctttgcatgggatagctattgaagggcaattaattatccccgaaacttagcagcttaaaggaaaaagtatttatcatgttactatttttgagaggaattcaggagtgatctactagatgtttatggctcagagtctctcttgtagttgttgtgaagatgtcatcagggactggcaggatgcctcaattccttgccaaaggaatttctccataggttacctaagtatctttatgatggggcagcaggcttcccccagagcaaaggatccaagagaaagcaaggaggatgacacaatgtctttgataacctacctacataccatacttataccatattctgttcattagaagagtcactaagtccaacccacacttaagtgaaggaaaaggaagttccacctcttgaaggaaagaataccgaagaatttgggagcgtattttgaatcaaccatgcctggacttaatagccttttacttaaaaaaaaaatcaaaaataatttcctttttttttcttcagttaatttttcctaagtaaaatttcttcacttaatttggtcaaatataatatacctatgatggatctcttagctatagccagaggatgagtttaacatcctgggcaatatgttattgtcactggaaaactaatattctagactatggtctcaaaaccaggagagatgattaaatttaaggtaacaggctttggtttctatctgtagggccctccttttttccttttatttttaattgacatgtaataattgtacctatttatgggatacagagtgatattttgatatgtgtgtacaatgtgtaatgatcaaatgagggtaattagcatatctgtcaccttaaacatttatcatttctttgtgtttctcattcctgtgggagctaaaaaagaaaatgagctcacagaagtagagtgtagggcccttctctttttactgaccagcagttaatgtttcttctattactgtaaaaccactcatccaataatagttgctttacagatagcttacattgagggtaaagaaaagagctccttgacagaagtaggcattaaggcctgcttttttattgccactcaacattgacccagaagccatggagccaaactagaaaacatttggagaatacttatatatgcgggtattgatatgataaatttctagaattggaattgattgattaatgggcatttaaaactttaatagatattgtcaaattgacttctgaaattattgtaccaatttatcctcccaccacaatatataggaatgccaaattctgctcatcttcacttatctttgctatgtaagagccataactgttctcgctatgttggccaacagagtagggcaaatatctgtggaaaccctttcagtaagtgtcagttttattcagcattggtggtggtattttattcaatatataagagtagaggatgggaactgatacctaaaggtgagacatgggtcaaaagtgaatgggaattggttttagctgacatggactgtgaaaataaggttgagaaatgcaaataaattggtgacagtgtccagaagtatctgaatattactcaggaccacagggttgtggtgggctgtgctacacatataagaagtgcattaggttggcatccatgaagaagctcaactatgagcaccatgttctcacatccaaggtgtagagactgtcctgatgcacccaatttggggccaagctttttgaaagctggcaccaggagtatgatgctggggacaaggaaccaaagcaaaagtactcaaacctctgtaatttggtgctgtacataaggtagcagctagacttgagggccaatatgggaagcccatgagacacagctgcctggtagtaacacttctgaccttagatctcatgggtaccagattctgcttccagggctacttttagtccttcagctaggtcgtagagcttcttttacccaaggagcaggtgtctgggcctggttttgaagtgatatttgattaaatctataaccttaagagtttcaaatctgtgctctgtaagatgagaatagccatatgaacaattcctgtcattcccaaaactgtttttctggctttcatattgagatctcctgggcctccaggcttctaccaccctaagcctttgctacttgctgctctccccagtttcaattccttctcacttctgcttgatggcagctttctttaatctatgaactccagtttatttttttccactaacttttaaaaattttttttttaatttttgtgggtacatagtaggtgtatatatttatgaggtatatgaaatattttaatacattgcatgcattgcataataatcacatcatggtaaatggggtatccatctcctcaagtatttatcctttgtgttacaaacaatccaattctactcttagttattttttaaatgtataatttctgtttttttgggggggcctcttccaccacatcattcagttatcccactcctgggtttaaaccaagctttgttaacaaaatagtgagtttataaaacattttattggaagtgtattttatatttcttaatctaaaatctattgtttttttccctgtgaaaatgtaaaataaagtattttacaccacttcctaggatttgatataatgtactgaaatctaaattttacttcagattaatgttagccaaactaatttgttaatatcatttaatgatgtcaatatttaaattttttttacatttacatctttttaaaatagcgttattgaaatataattcacataccatacattgtcacccctttgaagtgtacaatttaatgttttttggtatattcacaatatgtacaactgtcaccaccctgtaccctttagctatcactttttggcccccatctctcccactccaaagcaaccactaatttactttttgtctctgtagatttgccaattctggatatttcatataaatggaatcatacaatatgtggccttttatgactagcttctttcacttagcatattttcaaggatcaactatgttgtaacatgtatcagtactttattcctatttatggttgcatagtccattgtgacattataccacattttgtttattcattcaacagctgatgaacatttagattgtttttatattttggctattatgaatgatgctgctataaaaatttcagtatgacattttgtatttatgtatgttttcatttttcttgggtatatacctaggagcacaattgctatgtcatatggtaactctatgtttaaacttctcaggaacttctagactgttttacaaactgattgcactcttttacattccgaccagcagtgtacaagcactcttatttcttcacatcctaggcgacatttattattattatttgacatttttattctagccatcctataggtatgaaatagtgactcattgtggttttgatttgcatttctttctttgaagagtaacgatgctgaacatgctttcatgtgcttattggtcatttgtatattttcatagacctatttagtccccttgcccatttttaattgaattatttgtctttttattattgaattgtatgtgttcttcatacaggtgacccttgagcaatgtggaggttaagggtgctgacctattgtgcagttggaaatccatatacataacttttgtttctcccaaatttaactactaatagcctactgttgactagaagccttactgataacatcaatggtcaatgaacacatatttcatatgttatatttgttatatattgtattcttacaataagtaagctagagaaaagaaaatgttattaagaaaatcataaggcagagaatatatttattattcattaagtggaagtggatcattataaaggtctttatagcaacacaaatgaactaagacagtgtggtacttccataagaatagacatgtagatcaacagaatagaggagagtttagtcttgctgtctcagggctgtcagaggtggaaggaaatctgcctgtaagtgtatttgtgtagttcaaacccatgttgttcaatggtcaactgtgtattctagataaaagtcccttattagacatatgatttgccggtattttctcccgttctgtaggccatcttttcactttcttgatagtgtcctttgtagcccaaaatatttttttaattttgatgaagtcatatgtaattgttttttcttttgttgtttgtgcttttgatgtcttatctaagaaataattgcctaatccaaggtcacaaaaattttctcctgtgttttcatcgaacagttttataattttagctcttacatctaagactttgatctatttttcattaatttttaatagggtgggaggtagaggtccaaataataattttttcccgtggagacatccaggtgtctcagcattatttgttgaaaaggctattctttttatattgaatatccttgaaacccttttcaaaatcagttgaccacaggacaggtatatggatttattgctagattctcatttctattctgttatgtttagttggtttatagtattttctatgtcttgtattattgatcttctgcctagattttctgtctattagtgcaaggagttattgaagtgtccaactactattgttaaattatctggttcttgtactatttctgttgagttttgttttatatattttagtactcagaaattaagtgcatacatgattataattgttatatcttcctgatggattgatatttttatcattataaaatgatcctgtatatcttagtaacaggggtttttttgtttgttttaatgcctattttgactggctctcttgtggttgctacttgtatgatatatctttttccatccctttacattcaatcggtttgtatctttgaatctaaagtatacctcttataaacagtatatagttggatcttttcaatccagtcagaccttctctgctttctgattaagtcatttaatgtatttacatttaatttcatttgtgatatggttggatttatatctgccattttgctttctgttttctatatgcctcaagtcttttttgttcttctatccctcttttactgctttctttttcattaagtaaatatttctcatgtaatattttacttactttaataattttactacttttatttctttagtggttgctctaggatttaccatgtacatcttatcattggtttcaaagttatactaacttaatgccagtgagatatagaaatgtttctcctatgtagctctgttctcttttccccctttttgtgatattactattatacatgttacatcaaaaatgttttaaacccaagaatacattgttataattattgctttatataattttaagactcttaagaagctgaaagaagaaaggaaaatacatatatattataacttttgttatattagcattgtttatcatttctggttttcttcatttgttcctgtggatttgaattaccaactggagtcatttcttcagtcccatacactttgctcttacccacctcatttctgctgttattgggaaatatattacatttctatatgttgtatgcccagcaatacactatatacatatttttatacagttgccttttacatcttttaacaaaagaaagaagcaatactgtcttttctcattacgtaattatttttacttgtgctgctttgtcatgtggattcaaattaccattcatttagattataagtcagtattttgtacctaagcctttgctattctctcctattccaagtttcaattgaaactccatcttttacttcacagcagctttcttttgatctattaccttgaattttatttgacctgtttcatattaccctgtaatttcactcttagctttgaaatccaaatgaaaacaaaatagtgaatttaaacagcacttttatttgaaattcagctttagtttcttaatcttaaaaaggaaatttttttttcatgaaaaactaaaacaaggtattttagcccacttcctctgccttgaatataatgttctggaatttaaattttacgtcagattaacattagtcaaactaaattcctaatgtcattttaataatactaatatttaaacatcagcctacatttagatatcaaattagtaatttacagcccacatttcattgaagaccagtaaacttgatcagagataaaggaggagaataaggggctcagaaaagaggatgtaagcaacaccagctgtcaatgaggagaggggtggtcagacaaggcgagagtgagtggttggaaacttcacctggttgtccttagattgacactttgaaatactattttgtagtcattttgggttatagtcattttcacctgtataagttatctgggctaattttaagagaatccacttttagacttcagcggaaaccaacataaatgctgcttttgctaggttcaacccagttcaattttcgtttaaattcaaaagactccactgaaatttttccagtaaacactttactactttcacctctctttcttcatttggcactcaatagcagtgtttcccagtattaatatggcaaaactttatgaaatttactttatattttagctctaacctaaacaaatctagtatcaaaatagatgctgaaatgatttagtgcattgatttcagcacagaatttattcactcaccttccatagattagagaatagctttgaattgaacaccacctcattttcattttgctcttatcttttaaagaaaagactgttgtaagagactcaggtgaagtaatagtaatggagaaggaagtagatactaagaggctatctgtccaagaaatcagcctaaattttggaaaaacctttgatgagccaaactgtaatgcttcccatctttcttctggccaggatatccattaccaaaacttgacatgaacttctcattggagaatagagaagagccatgggtgaaggaattacaggattctaaagaaatgaaacaattacttgattccaagataggtaagtaattgttctttgatatactagtgggaaaaaaaaagaaaaatttaacctaaataaagagtttggaattctatttaggaatttctatgttcctgccactggtttaacataactcttcattttccttcactttcttttctccatggaacacaatatcatctgcagtttctatttcttctctcaggttttgagatcgggatagaaaatgaagaagatacttcaaaacagaaaaaaatggagactatgtatccatttattgtaactttagaggggaatgctctccagggtcccattttgcaaaaagactatgtacagttagaaaatcaatgggaaacccccccagaggatttacagacagatttagcaaaactggtagatcagcagaaccccactctgggagagacacctgagaactccaacttggaagaacctctcaaccctaaaccccacaagaaaaagagtccaggagagaaacctcaccgatgtcctcagtgtggaaaatgttttgctcggaagtcacaacttactgggcatcagagaattcattcaggagaagaacctcacaaatgccctgaatgtgggaaaagattccttcgtagttcagacctttatagacaccaacgacttcatacaggggagagaccctatgaatgcactgtatgtaaaaagcgattcactcggcggtcacatcttatagggcaccagagaacccattctgaagaagaaacatataaatgtcttgagtgtgggaaaagtttttgtcatggatcaagtcttaaaagacatctgaaaactcatacaggtgaaaaacctcatagatgtcataattgtgggaaaagttttagtcgactgacagctcttactttgcaccagagaacgcatactgaagagagaccttttaaatgtaattattgtgggaaaagttttagacagagaccaagcctcgttattcatttaagaatccacacaggggagaagccatacaagtgtactcattgttctaaaagcttcagacagagagccggccttattatgcaccaggtcactcactttagaggacttatttaagaattgctaagggaaacaggtcttacacaaattgacactaactcaaaaaaaatcttaacctgcagcaggctgtttgtcttggaagcttttgtttgagcttataagaacatagacagcttttttttttactagttttaaaacccatcttccaaggtatatgaattctagagtatttatctactcctgtgattttcttagatttgatttcttctgtctgcacaactcttctttttttaattacaatgaaaaattttgtgttccaaggcaactgtatcataggtgtaaacataaagcatataaattatgacaatccttttagaggtagggtcaatatagtggataaacctgtctatcagacgtattgattatagcagtactatagttattctgctgtcattattaaagatgattatattcattcaaagctttagatgtgtcccatgtggcaagaaaggagacagtgaattttgtcaaacaataaaaatgtgtcaggaacacaaggatgaaggggatgtcatttgcctggtaagaactgggttatttccactgaaatttgttatgtttaaggaaattaagattttaagcttgaaattatacaagcagaatctaatttaattttgattgactgaagaaccagggtcttttgctctcctttggtatttcactctcctttggtattcaatcatgtgtcttttagtgctttttaaaattttacccattctttaattcagcatctccctatgtatgtgtcatagaatacttagttctgctagatattctgcaaatatatttgggaattacttcctgctgtttcgccttcttaggttcatagtacacatcagcatatgagaatctctgagaggtcctctagaaaggagagaaaaagcacctcttttggctcaatgttttccaaacttatttgaccccaaaacctttttcatatacccaataataagctacagaactaatattctgcaaatgtctcttggaacacactgccttaaacagatatttctatagctgtcagtatagttatgttgctcccaagcctagttatctccagttgttttaagggtgttatgaaaaattcttaaaatatatatgaatttgtgtaacacacacagagacacacacacatactactttaagggggtgaggatcattaattcagataatttttaagtttcctagtgattctcaatctctttgaattttacttacatttacacacacacgcacacacatatgtatatacacatatcattttaagaagctgaggatcactaattcagataatgtataagtttcccagtgattctcaacctctttgaattttacttataattacatacacacacacactgctacttatataaatgttctcatgtaatcatggtaacagctcaaattcccaaagcaagggaagacttctcattgtcagttaaacctgttaaaacatgaaaatattcattgagcctagttccttgttataaaatacaagaaataagacattcaggcattttccctttatgaagatgttcagtcatcctttccttgaactacaattaggaaaagtatatgtctttattccattgaagttctcgagagtgatataaatactttggggggtatctactatgtgcctaactagtcctgttctaggcttagtggaagctagtaaagaaatataattcatggatcaggctcataaagattttataatatttttagttaaacaagagttgggaaacaggtggagaataatgcaagagagtttgtaattaagtgccaattataccaattgctagacccaggatgtatctttaattcttgtcatccaggtcaacatatgatgctgctataagtctggggctcaaattgatatcccagtagcaataaacatataatataggaggagtctgaatgtagagatgaaaaatacagaatgtaatggcttctcttttctctcttgtggaattgcattcaaaccagaacagtgccttagaatggatgtgcccaactgctctgtatttatgcaatatttgaataaagcggaaatgtatgtgctcttcctgc

SEQ ID NO: 5060 - DNA, 4233 bp, human
gttgccggtgagcttgggagaaccgtgggcgctgaggcggtgagtccccgagcggccagagggcgtggccgttccctggggcgcgggcgcgggtagcggggctcctttccgtggccggggccatgctaactgggtgattccagctgtgccccgggcggcgggcgccggaaggagtggtgggcggtgggcccctatccggccagggtccccgccaccactccctgcgacccgaccgggccttcccgggagtccttctgggctgggagctcccctccaggcgtcggggcctcgtcgcccaagagcgaacaggggccgcgcccgagacactagcatccgaatttgaatcagcttttacactttttagggacgtgtcactcttgccgttcctcaagtgctctctttacacacatcgcttttcttataggccccatgagggtggattccctacgagaaggtttggagagaaatcactggtcccacagtgaaatgaacgtttctctgggaagggtccatcgaaggaaacccgaagggtcaattccctggtagacgtggtggaaggttttgggtcagtcagggaagggctgaccagctgtgaggctggcgcagattaacgggtgggtccagagccaaaaacagcacagttcctggatgccctccagcaacggttaggtgcctagactctgggaaatagaggccccctaggaatgactcctgacaagcaataaactttaattgagtgcttcctctgtgccgggcatgctgctattcgcttcgcatgcaattggatccatgcagaacattttataaagtagatgctatgattatcttctgttacaaaagaggcactgggtgtcagggtcacacagctagcaggttattatacctaaaccgatctgctaaagtcgggctaccatcatggtaaagggggatacaaggacagagtgctgatttaggttgactggggaggaagagagtcatgagtactttttttcccttgaatcccctccagagaagaggacaactacagcagctgtctcagcacatgcagagagagaggacccaaggcacatgggcagatacaggtcttgagacctgtagaaacatgtatgtgactgtctctgtgacctcaaagactataccaagaacattttgatgtttttagaccttttgattgctggagaatatagattttgacgtaatcaccatttccctctggcatttaccatgtgaccttagacatgttgttcaatccccctaagcctcaaacctcaattccctcatctgtatccaggggataatactagtacccagctcctaaccttgggtgagggttaactgacaagtatatgtagaatgcttagaacagtacctggcacatagcatgaactcaataaatatccgttgttgtgaatgcatagcaaattcctaatggcctccctattgcagtgtatttttcacataggagatcctcttggaatgctatggtggaggggagtggggaaggaatggcatggggttactgggggaattacgcagactcggtgaggacaagaatgagagatggacaatttgctgcctttgcaaaccatggctctacctaagttcactttggtcgaaggccattaggagatacttaaagctagatggactttcagagttttttggaagtattgttagtattccttcgccatttcttttgagatctacatatattcagaaacacatgacaattggaattaaactgggaatgggttaaatgcaaagagatctataagggttcatttattaataaattcacggtccttagcctgggaccatggaattctagagcagaactgtccaatagacctttttgcagtgaagtctattaagcatttgaaatttagctaatattactgagaaactaaatttttgactaaacttaaagtgtcacatggggctgttggctaccatattggacagcaagcgcaattctagaggctttgagattttataaacttttgaaactagatgcagaaaaggatgtgtatgtgtatttttctaggaagtgagtctgaagctttcatcagattctcaaaaccaagagaaaaataaagaactactttaggtctttggtaaaaaagaagttaacaggttctttggtaaaaaagaagttgaccgaggtaagtaagccctcttgtgaccactcctgtttctcctttctcatttttttctgtccttagctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattgaaaaaaagaggaaggagaagaactgacagtgaatgtgccccacagtgcctaaaatatttactatttggctctttataaagtttgccaaccctgaatcaagtctagaaggaatataaaggaaaagaaacatagtttgttataaattgatagggatttgtacatatatgtgcttgggcctgaccgaatgtcatgaagttgtcagatgtttgcatctatgcttagaatcattgtgaatgggacagccagaaattcagactgataaagctcaagtactacgaacagtgttgctcctcgtcatgtgattttccaaaatggcatacgactctaggtaaatctgaacaataagcagtgtagtctttgcttttcacattagtgcattcctagaaaatttcatttgtgctgaaactatgcaaaacaaaacaaacaattgtacttatttgaccaacaaggtggggttcttgacaggttctttttactcacatgaatgtttgagtgggacattccacacttggtagggacctagaacaattctgcattgtaaattatgttccattaaattctgatagccaccacctgtcagcatatccaaaactccccatggggacagtggcactgtctgccattcagaatgactgtgtaaagcctcttttcagaagtgccgtgactgagagagggcagtatctttgggaaaagggagcaggagcttccagatgggcatcagggatactccagtcttgtctatgggggttctctgcaggagctgttagcttcagggctcctgaacaggagtcttctgaagttttctgtctccctagggtacttgggttggtggttgcccttcctttctctgtctccttggttttgtttactatataagattttatcttcatgtggtctagacatttgctgctgaatacagtcactactagtcatgtacagctcttgagcccttgaaatatggccaatacaaattgagatctgctgtaagtatgaaatacacaccacatgcagaagacttggtatgaaaaaagtaggtgaaatatctcactaataattgttcatattgattacatgttgaaatcctgattgtttgcactggattaagtaacacgtactattaagattggccttactttttaaaaaatttattcatatggccactagaaaatttaaaa

SEQ ID NO: 5061 - DNA, 3987 bp, human
gttgccggtgagcttgggagaaccgtgggcgctgaggcggtgagtccccgagcggccagagggcgtggccgttccctggggcgcgggcgcgggtagcggggctcctttccgtggccggggccatgctaactgggtgattccagctgtgccccgggcggcgggcgccggaaggagtggtgggcggtgggcccctatccggccagggtccccgccaccactccctgcgacccgaccgggccttcccgggagtccttctgggctgggagctcccctccaggcgtcggggcctcgtcgcccaagagcgaacaggggccgcgcccgagacactagcatccgaatttgaatcagcttttacactttttagggacgtgtcactcttgccgttcctcaagtgctctctttacacacatcgcttttcttataggccccatgagggtggattccctacgagaaggtttggagagaaatcactggtcccacagtgaaatgaacgtttctctgggaagggtccatcgaaggaaacccgaagggtcaattccctggtagacgtggtggaaggttttgggtcagtcagggaagggctgaccagctgtgaggctggcgcagattaacgggtgggtccagagccaaaaacagcacagttcctggatgccctccagcaacggttaggtgcctagactctgggaaatagaggccccctaggaatgactcctgacaagcaataaactttaattgagtgcttcctctgtgccgggcatgctgctattcgcttcgcatgcaattggatccatgcagaacattttataaagtagatgctatgattatcttctgttacaaaagaggcactgggtgtcagggtcacacagctagcaggttattatacctaaaccgatctgctaaagtcgggctaccatcatggtaaagggggatacaaggacagagtgctgatttaggttgactggggaggaagagagtcatgagtactttttttcccttgaatcccctccagagaagaggacaactacagcagctgtctcagcacatgcagagagagaggacccaaggcacatgggcagatacaggtcttgagacctgtagaaacatgtatgtgactgtctctgtgacctcaaagactataccaagaacattttgatgtttttagaccttttgattgctggagaatatagattttgacgtaatcaccatttccctctggcatttaccatgtgaccttagacatgttgttcaatccccctaagcctcaaacctcaattccctcatctgtatccaggggataatactagtacccagctcctaaccttgggtgagggttaactgacaagtatatgtagaatgcttagaacagtacctggcacatagcatgaactcaataaatatccgttgttgtgaatgcatagcaaattcctaatggcctccctattgcagtgtatttttcacataggagatcctcttggaatgctatggtggaggggagtggggaaggaatggcatggggttactgggggaattacgcagactcggtgaggacaagaatgagagatggacaatttgctgcctttgcaaaccatggctctacctaagttcactttggtcgaaggccattaggagatacttaaagctagatggactttcagagttttttggaagtattgttagtattccttcgccatttcttttgagatctacatatattcagaaacacatgacaattggaattaaactgggaatgggttaaatgcaaagagatctataagggttcatttattaataaattcacggtccttagcctgggaccatggaattctagagcagaactgtccaatagacctttttgcagtgaagtctattaagcatttgaaatttagctaatattactgagaaactaaatttttgactaaacttaaagtgtcacatggggctgttggctaccatattggacagcaagcgcaattctagaggctttgagattttataaacttttgaaactagatgcagaaaaggatgtgtatgtgtatttttctaggaagtgagtctgaagctttcatcagattctcaaaaccaagagaaaaataaagaactactttaggtctttggtaaaaaagaagttaacaggttctttggtaaaaaagaagttgaccgaggtaagtaagccctcttgtgaccactcctgtttctcctttctcatttttttctgtccttagctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattgaaaaaaagaggaaggagaagaactgacagtgaatgtgccccacagtgcctaaaatatttactatttggctctttataaagtttgccaaccctgaatcaagtctagaaggaatataaaggaaaagaaacatagtttgttataaattgatagggatttgtacatatatgtgcttgggcctgaccgaatgtcatgaagttgtcagatgtttgcatctatgcttagaatcattgtgaatgggacagccagaaattcagactgataaagctcaagtactacgaacagtgttgctcctcgtcatgtgattttccaaaatggcatacgactctaggtaaatctgaacaataagcagtgtagtctttgcttttcacattagtgcattcctagaaaatttcatttgtgctgaaactatgcaaaacaaaacaaacaattgtacttatttgaccaacaaggtggggttcttgacaggttctttttactcacatgaatgtttgagtgggacattccacacttggtagggacctagaacaattctgcattgtaaattatgttccattaaattctgatagccaccacctgtcagcatatccaaaactccccatggggacagtggcactgtctgccattcagaatgactgtgtaaagcctcttttcagaagtgccgtgactgagagagggcagtatctttgggaaaagggagcaggagcttccagatgggcatcagggatactccagtcttgtctatgggggttctctgcaggagctgttagcttcagggctcctgaacaggagtcttctgaagttttctgtctccctagggtacttgggttggtggttgcccttcctttctctgtctccttggttttgtttactatataagattttatcttcatgtggtctagacatttgctgctgaatacagtcactactag

SEQ ID NO: 5062 - DNA, 3814 bp, human; identical to SEQ ID NO: 3765

SEQ ID NO: 5063 - DNA, 5674 bp, human; identical to SEQ ID NO: 3766

SEQ ID NO: 5064 - DNA, 9625 bp, human
gtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacactgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggtcactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttatgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttcttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttacttttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgactcaaaaaaaaaaaaaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttatttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatacatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacatttccattaacttctcagcagcatttgacagttgtttactggcttcttcatgaaaaccttctaggatttccatttccgacaatctttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcatgctgcctgccacagacgatgaataaatgagaggtgtcagacctggagtgaaaagaaagtcacttttgtgagacagaaaggaaggatgaggaaaatcatacactaaaagggattttttgttgatggagtacgtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagttttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaagtggggtttctatcacctcaagcttttatcctttgcgttacagagaatacaattatactcttcattatttttaaatgtgcaattaaattattaccaactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctatggtgtatatgtaccatattttctttacccattcacgtgttagtggacacttaggttgcttccaaatcttggctactgtgaatggtggtgcaggaaacatgggagtgcagatatctcttcggtacactgacttcctttctcttgggtatatacccagcagtgggattgctggatcatatgatagctccatttttagttgtttgaggaacctccaaactgttcttcatagttgttgtagtaatttatgttcccaccaacagtgtatgagggttcccttttctccacacccttgccagcatttgttatgccggctagactgcctcttaccatgcagatacatttctatttccatgctgactgttacttcatctttctatctgtcacagcgcttcctacagcataggttctttggctatcttttggttaatgacatgtctctttctcttcagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaagcgttttatttgaaaggataacttgtgttttggttattttgtattcccacctgtgctggtagatattattaacccattaggtaaatactattacagtcgtggtttctgcagcagctcacactgatgtagctggcgtttataactaccttctttcgctacccgtttcgcattccctttgccctgagatagcatgtcagttggtcatgatgcttggcctggcaggatgactcaaaccttcattacggaagagtctgaaccattagatatcctgcctggatggggttgctgtgattttccattaactctaatcgaaaaacacgggaggactaagaagctctctagacatatcacacatactcttccttagcccctcgtgtggtgggaacccgatctcaatgttgaaatctgtatcatcagccttcaacgaaaaggcagaactaatgggagattttaatgtgtgtgtgtgtgtgtgtgtgtgtgtgtgtgtgtgtgtgtgtgtgtgtgttggtagggggtatatatacatgcacacacacactttctaatctcccattatacatataatacacattacacatattatatatacacccccatatatatatatgtatgcgtgtgtgggggggtatatccaatatatataataaaggtagttcctagataggattggtctgatacaataatttggagctgcagtagcagtccctgtaaggctgttgtttccagatacgacttgaacattctatgctttttattttttttaaagacagaatcttgctctgttgcccaggctagagtgcggtgacacgatcacaagtcactgccacctcgacctcaccccagttcaagcgatccttgtgcttcagccttcgaagtagctgggattacaggtgcaccacaggtgccatcacgctgcaatttttgtatttttagtggagatggggttttgccatgttgtccaggctggtctcgaaacctggcctcaagtgatctgcccatctcagcctcccaaggttctaggattacaggcatgagccactgcacccagcccattctatgcttttttttaaaaaattaattcattcaattattcaacaaatattaattgtgccaggtacttttttttattatactttaaggtttagggtacatgtgcacaacgtgcaggtttgttacatatgtatacatgtgccatttttgtgtgctgcacccattaactcatcatttaacattaggtatatctcctaatgctatccctcccccctccccacaccccacaacaggacccagtgtgtgatgttccccttcctgtgtccatgtgttctcattgttcagttcccacctatgagggagaacatgcggtgtttggttttttgtccttgcgatagtttgctgagaatgatggtttccagcttcatccatgtccctacaaaggacatgaactcatcatttttcatggctgcatagtattccatggtgtatatgtgccacgttttcttaatccagtctatcattgttggacatttgggttggttccaagtctttgctattgtgaatagtgccacaataaacatacgtgtgcatgtgtc

SEQ ID NO: 5065 - DNA, 8036 bp, human
gtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacactgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggtcactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttatgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttcttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttacttttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgactcaaaaaaaaaaaaaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttatttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatacatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacatttccattaacttctcagcagcatttgacagttgtttactggcttcttcatgaaaaccttctaggatttccatttccgacaatctttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcatgctgcctgccacagacgatgaataaatgagaggtgtcagacctggagtgaaaagaaagtcacttttgtgagacagaaaggaaggatgaggaaaatcatacactaaaagggattttttgttgatggagtacgtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagttttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaagtggggtttctatcacctcaagcttttatcctttgcgttacagagaatacaattatactcttcattatttttaaatgtgcaattaaattattaccaactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctatggtgtatatgtaccatattttctttacccattcacgtgttagtggacacttaggttgcttccaaatcttggctactgtgaatggtggtgcaggaaacatgggagtgcagatatctcttcggtacactgacttcctttctcttgggtatatacccagcagtgggattgctggatcatatgatagctccatttttagttgtttgaggaacctccaaactgttcttcatagttgttgtagtaatttatgttcccaccaacagtgtatgagggttcccttttctccacacccttgccagcatttgttatgccggctagactgcctcttaccatgcagatacatttctatttccatgctgactgttacttcatctttctatctgtcacagcgcttcctacagcataggttctttggctatcttttggttaatgacatgtctctttctcttcagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaa

SEQ ID NO: 5066 - DNA, 7836 bp, human
cgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacactgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggtcactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttatgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttcttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttacttttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgactcaaaaaaaaaaaaaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttatttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatacatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacatttccattaacttctcagcagcatttgacagttgtttactggcttcttcatgaaaaccttctaggatttccatttccgacaatctttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcatgctgcctgccacagacgatgaataaatgagaggtgtcagacctggagtgaaaagaaagtcacttttgtgagacagaaaggaaggatgaggaaaatcatacactaaaagggattttttgttgatggagtacgtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagttttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaagtggggtttctatcacctcaagcttttatcctttgcgttacagagaatacaattatactcttcattatttttaaatgtgcaattaaattattaccaactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctatggtgtatatgtaccatattttctttacccattcacgtgttagtggacacttaggttgcttccaaatcttggctactgtgaatggtggtgcaggaaacatgggagtgcagatatctcttcggtacactgacttcctttctcttgggtatatacccagcagtgggattgctggatcatatgatagctccatttttagttgtttgaggaacctccaaactgttcttcatagttgttgtagtaatttatgttcccaccaacagtgtatgagggttcccttttctccacacccttgccagcatttgttatgccggctagactgcctcttaccatgcagatacatttctatttccatgctgactgttacttcatctttctatctgtcacagcgcttcctacagcataggttctttggctatcttttggttaatgacatgtctctttctcttcagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagat

SEQ ID NO: 5067 - DNA, 8033 bp, human
gtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacaccgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggacactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttgtgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttctttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttaattttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattcttttttatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgactcaaaaaaaaaaaaaaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttatttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatctttttttttttttaatttcttgtccgtattggtgaatccctatcatttttttcttgagatggactttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttgtcttctcttctctaaatactgtaaaaaattcctgaaccccagcatctctctccctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttctccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacactaaaagggattttttgttgatggagtacatatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcagcttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaagtaagtaatataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagttttttttttttcaacatcttcagaatatgaaaaaatcttcgaaatgcttgaaggagtgcaaggacctactgcagtcaggaagcgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtgtaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaagtggggtttctatcacctcaagcttttatcctttgcgttacagagaatacaattatactcttcattatttttaaatgtgcaattaaattattaccgactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaa

SEQ ID NO: 5068 - DNA, 7809 bp, human
cgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacaccgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggacactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttgtgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttctttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttaattttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattcttttttatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgactcaaaaaaaaaaaaaaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttatttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatctttttttttttttaatttcttgtccgtattggtgaatccctatcatttttttcttgagatggactttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttgtcttctcttctctaaatactgtaaaaaattcctgaaccccagcatctctctccctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttctccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacactaaaagggattttttgttgatggagtacatatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcagcttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaagtaagtaatataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagttttttttttttcaacatcttcagaatatgaaaaaatcttcgaaatgcttgaaggagtgcaaggacctactgcagtcaggaagcgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtgtaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaagtggggtttctatcacctcaagcttttatcctttgcgttacagagaatacaattatactcttcattatttttaaatgtgcaattaaattattaccgactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggct

SEQ ID NO: 5069 - DNA, 9905 bp, human
gtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacaccgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggacactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttgtgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttctttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttaattttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattcttttttatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgactcaaaaaaaaaaaaaaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttatttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatctttttttttttttaatttcttgtccgtattggtgaatccctatcatttttttcttgagatggactttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttgtcttctcttctctaaatactgtaaaaaattcctgaaccccagcatctctctccctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttctccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacactaaaagggattttttgttgatggagtacatatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcagcttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaagtaagtaatataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagttttttttttttcaacatcttcagaatatgaaaaaatcttcgaaatgcttgaaggagtgcaaggacctactgcagtcaggaagcgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtgtaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaagtggggtttctatcacctcaagcttttatcctttgcgttacagagaatacaattatactcttcattatttttaaatgtgcaattaaattattaccgactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaagcattttatttgaaaggataacttgtgttttggttattttgtattcccacctgtgctggtagatattattaacccattaggtaaatactattacagtcgtggtttctgcagcagctcacagtgttgtagctggtatttatcactacgttctttcgctacccatttcacattccctttgccctgagatagcatgtcagttggtcatgatgcttggcctggcaggatgactcaaaccttcattacggaagagtctgaaccattagatgtcctgcctggatggggttgctgtgatcttccattaactctaatcgaaaaacacgggaggactaagaagctctctagacatatcacacatactcttccttagcccctggtgtagtgggaacccgatctcaatgttgaaatctgtatcatcagccttcaacgaaaaggcagaactaatgggagattttaatgtgtgtgtgtgtattttacacacacacacattaaaatacacacacactttaaaatctcccattatacatgtaatgcacattatacctgtgtgtgtgtgtgtgtgttggtagggggtatatatacctacacacacacactttgtaatctcccattatacatataatacacattatacacattacacatattacatatacacccctattcatatatatataccccatatatatatataccatatatagtatatatataccatatatagtatatatatatatatatatgtggtatatatatatatatataccatatatagtatatatatatatatatgtggtatatatatatatataccatatatatatatatatatgcacgtagggtggtatatccaatatatataataaattatatatatatccaatatatataataaattatatatatatccaatatatataataaaggtagttcctagataggattggcctgataacaataatttggagcttcagtagcagtccctttaagactgttgtctccagatatgacttgcacattctatgctttttattttatttttttaagacagaatcttgctctgttgcccaggctagagtgcagtgtcacgatcacaagtcactgcaacctccagctcaccccagttcaagcgatccttgtgcttcagcctcccaagtagctgggattacaggtgcaccacaggtgccatcacgctgctaatttttgcatttttagtggagatggggttttgccatgttgtccaggctggtctcgaaacctggcctcaagtgatctgcccatctcagcctcccaaggtgctaggattacaggcatgagccactgcacccagcccattctatgctttttttaaaattaattcattcattgattcaacaaatattaattgttccaggtacttttcttttttttattattatactttaagttttagggtacatgtgcacaacgtgcaggtttgttacatatgtatacatgtgccaagttggtgtgcttcacccataaactcgtcatttaacattaggtatatctcctaatgctatccctcccccctccccacaccccacaacaggccccggtgtgtgatgttccccttcctgtgtccatgtggtctcattgttcaattcccacctacgagtgagaacatgcggtgtttggtttttgtccttgggatagtttgctgagaatgatggtttccagcttcatccatgtccctacaaaggacatgaactcatcatttttcatggctgcatagtattccatggtgtatatgtgccacattttcttaatccagtatatcactgatggacatttgggttggttgcaagtctttgctattgtgaatagtgccgcaataaatatacgtgtgcatgtgtc

SEQ ID NO: 5070 - DNA, 4286 bp, human
tgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatctttttttttttttaatttcttgtccgtattggtgaatccctatcatttttttcttgagatggactttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttgtcttctcttctctaaatactgtaaaaaattcctgaaccccagcatctctctccctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttctccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacactaaaagggattttttgttgatggagtacatatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcagcttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaagtaagtaatataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagttttttttttttcaacatcttcagaatatgaaaaaatcttcgaaatgcttgaaggagtgcaaggacctactgcagtcaggaagcgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtgtaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaagtggggtttctatcacctcaagcttttatcctttgcgttacagagaatacaattatactcttcattatttttaaatgtgcaattaaattattaccgactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttccca

SEQ ID NO: 5071 - DNA, 9947 bp, human
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacactgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggtcactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttgtgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttctttttttttttttaagcaccattttatgtgtttattggtcatttaactatgccttttatgaagttccttttcaggtattttcccccagcttttactgagatgtttgtattttaaaaatggatgtgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttacttttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaacgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgtgttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagagtaagtaagcctgtcctcatgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatcttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacacacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcatgctgcctgccacagacgatgaataaatgagaggtgtcagacctggagtgaaaagaaagtcacttttgtgagacagaaaggaaggatgaggaaaatcatacactaaaagggattttttgttgatggagtacgtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaaatggggtttctatcacctcaagcttttatcctttgcgttacagagaatacaattatactcttcattatttttaaatgtgcaattaaattattaccaactatagtcaccctgttgggctatcaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaagcattttatttgaaaggataacttgtgttttggttattttgtattcccacctgtgctggtagatattattaacccattaggtaaatactattacagtcgtggtttctgcagcagctcacagtgttgtagctggtatttatcactacgttctttcgctacccatttcacattccctttgccctgagatagcatgtcagttggtcatgatgcttggcctggcaggatgactcaaaccttcattacggaagagtctgaaccattagatgtcctgcctggatggggttgctgtgatcttccattaactctaatcgaaaaacacgggaggactaagaagctctctagacatatcacacatactcttccttagcccctggtgtagtgggaacccgatctcaatgttgaaatctgtatcatcagccttcaacgaaaaggcagaactaatgggagattttaatgtgtgtgtgtgtattttacacacacacacacattaaaatacacacacactttaaaatctcccattatacatgtaatgcacattatacctgtgtgtgtgtgtgtgtgttggtagggggtatatatacctacacacacacactttgtaatctcccattatacatataatacacattatacacattacacatattacatatacacccctattcatatatatataccccatatatatatataccatatatagtatatatataccatatatagtatatatatatatatatatatgtggtatatatatatatatataccatatatagtatatatatatatatatatgtggtatatatatatatataccatatatatatatatatatgcacgtagggtggtatatccaatatatataataaattatatatatatccaatatatataataaattatatatatatccaatatatataataaattatatatatatccaatatatataataaaggtagttcctagataggattggcctgataacaataatttggagcttcagtagcagtccctttaagactgttgtctccagatatgacttgcacattctatgctttttattttatttttttaagacagaatcttgctctgttgcccaggctagagtgcagtgtcacgatcacaagtcactgcaacctccagctcaccccagttcaagcgatccttgtgcttcagcctcccaagtagctgggattacaggtgcaccacaggtgccatcacgctgctaatttttgcatttttagtggagatggggttttgccatgttgtccaggctggtctcgaaacctggcctcaagtgatctgcccatctcagcctcccaaggtgctaggattacaggcatgagccactgcacccagcccattctatgctttttttaaaattaattcattcattgattcaacaaatattaattgttccaggtacttttcttttttttattattatactttaagttttagggtacatgtgcacaacgtgcaggtttgttacatatgtatacatgtgccaagttggtgtgcttcacccataaactcgtcatttaacattaggtatatctcctaatgctatccctcccccctccccacaccccacaacaggccccggtgtgtgatgttccccttcctgtgtccatgtggtctcattgttcaattcccacctacgagtgagaacatgcggtgtttggtttttgtccttgggatagtttgctgagaatgatggtttccagcttcatccatgtccctacaaaggacatgaactcatcatttttcatggctgcatagtattccatggtgtatatgtgccacattttcttaatccagtatatcactgatggacatttgggttggttgcaagtctttgctattgtgaatagtgccgcaataaatatacgtgtgcatgtgt

SEQ ID NO: 5072 - DNA, 7844 bp, human
gcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacactgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggtcactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttgtgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttctttttttttttttaagcaccattttatgtgtttattggtcatttaactatgccttttatgaagttccttttcaggtattttcccccagcttttactgagatgtttgtattttaaaaatggatgtgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttacttttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaacgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgtgttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagagtaagtaagcctgtcctcatgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatcttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacacacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcatgctgcctgccacagacgatgaataaatgagaggtgtcagacctggagtgaaaagaaagtcacttttgtgagacagaaaggaaggatgaggaaaatcatacactaaaagggattttttgttgatggagtacgtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaaatggggtttctatcacctcaagcttttatcctttgcgttacagagaatacaattatactcttcattatttttaaatgtgcaattaaattattaccaactatagtcaccctgttgggctatcaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgtt

SEQ ID NO: 5073 - DNA, 8040 bp, human
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacactgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggtcactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttgtgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttctttttttttttttaagcaccattttatgtgtttattggtcatttaactatgccttttatgaagttccttttcaggtattttcccccagcttttactgagatgtttgtattttaaaaatggatgtgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttacttttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaacgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgtgttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagagtaagtaagcctgtcctcatgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatcttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacacacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcatgctgcctgccacagacgatgaataaatgagaggtgtcagacctggagtgaaaagaaagtcacttttgtgagacagaaaggaaggatgaggaaaatcatacactaaaagggattttttgttgatggagtacgtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaaatggggtttctatcacctcaagcttttatcctttgcgttacagagaatacaattatactcttcattatttttaaatgtgcaattaaattattaccaactatagtcaccctgttgggctatcaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaa

SEQ ID NO: 5074 - DNA, 25297 bp, human
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacaccgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggacactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttatgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttcttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttaattttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggcaggaatatttttctccatttactgcagtcttgaatttctctgagtgatgttttataatttttgtgaagtactctagcacatcttgattagatttattcctaaatgtttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacatttccattaacttctcagcagcatttgacagttgtttactggcttcttcatgaaaaccttctaggatttccatttccgacaatctttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagaaacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccatagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacagtaaaagggactttttggtggtggagtgcgtatagaacttttagcagtaatggccgcctctattttctcagaatgtgtttgatataacaggagaccggttgagttgtatcccagttgcctgggttccagctcagtaaagcatggcagtttgtaagtgagtttgagaaatcatgatatcaagtgagacttgctgctttcaacttgtaaagcataacaagctgaaactgtcccatgagtaccagggatctgtgaatgttgctttagagttgtactgccttacttggtttccatatctattcaaggcgacagaaaataggaggtggttttattgtattatgtgtcctggcctccgtttgtcaggcctgggatttctccctggtgtatcctcccatttatgaaataaataattccctagaaactgaggagcacatagatgtacccagaggggtgatgaaacacacgtatctcacagctcaacttctcagtttgatttccagatctgtcattcatgaggtttatgtggaggggaaagaaagtggtcaaacaccaactgatggcttttactcaaaatctgtttcaccagagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaagtaagtagtgtaagaacgtctgttttataaaactgtaggaagtcactctttctatgattcagaagatatccatgttacctcttgaggctcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagtactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacggacaacaatgtgtaataatcacatcaaggtaagtggggtttctatcacctcaagcttttatcctttgcgttacagagaatacaattatactcttcattatttttaaatgtgcaattaaattattaccaactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctatggtgtatatgtaccatattttctttacccattcacgtgttagtggacacttaggttgcttccaaatcttggctactgtgaatggtggtgcaggaaacatgggagtgcagatatctcttcggtacactgacttcctttctcttgggtatatacccagcagtgggattgctggatcatatgatagctccatttttagttgtttgaggaacctccaaactgttcttcatagttgttgtagtaatttatgttctcaccaacagtgtatgagggttcccttttctccacacccttgccagcatttgttatgccggctagactgcctcttaccatgcagatacatttctatttccatgctgactgttacttcatctttctatctgtcacagcgcttcctacagcataggttctttggctatcttttggttaatgacatgtctctttctcttcagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaagcgttttatttgaaaggataacttgtgttttggttattttgtattcccacctgtgctggtagatattattaacccattaggtaaatactattacagtcgtggtttctgcagcagctcacactgatgtagctggcgtttataactaccttctttcgctacccgtttcgcattccctttgccctgagatagcatgtcagttggtcatgatgcttggcctggcaggatgactcaaaccttcattacggaagagtctgaaccattagatatcctgcctggatggggttgctgtgattttccattaactctaatcgaaaaacacgggaggactaagaagctctctagacatatcacacatactcttccttagcccctcgtgtggtgggaacccgatctcaatgttgaaatctgtatcatcagccttcaacgaaaaggcagaactaatgggagattttaatgtgtgtgtgtgtgtgtgtgtgtgtgtgtgtgtgtgtgtgtgttggtagggggtatatatacatgcacacacacactttctaatctcccattatacatataatacacattacacatattatatatacacccccatatatatatatgtatgcgtgtgtgggggggtatatccaatatatataataaaggtagttcctagataggattggtctgatacaataatttggagctgcagtagcagtccctgtaaggctgttgtttccagatacgacttgaacattctatgctttttattttttttaaagacagaatcttgctctgttgcccaggctagagtgcggtgacacgatcacaagtcactgccacctcgacctcaccccagttcaagcgatccttgtgcttcagccttcgaagtagctgggattacaggtgcaccacaggtgccatcacgctgcaatttttgtatttttagtggagatggggttttgccatgttgtccaggctggtctcgaaacctggcctcaagtgatctgcccatctcagcctcccaaggttctaggattacaggcatgagccactgcacccagcccattctatgctttttttaaaaaaattaattcattcaattattcaacaaatattaattgtgccaggtacttttttttattatactttaaggtttagggtacatgtgcacaacgtgcagggttgttacatatgtatacatgtgccatttttgtgtgctgcactcattaactcatcatttaacattaggtatatctcctaatgctatccctcccccctccccacaccccacaacaggacccagtgtgtgatgttccccttcctgtgtccatgtgttctcattgttcagttcccgcctatgagtgagaacatgcggtgtttggttttttgtccttgcgatagtttgctgagaatgatggtttccagcttcatccatgtccctacaaaggacatgaactcatcatttttcatggctgcatagtattccatggtgtatatgtgccacgttttcttaatccagtctatcattgttggacatttgggttggttccaagtctttgctattgtgaatagtgccacaataaacatacgtgtgcatgtgtctttatagcagcatgttttataatcctttgggtatatactcagtaatgggatggctgggtcaaatggtatttctagttctagatccctgaggaatcgccacactgacttccacaatggttgaactagtttacagtcccaccaacagtgtaaaagtgttcctatttgtccacatcctctccagcacctgttgtttcctgactttttaatgattgccattctaactggtgtgagatggtatctcattgtggttttgatttgcatttatctgatggccagtgatgatgagcatgttttcatgtgtctgttggctgcataaatgtcttcttttgagaagtatctgttcatatccttcgcccgcttgttgatggggttgtttgtttttttcttgtaaatttgtttgagttcattgtagattctggatattagccctttgtcagatgagtagactgcaaaaatttcctcccattctgtaggttgcctgttcactctgatggtagtttcttttgccgtgcagaaactctttagtttaattagatcccatttgtcaattttgacttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaagtgtaaggaagggatcccatttcagctttctccatatggctagccagttttcccagcaccatttattaaatagggaatcctttccccatttcttgtttttgtcaggtttgtcaaagatcagatagttgtagatatgcagcattatttctgagggctctgttctgttccattggtctgtatctctgttttgataacagtaccatgctgttttggttactgtagacttgtagtatagtttgaagtcaggtagcgtgatgcctccagctttgttcttttggcttaggattgacttggcaatgcgggctcttttttggttccaaaatcagtgtgcaaaaatcacaagcattcttatacaccagtaacagacaaacagagagccaaatcatgagtgaactcccatgcacaattgcttcaaagataataaaatacctaggaatccaacttacaagggacgtgaaggacctcttcaaggagaactacaaaccagtgctcaatgaaataaaagaggacacaaacaaatggaacaacattccatgctcatgggtaggaagaatcaatatcgtgaaaatggccatattgcccagggtaatttatagattcaatgccatccccatcaagctaccaatgactttcttcacagaattggaaaaaactactttaaagttcatacggaacaactttcattttggtggaatcactttggtttcccctgttgaaaaaattcctcaatgtgtaactaagtcctctagtccagcagagccaaaagttggcttcttggtgcacagtttgcttcttgagcataagaagcaacattttgttactagatacccaggagtaatagtgagagaaggcccacatattgcctccttcattcttgaagtcataaatgtggctatgggagaaatagttccatatacttgaggctaggattcagctttgccactttctagattgtcagccaagccccacaaggcactgccacaaagctgcaatgacaactcaggctttaaaaggtcctccaatgttctattgagccagccatttcaggatgttgaagaacatcacaagactagtgaagtacattagcatgagcccattcccatacttcattgcctgtaaagtgagtttgatgtttaaaactggtgcagtgtggaataccacgacggtggatacagcctttcctcataccacagtaccgatttccttgaagttccatgggtgggaatgaaaatccatatgcagaataagtgtctatttgaggaagatcaaagtgataccccttcaatcgtggaagcagacccaagtaatcacagtgctacctggaagctgactgaccactctgggacatggtgccatattggggactcagtgttggtctctgctgctgtcagattgaatagtgagcagtggctgtagtgagatggacctggtaaatgaaagttcatgttgccaaacccgtaaataagctttatctcagccaccataatcatgatgcaccattactgcttagaagatagaggggtgcacccaagtaggtatggaggggtctcaggtagcttagagtggcctcagccaagaccgcaagtatacggctacctcagttccacaactttaagaagttagacctgcccgtaacccaaatgtgcttgaaaacaggttctctctgagtccttagttagtcagcagcctggttgataccctaactttgattttgtgagatcctaagcagagaaaccaatccagcctgcatggatttctgatctacagaactgcttatatatttgtgttattttaagctgctgaatcggggacaatttcttttgcattagtaacaaacctaatagatgtggtgcctgcatattctgaagtaacaaatgaaaatcaggcatgatgttttttattttctagtcaactggtctcagggaactccacatgagaccacaggtgcaggattagggaagcttctctttttctgggccccggtccatgctagcagggtttcagtcacttgtcaatgggtccacggtactgcacaacatttaggtatatgctaaaacaagcatctattatgcaactcgtttcatgttccttatttagtagtaagaaaggcaagatgtaagaacttgctgttcaccttataaccaccatcttgacatgccagactaccagattgttaaacgcttcactcagttagaaggcccctgattttgtgtgagaattatttctcacataatgtcttgcaagtgtgttgctaccatgtctggattagttgctacctccttttcagtcagcatgatgtcatcactgcaaagaatggtgtcacatctggtttaagagaaaggtggccattttccctaagaactcgtttaggatataaacctagagagttgatataagcttgaaataggaaatgatagtacattgctgtcctttctagctgaattgaaattcttgtttacgacaattactgaaagaaagccaaacattcacctaatcagtattgtatatcaggttccgagggatgtcacagttgctgacacaacaaaaccacttgtagtacagcagctgcagttggaacaacaatttgattaagtttatggtgcaatctcggctcactgcaacctccacctcccgggttcaagcagttctcttgcctcagcctccttgtgtagctgggactatagaaacgcattatcacacctggctaattgtttgtatttcttagtagagacagagtttcaccatgttggccaggctagtctcaaactcctgacctcaagtgatatgcccacctcagactcccaaagtgcaagtgcgagccactgcgcagggccccagctattttttgtatttttggtagagatgtggtttcgccactttggccagcctcgtctggaactcctgacctcaagtgatccacccgcttctgcctcccaaatcctgggattacaggcgtgagccactgtgtccggtgaaaacttcacttttaagtgaaacgcagaagcaaaatctgataatcagaaaatgagatactgcgtgttctcattcatatgtgggagctaaacaatgggtacacatgaaaataaaggtagaaaccattgactctggggactccaaaatggaggtagaggggagggagggagcgggtcggagggttgaaaaactacctattggatactctcttcactatttgggtgatgagttcactagaagcccaaaccccggcactgtgcaattatatccaagtgagaaatctgtacatgtacccttctggcatctataattttaaaaaagctaacaaagaaagcttcagttttaaatcttaaccaaatacacaggaaaaggattactatacttggacacctttacaggtttctatgttagtttttggtattaaagcagaaacctgttcctcgaccactttattaattgtatgtcctctttgtacaaacatcgaaaatagaagactgtcacttttggttctgtaactgtcttgactgcagtcttctacagctttcacagagttaatggtccctagtatctgccattctccaattgccctgggtggcgaaatcgctgccatagtaaacttttcactgataattagagtttctggaaacatgcagggctcgttatttaagagtgactccatttgggcattttggtggatggcctacaggttttcttgcagagtatactagagtctccagaatgaataaccctaggaacttgaggaactagcgctttccagaattttggaagccgagatacaaacattggttttctcaaaagcactgcaagtgggaaggaaaatccatatctagactaaatgtctgttcaggtaagaagaaagcacttctctttttataatagaagtgatctattgtaatccacataccaactagtggctggcagatcattctggagtctggtgccaaatcgggggcttagtgttggtctccattcctggaagatttttcactcagcaatgaccgtagccaggtttgccatggtgagtggaggtccatgctactgcgcataatctccaaccctgccagtttgaccactttgtttgttgagccggtaagattgtgacacacgtgttagggaaagaggctgattaatacctagataataagtaccttatccatctgattattaaaattctgctctgctgaggataccctttgctgagaactctcatgagaccccaatatcttcacattgtatgtccgtttggacaggcctgtccacatattttttttttctcagacttctttgtcacacatttttaatcgtgtgttctcaaagtccctgacaattcagcgaatgagtgggacacagcctatgcatgatacatacttacacgtctggatatgcctcctccaagaaggtgcactgctcaaagttcttccctctgggaggatttcccttcatcactgtccttcagggctgtcccagtcaggactgtcgtatgcagctgtccacttgtggcttgtgtggtaggcaggattctaattaagccccaacaagattccagtctcatggttattcaatcaaatactcctatgagtactgctctggtgggatttttttaatgcaaaaaatgagtattttattttgatagcactagaggaaacaaacaaaacaactgttcctacatcaaagtgaaaacaatgtttaagctttcctatcaatcaaatatattccaaaagaaaatgtgttctatgaaggttctgaagcacaggcaaatattaacacaataggctaagaagctgtaatactgaatatgactctcttctaacagggtacttaacaaacataatttttaattttaattttaattaattaatttattttgagacggactctccctttgtcccccagtgacaatggatctctgcccctttggagtgcagtgacgcgatctctgctcactgaagcttgcacctctcaggttcaagtgattctcctgcctctgctgccctagtagcagggagtacaggtgcccaccaccatgcctggctatattttttaattttaattttaagttttttacaaacataacttttgaattacaaaaccagtgaagtaatcccttccaaataattgtgtcaatagtgaaactgcctgttccattaaaactcgaaaaatttcgctgtaatattttttaccactatggacaattcaagtaaattttgctgcacttaaaataagttgtgaaagtagaaaaatgggccgggcatggtggctctcccctgtaatcccaggactttgggaggccaaggcagatgaatcacttaaagtcaggagtttgagaccagcctggagaacattgtgaaacaccgtctctgctaaaaatacaaataccagccgggcatggtggtacatgcctgtaatcccagcttctcgggaggctgaggaaggagaactgcttgaacctgggaggcggaggttgcagtgagccaagatcatgccactgcactccagcctgggtgacagagccagactgtctcaaaaaaaataaaaaaggtggaaaaatatacaaagttccagattaaaatgattaatagatgcaatataataaggtttcccctccttccatcctttctttctttctctctttctttcttcctttcttcccttctttcttccatccttcctttcttcctttcttcccttctttcttccatccttcctttcttccttcctttctttctttcgttctttctttccttccttccttcttttttctttctctttctttctttctttctctctttctttctttctttttttttgtagacagtcttactctgtcacccaggctatagtgcaatggtgcgaacaaaggtcaatgcagcctcaacctcctggtgtcaagcctcccgagcagctgggaccacagttacacgctcagctaatttttgtattttgtgttaagatggggtttcaccatgctgcccaggctgctcttgaactcctgggctcaaggaatccacccctcttggtctcccaaattgctgggattacagacgtgagcgaccgcactggggccctcatttttcttatcaattaacaataatggttacctttaacagatagaggttgactttatttattgattgattgatttttatttttagacagagtctcactctgttacccaggctggagtgcagtggcatgatctcagctcactgcaaattctgcctgtccggttcaagcgattctccagcctcagcctcccaagtagctggtgggattataggtgcatgccaccacgcccggtaattttctgtatttttagtagagacgggattcaccatgttggtcagacagactggtctcgaactcctgacctcaggtggtccagccccttcggcctcccaaagtgttgagattacaggcgtgagccactgtggcgggtcggggttgactttaaaacacaaccccctcaaatgaaaattgcagtttgttgttgttctttttctttttcttttcttttccttctttctttctttctttttttttttttttctgaggtggggtctcctctaccgcctgggctggagtgcagtggctcactgctacctccacctcccgggttcaagccatcctcccacctcaacttcccgagtagttgggaccacaggtgcgaggccactaggcccagctaatttgtgtgtttctttctttctttctttcttttttgattagttggttgctttgtagagccggggtctcactatgttacccaggcgatttcatcccgctgggtgagaaggttctgcattcctacgcatacgttgctgtgcagttggtactgaaggtcgcctgtagagggcgccagagtcagcgaaggggagggctgcgcttcctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacactgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggtcactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttgtgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttctttttttttttttaagcaccattttatgtgtttattggtcatttaactatgccttttatgaagttccttttcaggtattttcccccagcttttactgagatgtttgtattttaaaaatggatgtgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttacttttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggaaagaatatttttctccatttactgcagtcttgaatttctctgagtgatgttttataatttttgtgaagtactctagcacatcttgattagatttattcctaaatatttgatgtttttggaactgtttttaacgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgtgttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagagtaagtaagcctgtcctcatgtcctcctcatgctcctgcctcatcccctccagagaaactgtccttgtcaaggttaacagtttcggctgacattgccattaacttctcagcagcatttgacagttgttcactcgcttcttcatgaaaaccttctaggatttccatttccgacaatcttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacacacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagatacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcatgctgcctgccacagacgatgaataaatgagaggtgtcagacctggagtgaaaagaaagtcacttttgtgagacagaaaggaaggatgaggaaaatcatacactaaaagggattttttgttgatggagtacgtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagcactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacagacaacaatgtgtaataatcacatcaaggtaaatggggtttctatcacctcaagcttttatcctttgcgttacagagaatacaattatactcttcattatttttaaatgtgcaattaaattattaccaactatagtcaccctgttgggctatcaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctgtggtgtatatgtaccatattttctttacccattcatgtgttagtggacacttaggttgcttccaaatcttggctactgtggatggtgctgcaacaaacatgggagtgcagatatctgttcggtacactgacttcctttctcttgggtatatacccagcagtgggattgctggatcatatgatagctccatttttagttgtttgaggaacctccaaactgttcttcatagttagttgttgtagtaatttatattctcaccaacagtgtatgaaggttcccttttctccacacccttgccagcatttgttatgccggctagactgcctcttaccatgcagatacatttctatttccatgctgactgttacttcatctttctatctgtcacagcgcttcctacagcataggttctttagctatcttttggttaatgacatgtctctttcttttcagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttccc

SEQ ID NO: 5075 - DNA, 9613 bp, human
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacaccgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggacactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttatgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttcttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttaattttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggcaggaatatttttctccatttactgcagtcttgaatttctctgagtgatgttttataatttttgtgaagtactctagcacatcttgattagatttattcctaaatgtttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacatttccattaacttctcagcagcatttgacagttgtttactggcttcttcatgaaaaccttctaggatttccatttccgacaatctttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagaaacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccatagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacagtaaaagggactttttggtggtggagtgcgtatagaacttttagcagtaatggccgcctctattttctcagaatgtgtttgatataacaggagaccggttgagttgtatcccagttgcctgggttccagctcagtaaagcatggcagtttgtaagtgagtttgagaaatcatgatatcaagtgagacttgctgctttcaacttgtaaagcataacaagctgaaactgtcccatgagtaccagggatctgtgaatgttgctttagagttgtactgccttacttggtttccatatctattcaaggcgacagaaaataggaggtggttttattgtattatgtgtcctggcctccgtttgtcaggcctgggatttctccctggtgtatcctcccatttatgaaataaataattccctagaaactgaggagcacatagatgtacccagaggggtgatgaaacacacgtatctcacagctcaacttctcagtttgatttccagatctgtcattcatgaggtttatgtggaggggaaagaaagtggtcaaacaccaactgatggcttttactcaaaatctgtttcaccagagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaagtaagtagtgtaagaacgtctgttttataaaactgtaggaagtcactctttctatgattcagaagatatccatgttacctcttgaggctcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagtactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacggacaacaatgtgtaataatcacatcaaggtaagtggggtttctatcacctcaagcttttatcctttgcgttacagagaatacaattatactcttcattatttttaaatgtgcaattaaattattaccaactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctatggtgtatatgtaccatattttctttacccattcacgtgttagtggacacttaggttgcttccaaatcttggctactgtgaatggtggtgcaggaaacatgggagtgcagatatctcttcggtacactgacttcctttctcttgggtatatacccagcagtgggattgctggatcatatgatagctccatttttagttgtttgaggaacctccaaactgttcttcatagttgttgtagtaatttatgttctcaccaacagtgtatgagggttcccttttctccacacccttgccagcatttgttatgccggctagactgcctcttaccatgcagatacatttctatttccatgctgactgttacttcatctttctatctgtcacagcgcttcctacagcataggttctttggctatcttttggttaatgacatgtctctttctcttcagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaagcgttttatttgaaaggataacttgtgttttggttattttgtattcccacctgtgctggtagatattattaacccattaggtaaatactattacagtcgtggtttctgcagcagctcacactgatgtagctggcgtttataactaccttctttcgctacccgtttcgcattccctttgccctgagatagcatgtcagttggtcatgatgcttggcctggcaggatgactcaaaccttcattacggaagagtctgaaccattagatatcctgcctggatggggttgctgtgattttccattaactctaatcgaaaaacacgggaggactaagaagctctctagacatatcacacatactcttccttagcccctcgtgtggtgggaacccgatctcaatgttgaaatctgtatcatcagccttcaacgaaaaggcagaactaatgggagattttaatgtgtgtgtgtgtgtgtgtgtgtgtgtgtgtgtgtgtgtgtgttggtagggggtatatatacatgcacacacacactttctaatctcccattatacatataatacacattacacatattatatatacacccccatatatatatatgtatgcgtgtgtgggggggtatatccaatatatataataaaggtagttcctagataggattggtctgatacaataatttggagctgcagtagcagtccctgtaaggctgttgtttccagatacgacttgaacattctatgctttttattttttttaaagacagaatcttgctctgttgcccaggctagagtgcggtgacacgatcacaagtcactgccacctcgacctcaccccagttcaagcgatccttgtgcttcagccttcgaagtagctgggattacaggtgcaccacaggtgccatcacgctgcaatttttgtatttttagtggagatggggttttgccatgttgtccaggctggtctcgaaacctggcctcaagtgatctgcccatctcagcctcccaaggttctaggattacaggcatgagccactgcacccagcccattctatgctttttttaaaaaaattaattcattcaattattcaacaaatattaattgtgccaggtacttttttttattatactttaaggtttagggtacatgtgcacaacgtgcagggttgttacatatgtatacatgtgccatttttgtgtgctgcactcattaactcatcatttaacattaggtatatctcctaatgctatccctcccccctccccacaccccacaacaggacccagtgtgtgatgttccccttcctgtgtccatgtgttctcattgttcagttcccgcctatgagtgagaacatgcggtgtttggttttttgtccttgcgatagtttgctgagaatgatggtttccagcttcatccatgtccctacaaaggacatgaactcatcatttttcatggctgcatagtattccatggtgtatatgtgccacgttttcttaatccagtctatcattgttggacatttgggttggttccaagtctttgctattgtgaatagtgccacaataaacatacgtgtgcatgtgt

SEQ ID NO: 5076 - DNA, 8032 bp, human
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacaccgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggacactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttatgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttcttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttaattttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggcaggaatatttttctccatttactgcagtcttgaatttctctgagtgatgttttataatttttgtgaagtactctagcacatcttgattagatttattcctaaatgtttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacatttccattaacttctcagcagcatttgacagttgtttactggcttcttcatgaaaaccttctaggatttccatttccgacaatctttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagaaacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccatagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacagtaaaagggactttttggtggtggagtgcgtatagaacttttagcagtaatggccgcctctattttctcagaatgtgtttgatataacaggagaccggttgagttgtatcccagttgcctgggttccagctcagtaaagcatggcagtttgtaagtgagtttgagaaatcatgatatcaagtgagacttgctgctttcaacttgtaaagcataacaagctgaaactgtcccatgagtaccagggatctgtgaatgttgctttagagttgtactgccttacttggtttccatatctattcaaggcgacagaaaataggaggtggttttattgtattatgtgtcctggcctccgtttgtcaggcctgggatttctccctggtgtatcctcccatttatgaaataaataattccctagaaactgaggagcacatagatgtacccagaggggtgatgaaacacacgtatctcacagctcaacttctcagtttgatttccagatctgtcattcatgaggtttatgtggaggggaaagaaagtggtcaaacaccaactgatggcttttactcaaaatctgtttcaccagagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaagtaagtagtgtaagaacgtctgttttataaaactgtaggaagtcactctttctatgattcagaagatatccatgttacctcttgaggctcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagtactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacggacaacaatgtgtaataatcacatcaaggtaagtggggtttctatcacctcaagcttttatcctttgcgttacagagaatacaattatactcttcattatttttaaatgtgcaattaaattattaccaactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctatggtgtatatgtaccatattttctttacccattcacgtgttagtggacacttaggttgcttccaaatcttggctactgtgaatggtggtgcaggaaacatgggagtgcagatatctcttcggtacactgacttcctttctcttgggtatatacccagcagtgggattgctggatcatatgatagctccatttttagttgtttgaggaacctccaaactgttcttcatagttgttgtagtaatttatgttctcaccaacagtgtatgagggttcccttttctccacacccttgccagcatttgttatgccggctagactgcctcttaccatgcagatacatttctatttccatgctgactgttacttcatctttctatctgtcacagcgcttcctacagcataggttctttggctatcttttggttaatgacatgtctctttctcttcagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaa

SEQ ID NO: 5077 - DNA, 7836 bp, human
gcgccacaacttcactgccattttgtgaggtgccgccgtctctcctccagcaaggtcaggacttcaggactgtgagtgggcagtttttccctggatgctttaatttcgccctggaaagtgtcctttttcctcagaaagagtcttttctgtggtgttctctgtccggtgtgtgggagggctcccttggggaagtggcttagctctggggacaccgccatgggcgcctgtgtcagccgcgggggagcgttttccttgggcaccccgtctcggctatgttgtggggccagggggcttttcttgggggctcttcttgggggctccctgtcggtgatggaaaaggcgacttttcctgctgaaatgacctgagcccggggggtgggggccatgccttggttgcctgtgtcggcctcgggtgcggcggtgtttctttcccgctcagtcgctgtcctgaggggggactctgccctggggacactatctgtgctcatggaacgtggtgggggtggctgtgccccggacacatgatcgtagccctgtggggtcactgtcgggggctttatctcaacctctggtggactcttccttgggtactgatgtcggccgtgaggcgcatttgtcctcggatgttgctcgctctcagttacaatgtgttggcttttctttggttctgcttatccccgttgtggacgcttactggatgctttctcttggtgctgggtttttaaaattattatctgtaggtgctctctcccggtgccgccggggaatggggtaatgttccttggattctctaagcctatggtgggactcagggagctctgtgtcagccatgaaggaggccacgtgaccttgggaactctgtctcgacccaggttggggtgcttttcctcggttggttgatcgcaattctgaaggagctctttcctgggattctatctgacctttcagccacagcctcaggtgtctgtgtgggaatgggagtccagaaatattcgaaggttccagctgtgccacattcgaacactcgcagtacagttagtctttcattccagccactctgatgggtgtgcagtgatctctccttatgtctacactcgcatttctctgctgattaatgagatcgagcacctttttaagaaattgtttttatttattgatttttgtttgtcttttgagatgaggtctccctctgtcacccagactggattgcagtgccaccacacccagctatttattgttttcttttttttttttttagcaccattttatgtgtttattggtcatttaactatgccttttatgaagttccttttcaggtattttcccccagcttttactgagatgtttgtattttaaaaatggatttgtagtttccatatattctgtatttgagttatacgcacaggcacacaggcgtatatgtacatatacaaaaatacatatacaattttagtatcttctataaatcttttttgcttttacacgatctcaataatgtgttgtagatgaacagattctcttaattttattaattagtgtattatttatggatagtgctttttattattttaagaaacatctttgactcacccaatgccattacgataatattccttttcttaaaattatactttaagttccgggatacatgggcagaacgtgcaggtttgttacataggaagacacatgccatggttgtttgctgcacccattgacccgtcatctaccttaggtatttctctaatgctatccctcccctagccccccaacccctgacaggccccactgtgtgatgttcttctccccgcgtccatgtgttctcattgttcaactcccacttatgagtgaggacacgtggtgtttggttttctgttcctgtgttagcttgctgacacatgtcccttcaaaggacatgaactcattctttttgatggctgcatagtattccgtggtgtatatgtaccacattttctttatccagcgtcgtggcaggcgcccgtaatcgcagctactcaggaggctgaggcaggagaattgcttgaacctgggaagtggaggttgcagtgagcagagactgtgccactccactgcagcctgggtgacagagcgaggctccgacccaaaaaaaaaaaaaaagtaatgtcttccaatgcatggcaggaatatttttctccatttactgcagtcttgaatttctctgagtgatgttttataatttttgtgaagtactctagcacatcttgattagatttattcctaaatgtttgatgtttttggaactgtttttaatgacatttgaaatctcatattctaattattcgttatacagaattgccattctgtataatgccattcattatacagaattgctattcattatacagaaatgccattggttttcattgtatctagtaagttgactaaatttgcttattaactgtaatgattttattcttctgcatttttctatgtacagaacaatgtcatctgtgaataatgacagttttctttctttccaaattttaaacctattgtattttcctgatgatatggcactttttagaacctccagtaaattgttgaatggatagtggacatctttgtcttgttttcaaactcagggagaaaatactgatacgtcactatgaagtatggcatttaaaaattttttgtacatatgctaaccagaataggaaagttgccctttttcctaagttggtgatagtttttatcacgaatggactttaaacattgatccatgtatgaaaatgatcatgcggtgtttccctgtttttgttgttgttgttgttgttgttgttaatgtggtgcactacatttgtcgattttcaaatgttaaatcagtgttgcctttctgcaatatactccaccatggctgatgtatgtcctttttaagtactagtacattttatttgctcacccttagtttggaatttttgtgtctaagttcggggtgatcttggcttgtatttttggcttgatcttgtagtttttcattcttctaaattccttgtcagatgttgttatcagttttgtatcaatcttctaataagggttcctaataagggttaatacacgttggtttatgcatctatttgaatatataagcataaatacttatatattaaatatatatgatatataatatataatttaaaatataatgtataataagggttaatacagattggtttatacatccattttttctaataagggttaatacagattggcttatacatcttcaaataggtaataatatttttatctatttttggttgatgacagctgcttattccacaagcattctgattgatttggttataccatctttcttctgttttactttgtgtacattaaaattaggtttcttttcctgagaacagagtgtttgttgagacttggtaaatcttggctcatgattaaaagtgaaattaatgattcaaagtcttggttgtatacacatatgcagattgcttgccattttgtgattgttagatttttgtcatgaatagaatatattcattgatgtttttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagagtaagtaagcctgtcctcacgtcctcctcatgctcctgcctcatcccctccagagaaactgtccttgtcaaggttaacagtttcggctgacatttccattaacttctcagcagcatttgacagttgtttactggcttcttcatgaaaaccttctaggatttccatttccgacaatctttttttttttttttttaatttcttgtccgtattggtgaatccctatcatttttttcttgagatggagtttcgctcttctcagccaggctggagtgcagtggcgcgatctcggctcactgaaatctccgtctcctgggttcaagtgattcttctgccgcagcctcccgagtagcgggattacaagcaccagccaccacacccagctaatttttgtaagtttagtagagatggggtttcgccatgtcggccaggctggtctggaactccccccctcaggtgatccacccacctcagcctcccaaagtgctgggattacacgcacgagccaccgcccccgaccccatcattgtttttttctacatttctttttcttctcttctctaaatactgtaaaaaattcctgaaccccagcatctctctctctccttctattccactctgccacgatcaatcactgagctcctgagaaacctccatgtttcccattatttcccgcatcaaacacataccctccaaccctgcagccgggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccatagtgcccggtccatccccactccagcccatatccttggcctcaccgcaacctggaactccccctctgcctctgcgcaggcagctctgctttttccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacagtaaaagggactttttggtggtggagtgcgtatagaacttttagcagtaatggccgcctctattttctcagaatgtgtttgatataacaggagaccggttgagttgtatcccagttgcctgggttccagctcagtaaagcatggcagtttgtaagtgagtttgagaaatcatgatatcaagtgagacttgctgctttcaacttgtaaagcataacaagctgaaactgtcccatgagtaccagggatctgtgaatgttgctttagagttgtactgccttacttggtttccatatctattcaaggcgacagaaaataggaggtggttttattgtattatgtgtcctggcctccgtttgtcaggcctgggatttctccctggtgtatcctcccatttatgaaataaataattccctagaaactgaggagcacatagatgtacccagaggggtgatgaaacacacgtatctcacagctcaacttctcagtttgatttccagatctgtcattcatgaggtttatgtggaggggaaagaaagtggtcaaacaccaactgatggcttttactcaaaatctgtttcaccagagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaagtaagtagtgtaagaacgtctgttttataaaactgtaggaagtcactctttctatgattcagaagatatccatgttacctcttgaggctcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggttttgtatgtgcaggtatcttgatttaagcatttaaaacatttcagcctctgaagcatgattgctgaggtgtagattcacttctattcttctttatatttgataatactgaagtttttttttcaacatcttcagaatatgaaaaaatcttcgaaatgcttgaaggagtgcaaggacctactgcagtcaggaaacgattttttgaatccatcatcaaggaagcagcaaggtgggtagaaataggaactgtccaatttctttaagcacttgggctcaatagagtactgggggtgagcgttggggaacagcccctgccttgcgtttctcaaaccctggtcctcactcacagttatggctgtctccacagttacttaggctaatgttatctgagtctaactcattcttcgaagactatggagacttccattttcaccatagtctgaggtgcgcattgtccctcaattgacactctttgtatttgctagactacctctttttaaaaaatttgtgtaggcacatagcagatgcatatatttctgggctatatgagatattgtgatacggacaacaatgtgtaataatcacatcaaggtaagtggggtttctatcacctcaagcttttatcctttgcgttacagagaatacaattatactcttcattatttttaaatgtgcaattaaattattaccaactatagtcaccctgttgggctatgaaatacgacatcttatttattccatacttctacgtattaatcatccccacttcccacaccctccacccccactaacctttgtagcctctggtaactgtcattctactctctatctccattagttcagttgttttacacttttactcccaaaaataagtgagaacatgtgaagtttgtctttctgtgcctggcttatttcacttaacataaggaccttcggttctatccgtgttgttgcaaatgactgaatctcattcttttttttatggctaaacagtactctatggtgtatatgtaccatattttctttacccattcacgtgttagtggacacttaggttgcttccaaatcttggctactgtgaatggtggtgcaggaaacatgggagtgcagatatctcttcggtacactgacttcctttctcttgggtatatacccagcagtgggattgctggatcatatgatagctccatttttagttgtttgaggaacctccaaactgttcttcatagttgttgtagtaatttatgttctcaccaacagtgtatgagggttcccttttctccacacccttgccagcatttgttatgccggctagactgcctcttaccatgcagatacatttctatttccatgctgactgttacttcatctttctatctgtcacagcgcttcctacagcataggttctttggctatcttttggttaatgacatgtctctttctcttcagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgtt

SEQ ID NO: 5078 - DNA, 25297 bp, human; identical to SEQ ID NO: 5074

SEQ ID NO: 5079 - DNA, 62945 bp, human; identical to SEQ ID NO: 3770

SEQ ID NO: 5080 - DNA, 60900 bp, human; identical to SEQ ID NO: 3771

SEQ ID NO: 5081 - DNA, 63894 bp, human; identical to SEQ ID NO: 3772

SEQ ID NO: 5082 - DNA, 63959 bp, human; identical to SEQ ID NO: 3774

SEQ ID NO: 5083 - DNA, 59814 bp, human; identical to SEQ ID NO: 3775

SEQ ID NO: 5084 - DNA, 62945 bp, human; identical to SEQ ID NO: 3770

SEQ ID NO: 5085 - DNA, 60900 bp, human; identical to SEQ ID NO: 3771

SEQ ID NO: 5086 - DNA, 63894 bp, human; identical to SEQ ID NO: 3772

SEQ ID NO: 5087 - DNA, 62781 bp, human; identical to SEQ ID NO: 3773

SEQ ID NO: 5088 - DNA, 63959 bp, human; identical to SEQ ID NO: 3774

SEQ ID NO: 5089 - DNA, 59814 bp, human; identical to SEQ ID NO: 3775

SEQ ID NO: 5090 - DNA, 62945 bp, human; identical to SEQ ID NO: 3770

SEQ ID NO: 5091 - DNA, 40381 bp, human; identical to SEQ ID NO: 3784

SEQ ID NO: 5092 - DNA, 42063 bp, human; identical to SEQ ID NO: 3785

SEQ ID NO: 5093 - DNA, 60900 bp, human; identical to SEQ ID NO: 3771

SEQ ID NO: 5094 - DNA, 41571 bp, human; identical to SEQ ID NO: 3788

SEQ ID NO: 5095 - DNA, 63894 bp, human; identical to SEQ ID NO: 3772

SEQ ID NO: 5096 - DNA, 62781 bp, human; identical to SEQ ID NO: 3773

SEQ ID NO: 5097 - DNA, 63959 bp, human; identical to SEQ ID NO: 3774

SEQ ID NO: 5098 - DNA, 59814 bp, human; identical to SEQ ID NO: 3775

SEQ ID NO: 5099 - DNA, 110663 bp, human
agaaaagaaggtgactgaggcatggacagcagaaaatgagtctcctgtttagtacttctttcatttcacatcaaacataggaatttagagacaagatctggtcatttgagggtgggaagttaaaagagtccagttctcaggtaagtgtttctcttcctcccttcctccttccctccctctttcctttccttccttctttccctctttccccctctctccttctttcccttaaatttttctgaaccacaaaattaagaaatacgcatcatgaaataaccaaattgcttgaaattgtgtgaggtataaaattcaagtctttaatcctcaccctttctttctcttttcctctttctttacttttcctccttccttccttttatgttttttcaaaattatgaaagtaatgtatgctcattgtaaaagcaaacagtacagaatcacaggaagtataaaggaaacatttaattcccatttttccttcctatctctttcctccccttcctatcttccttaccttcctctctctctccctttcttcctttctcctttcctttgatttttaaaagtatgtaactaatttataatctttgtaaaataaccagacagtacagaacagtatggaaaattcctcatgccccatcccctttcctcaacccaccttttcatgccttatatatagacttaccttattcctttttttttttttttttggagacagaatctcgctctgtcgccctggctggagtgcagtggcatgaacacagcttactgcattgtctgtctcccagattcaagtgattctcatacctcagcctctcaagtagctagaattataggcatgcgccaccatgcccggctaattttgtatttttagtagagacagggtttcaccatgttgcctaggctggtttcgagctcctggcctcaagtgacccagctgcctcagcctctgaaagtgctgtgattacaggcatgagccaccatgcccagcctttattccttttaatggttgcatagtattctgttgtgtaaatgtcccatgatttatttattgggcaccaggtaagtttctgaaacataccttgaagttgttataaaagtttaggggaaatggaagaaaaatataaattggattacttgctgctgaaaatcccattttatagatagcaatcatatccatttctatagcactttatgctttgaaaattgccttcgaaatatcatctcatttgatcctcttcaagagcagctctgagaaatatgcagattattatctccatttttacagataaggaaactgagtcccagggaaattaaggaacaaaaatatgtatggcctcacagccagttactgattctcagcctagtcctcttatagcactataaatttaagctgcatttcattttgcaagtcatgaaagatttagacacccccttacttctaagctcatagtttagaaaatccatccaactcatacaaattcccttattattctaatgagaatggtggtagaatccttggtaaatatgaagagcctgattaatggctggcattcatagcaagctcaagattcatttgacttcctaattggcttctgttacattaaatgtaaagtgggtctattcattccaaatcccacttggaggtagaaagaaatacaatacgttgcattatcctatagaaaaagaaatgtttaaatcagtagtaaatcattcagaagtatatttcatttaaaatcagaaatgcccatcagcaccctactgccaattttctgtaacatgtttcagtaggatttgcagttttaacaccattttgtttggagaaaagagggttttaagtgcattttccacataagacactatagttacaattaattaaggagagaagctgggtgaacataatgaaatggtgattagatttctctaaacagatctgttttaaaaatacaaatgatttgatgagttacttttgtcaacaaggtcttcttgcataacattccttcaagaaatttaggatcattataactacaagtagttgaattgaagtttgtgcattagggttgaatatatcacattttggttttttgtttgtttgtttttgagacagagttttcacttgttgcccaggttggagcgcagtggcgcaatctcggctcactgcaacctccgcctcccaggtccaaggaattctcctgcctcagcctcccaagtagctgggattacaggtgcccgccagcatgcccagataattttttttttggtatttttagtagagatggggtttcaccatgttggccaggctggttgcaaactcctgacttcaggtgatccacccgcttcggcctcccaaagtgctgggattacaggcatgagctacagctcctggcctcacattttgtaattatgcatttaatgtctgtcctccccacagggctaactgtcctatgatggcagagatgtgtgtcttgtcttctcagcactgtattcccagggagcaacacagtgtccagcacatagaagggattcaataaaatttattgagctagtatatagataaatccatcagtgaggtttcagccaggctgggtatctctggtaaatgcctatcatgtggttggctgacatgactttaagcaataggaaaaaacccttaggtggtatgcaaaggagaagtgtggtcacatacgcttagaaattgtattttctgaatatctgagctgggcatatttttgactttttaaacacagacttagacaatgaaagaacacatcatatatcagaagctttatggattgattctcatgtcgagttttatctttctctcaggtaagaaaatgtattcttattatctctttcaatgtctcatgtatagtaggttatagaaataaaccatttgaaaaatactaccaatggagatttgctgggctgcctcttaatggtcaccttttggtcaatatggctacagaagaagctgaagcatcagtaagtgaattaattcattcatcattctgtactactgatagagagctggcctcaagaaggcagtagcttggactactacctttgacatttcttaaagcaactctgaaatgccatttggcggctaatgcacacctaacagaagatttgggttttcttttggactgtttcctctcctccgtaatgctttatttaaagctgtctgaagcattgtgatatcatctttctgtctccattatatgtatatggcaagaatcatagaatacagatggggaaactgaggcatgcaaacagctggtaacagattcataaagcaatgggcatatattctggaagcacccagaccttccctagactctatgacaggaatgaaaataatttgtctctattttacagtagataattaagacaattcactgaagtagctggtaatttggagacttcaggagaaggtcttggtaaactgcaatcttgtccacattaagtaaattcagtttgtagcattgcttatttagcacataagtacttagctaaaaggtcataaatgccagtgagtgacaacgcctgatgaaattgacctgtgtttaatttgaacggtcctcaagcgtaagagctaatctgcaaaaataccaaatcatcattgccatcaagagcaaacactggcttcttgctgcatgcagagcctgataggaaaccatgtttcttataatagagattgaaatggggcctacggggtacagtggcaactttgtcacctggcctggcctacctgctaaaaagttgatttatttttcctctacctgtttcctcaagggcaagaaactgtattttcccaatttctttatccaaagcatccaacacaggccttgacacacagtttaggcacttggttcatatgtgctgatttaatgaattcatgcaatttgaaatgatgaaaattttcaacatctgtatggtggtggggtatatgacacaaactccattggtttttgtgaagggctacagggcatggtatagagcaatctagaatagtggaatatgggaatctagtgtagtcatggaataaaaagtgaagagtgtgtggtactgaaaagtttgcatgggtttgcgaggaatgtcaccactcagtgaaaattattattattgttattattattattattttgagacagagtctcactctgttgcccaggctggagtgcagtgacgcaatcttggctcactgcaacttctgcctcccagattcaagcaattctcctgcctcagcctcctgagtagctgggattacaggcgtctgccaccatgcccggctaatttttataatggtcagtgaaaattatgatagatgtgcaggtcctcaacctgcagaggtcaatttaaagcagtcacaaggttttccagactgtttaagtctcaaattcatgagtcaaacaagttttttttgtaggttatcaaacattgaattataattgttctttgattgccgagaaattcattacttttttcttggaaaaaaaagaccctgtccttggaaacaacggcataactcaggttcagttcccttcaggctccagatgagtcaccagcctcccaactgtgagggtcattattggggagagattaaggccagattaagtggagggtgactcagagatgctctaactgggaggagccagagtgtggagcaaaactgtctccatagaagaatatcaagggttgagaaggagaagccaaatctgtattaaagtctatggggtgagagcagagccagaaagaagagatgaagactgaggtcaagagctgaatagttgcagaatggagcaggaggtaaaaaataaggcataaatgagagaagagggcctaggacttaggctgtatgtgggactcggtttcctagttctctgtcttagtctgctcaggatgccataacaaaatactatagattggatgatttaaaccatgggcatttatttctcatgtttctggaggctgagggttcaagatcaaggtgccagatgattcaattcttggtgagggccctcttcctggcttgtagacagctgccttctctctgtgtcctcgcaaggctgagagagagcaagagagctctgctttcttcctcttctataagggcactaatcccaccataggggctccaccttcatgccctcatgtaaacctaattactttccaaaggccacaccttcaaataccaacacattagaggttggggcttcagcataggattttaggggagggggaaacaaacattcagtccataacatgattttcctcttaatggtgctggctattggctgtgtaatggatatgggtaggtttgggttgaagacatagggctatagtagttgtcctaaggtcttgctcataccatgtacacacacacacacacacacacacacacacacacacgctcacaccccaagtggagtaggacaggctttgctggctgaaagagtgtaacgtgttctggagcattcttgaggcaggaggctggggttttgtgacattcttgaggtgggaggctgggtttttgaggcacctagcctctacagtcagtaacttttgctcctgtattggataggcaattagtcaatctgggccggaatcaactttcctgagaagttgtcacatatgcagagacgacctgactaggaattgttttgacacaggaaagccccagagccatgtcagaaaatcagtccttaggctgtagagacaaactaggccagggcagtcaggacacagtaggagtgtagaggtaaagaaattcttcttctgaaaggtgtttgtgtagccagggttcaggaaaagccctatcttttctttttttaaaaaattttattttttaaattgtaaatagacacaggatctcgctgtgttgcccggactggtcttgaactcctgagctcaagtggtcctcccacctcagcctcccaaagtgctgggattacaggcatgtcccaccctgcctggtctatcttttcttgagaaactaattccacgagaaaagagaagtggaggataaactttgagcagaaactaaatttctgtatgaattcaagagttgagctgtccaatatggtaattacttgcaacatgtggctaggttttaattaattaaaattaagttaaaaattcagttcttagtaatacaagccaggttttaagtgcttaatagctacaggtggctggttgctaccatattaggcattgcagatacagaacatttccatatcacagaaggttttattagacagcactgttctagaaggttgtagagactggcatttgagaaaagatatttgttttaaacagctttattgggctgggtgtggtggctcatgcctgtaatcccagcactttgggaagccaaggcaggtggatcacttgagctcaggagtttgagacagccttggcaatatggcaaaaccccgtctctactaaaaatacaaaaatgagctgggcatggtggtatgcacctgtaattccagctactcgggagactgaggcacaagaatagcttgaacccaggaagtggaggttgcagtgagttaagatcgcgtcattgcattccagcctgggcaaccggagtgaaaccctgtccctaaaataaaataaaataaaataaaataaacagctttactgaaatataatttacataccatacagttcacccatttaaagtatacaattcaatggttttcagtatatttagagtggtggaaccatcactactatctaattccagagcatttttataacccccaaaagaaataccatactctccgttcctcccccagcactccaggccttgacaatcagtaatctgttttctgcctctatgaatttgcctattctggacgtttcaggtaaatggaatcatacgatatgcagccttttgtgactggcttcttccactttacacaatgttttcaaggttcatccatgtgtagcatgcatcagcagttcatttatttttattgctgaacaatattcaatggtatggatatacctcatatttttttccattcaccagttgatggacatttaaattgtttctacattttgactattatgaataatgctgtatgaacatttgtgtacaagttttgtgtgggcatatgctttcatttcttttgtgaatatacctaggagtgcaatggcagagtcaaatgtaacttcatgattaacattttgaggagcacgcagaccattttccaaagaagctgcatcattttacatccccactagcagtgtatgaaggttctgatttctccacatcctcaccaacacttgttattgtctatctttttgatcatagccatcctattggaaatgaagtgatactccactgtggttttgatgtgcatttccctatgactattaagcattttttcatgtgtaaaaacagacattttgtctaacaatactcaaagcctttcacctgggaaattgtgcattctagactctgaagcataagttctttctttttaattttttcagatacatatttccttgagttggcacaggcatagcacatttgtctagcataggacagatgaaaaacgctcatatgatagcctgtttgagcttgagcatgtcacttaggagggtgactgaccaccatattctgtctcaggctagtaagttgtacaaatttccttcaacagtaaaaatattgacagggaattgcataggctgaaaagtaggtctgaaacagttttccccatgttgttcaccgcccggaggtggatgggcttctaggatccttggcctggatttttgttacctaggtgcttttgagttggtctatcaaggtagggcttatgggagctgttagcatcacaacatagagatcttagtagagggccctgtatttccactgccaggtaatgatcagtagtctttcctcttctggaaatggcttctctgcacacaccattatgcaaacttaggggctatctttcattcttccctttctctcactctccacatctaatccattgagtcttgttcatgccaccacaaaaatacatcctaaatctgaccgttttcttttcttttcttctctctctctctttttaaaccattttaactgcttccgccatgggctgagccaccatcattttctcttggctgacttcagtagcctcctaatgttctccctgctttcactcttgctctgctacagtctattctccacacagcagccagagtgatcctttaatatatcaagtcagatcataccactcttttactcaaaacttgccaataagttcctatcaaaattagaatataattcaaactctttaatgagacctaaaaagcactacatgatctgatctcccactgcctcttgggcttcacttactaccatgcatcctctttctccctctgctccagacacactggcttcctagtattccgtaaacacaccaagcacagtcccaccaaaaggcctttgcacgtactgttacccatgtctgggtcactcttattccacatctttgtaccctggctcttttttcatcccttgggactaagctaaaaatgactctttctcagagaggcctttcttaactatcctacataatgtagacatttcctttcccctcatctctgcttttcccattacctaactcatcaacctgtcaatttctttcagagtactgtatgtaatttgtgttttttcctttacttgtttattgactgcatctgtccctggaatgtaagctgatgagctcagggaccttgtgtgttatgtctcctctattactgcactctaacactgacacatagtcaatgctcagtgaccatcactgttgagtaaataattttttttcagggagcttctggctttatgagtaaggacatctatttttttgggtgagacatgggccttgaatccaagatttgaaggaaaaatcacatgacctatgtgaggataattcctctgtctcctatgccaagaactcttggcaggccacaaatggagtcagcagcctaggtactagaggaagggatgtgttggacaactctgtggctggtgattggtgacagaaatgaggatcagggttggacgcttctatatctggtaggcctggtttatctaaggattagcctggttacaagaccagtggaaagtgtgggcagtgggtggcagatagtgactctgattctctgtggttgtgcacactatggccatggtgatgtgggtaatggagctccccagtatcaggtacctattgattatatctactcagacagtcatggggctgctagaccagggcctggtctacaaagtttttcagtgctccagaacgttgaattccaaggatttgtgattctaagagccagaagactccctcctcaagtgagtatctgctcacctgcccttttatgagtgggtagtgacacttccaagataaggcagacatggagtagccttggtagaacgctcactctcagagtggccagattcttcaaagtataaacacaactgatgcctctggtgggcccttttcctcaaatctgctctgcagcctcaccttgctctcataggtattaccaggtgattagctgggttctgagccctacacagtgttgagtcaagttgtgtcttcccagcattcatatgttgaagtcctaaccctcagtacctcagaatatgatcttctttggaaatagagtcattgaaaatataattagttaagataaagtcatactgcagtagggtgggcccctaatccaatattattggtatctttataagaagaaaaagtgtggacacacacatgcacacagggagatcaccatctaaagatgaaggcagatatcggggtcatgtgcttataggccaaataacaccaaatattgccagaaaaccaccagaaactaggaaagaggcatagaacagattctctctcacagctctcaaaaggaaccaaccctgctgacaccttgaccttggacttctagcctccaaaactgtgagatgatacatttctgttgtttaaacaacccagtatgtggtatgttgttatggcagccctggcaaactaatgacacagacactgatgctctggcaggctcactgggttagaattaaaaagaggaaagcaggttacctcatggagaagagacagtgaccagatcatgcccagagtacctgaccatggaagaacctcatttgtcctttgccctgaacgtagtgcaggacagtggacctggaaccacagtcccccaaactttgaaacacttgaacattttaaggagaaactttgccttctaagaaagggtagaaaaacctgtataggatatgtctgatgttacttaatgctgtcataagcagaaaacaaagggattttgctgaaaaaaaaaaacaaaccattcagattgtctatctcttagagttttaaaccatttactctctgactttttattttatttgtttatctatttttgagacagagttttgctcttgtcgcccaggctggagtacagtggcgtgatcttggctcactgcaaccactgcctcccgggttcaagtgattctcctgcctcagcctcccgagtagctgggattaaaggcatctgccaccacgcctggctaatttttttatttttagtagagatggggtttcgccatgttggccaggctggtctcaaactcctgacctcaggtgatccgcccgtctcagcctcccaaagtgctgggattacaggcatgagctgccacacctggccttactcactgacttttaaaataaatgtatttattacttttggggtctgacagggacagagaattctcccttgatcttttgctaaaagttccctaaaacagaaggcagagcacgagttcagtatacagtccagaacttctcattctatgccagatgcttcattcctgatacctttgcacaagggacagcactccatctgcccacccattagcctccaactcagtgccctaatacaggatacaactatttattcagtaaacagctacaaaggacctactctgtgtccatgaacttggacttccccatctcaaactgtacatgaaaattaacttgaaatggatgaaagacttaaatgtaagaactaaaactgtaacattcttagaggaaagcataagggagaatcttcacgacctttggtttggcaatggattcttagaaatgacaccaaaagcggccgggcgtggtgtctcacacctgtaatcccagcactttgggaggccgaggcgggtggatcatgaggtcaggagatcgagaccatcctggctaacatggtgaaaccccgtctctactaaaaatacaaaaagttatctgggcatggtggtacatgcctgtattcccagctactcgggaggctgaggcaggagaattgcttgaacccaggaagcggaggttgcagtgagccaagattgcaccgctgcactccagcctgggtgacagagcaagactccatctcaaaaaaaaaaaaaaaaaaaagaaagaaagaaatgaaatgaaatgacaccaaaagcatgagcaataaaagaaaagaaaaattcgatacattgaatttcattaaaattaaaaacttttacacatcaaaagacactatcaagaaagtgaaaagacaatacagaattggagaaaatatttgcaggtcatctatctgataaggttctggtatccagaattaaaaatgggcaaaagacttgaatatgtatttctccaaagagtctatgcaaatggcaacaaacatatttaaaaaaatgctcaatgtcatcagccattagggaaatacaaatcgaaaccacaatgagataccactccataacctctaggatgacaataataatagtaaatggaaaacaacaagtgttggctaagatgtggagaaattggagccctcatacattgctggtaggaatataaaattgtacagctgctgtgaaaaacagtttggctgttactcaataagtgaaacatagagttactatatggcctagcaattctactcttacgtttataccccaaataaataaaaacatgtgttcaaacaaaacaaatgacatgcatgttcatagcagcactattcataatagccaaaagagagaaacaatccaaatgtctattaacgtgaatcaataaacagaatgtgatacatccatataatgaatcttattaagccatggaaaaggatgaagtactgacacatggtacaacatggatgaacattatgctaaatgaaagaagccgacaagaaaggacacatattgtctaactccctttatataaaatgtccagaacaggcaaatccagagacaaaaagcagattagtagttgccaggggctggaggggaggggcaaactgagagtgagtgcttaatgggtacagggtttcctttttggatgatgaaaatgttctggaattagataatggcgatagttgcacaacattatgaatatgctaaataccactgaatagtagactttaaaatggtttaaatggtaaattttatgttatatgaaatttcccagtacaaataaaatggtgcttggcactcctagggtagtaacagccatttaagtgagatttatgatgagtttttcctaacacggaaaacacttatgctatgagtgagaaaagcaggggacccaattttccttacaatatgatctcagcctcacaaaaacaagcaaagcctgtgcacagaaaaaaactgaggaaatataccaaaatgttaatggtgattatctctgagtggtgggactctctggctggctttgttttcatctttttacttgctaatacttttcagtttttctttaagaaaacatgtacagtatcacttttataatggaaaaaacaccttaaaaacagtaaggaagacaataaatgtcatttaaaataaaaggaaacagtggatagaggcgaagagacacagaggagccaaatcaagagagaacacgcttcaggggagcaatcatgcaatttggacttgaaaattgccagggaacagatggcagcatctaagcagacatctgcaatggatagcgaaatcatatgcaaagacacaagtggcctttgaagcaggcccttgagaggcgcggcagagaacgctacttgcctggccaaacataagggcaaagcccctctccaccttgtcacagtctggcctcctcagagccctgctggaggcccagaggctgcggtggggctcagctcagttgggcttccatgtgtgagggtgcaaaagaggctgtggaggaaggaagaggcttctgatagtgaccctggcaaacatggcagctgacatttacatggggttgcacagtttataaacattctcacacacataacctaaatgttagttatgattgcatcatcttttatcatggccctatgaggtaggcagttattatttccatcttactgtggaagaacgaggcatggagaagtgatatgagctatttatttaacttttatatagtgttctctatgtgccagacactgtgctgagagctttcacaggcatctgttgcctatgttcacacagctagtaagagacagaactgggactcaaatttggctttttagacttcactataccacatttctgcttatgtctaagcagaatttacctatatcttcagaatcttaagtaaggccacagtgattctatctatctatctatctatctatctatctatctatctatctatctatctatcatctatctattatctattatttatctgtctacctatccattcatccatacatctctccatccattcatctatctatccatccacccatccatctttatttttctgattataggtgtaatacatgattgtttaaaacatgcaaatatgctgaaataagtaacataggaagtaaaacatttccctaatctcacacctaaagataatcattcttaactgtttaatatgtgctcttccacacttttttctgtgggcatactacctgcatatttttcttttagtttttaataggataatactgcacctgcacttaatataactcctatttcacacaatagtaagccttgaaaaactctccatgactatagaggcctatcttgtttgtttccctattccattgtatagaggtagcaattttcctaaatagtcacttattgatagacatacaggttcgtcaattgttcttgattataaacaatgtggcaataaatatcattgtactctcatctttgtctatctgtatatttgtctaaaatgaattgatagaaatgaaattgctgggtcaaaggatacacacaattatatacaattaagattgccatagataatggcaaattgcccttcagaaaaataatacttaattggcactcccactagcagcgtgtaagagtgactcatttccccacaggcttgccaaagctggatattctgtcttctaaaattctatcaaccaagtaggcaaaaatggtgtctccttattgttttaatttgtgcttagaaatagtaaggtggcatctttctatagtattggcctttatatttctgcttttgtaaattgctttttcccatcttttggcaactggttttaaattagtatactgcaggctgggcatgatgtctcacacttgtaatcccagcactttgggagactgaggtgggaggattgcttgagcctaggagtctgagaccagaccagcctaggcaacatagtgagatatcatctctaaaaagaattaaaaaatttgccaggcatggtggcatgcgcctgtggttccagctaattggaaggctgaggtgggaggattgcttgagcccgggaggtcaaggctgcagtgaaccatgttcatgccactgcactccaacctgggcaagagagtgagaccccccctcttaaaacaaaaaatcaaaaactaaattagtatactgcagagaggagaggcccttgtagaccatatgagattatgatacattctcttttaaggtgcaactaggccctggagatttatgctcaccgtaaaaccagttcttaaatgtatctgacatcatttcagagggctgaacagaaaggcagttaaccaacaataattgagacttgggtttcatatcacttattgtcttgtgggattaactcttgatttattagccacacaaaagatgataaagtaatataatcacagaagccagggacagaagtaagcattttctcattcatcaatggatagttcagaaataactccccggcaggtggatagtatgagttcctgcacatgggagtgtgtgatgcaggtggaatgtatatgagtgtgtgtggggggcaggcatatacatgttattgtttgcttttggaaaatgtccactagaggaatggagggagagaatactatatggtcagagaatatctggaagctttcatttggcggcatctcccagaagcagggaagtatttacttcctgctagcctctgtagtgttctgttatggctgtcactgttttagagtggtggtcccaacgttacaactgtaattcagggagtggttacagttccaattctgccacagagctctttatcttctggcttaggctgtactggcactggaattaggttgataattaggtaatcctcagatatttacctagtagactgggggtgtaagatttgtagtggtgatagtatcatcactcatctgcagcttcttgtgaaacaaagggcatatccaatgtaaagtttcaaagatactgccgaactacttaccaaaagaccgcacccaatggacatgtccttcagcaatgtttaacaaggttttgcatacatcatctcacttaatcttcaaataatcttgtaaagtcatcagggagaggctattatctggcatagactataatgtgaatggtggcccttaaagttgaacgggcatacaatgctgtggccccaaatctccattttactgaagcaaacattgaggtatcaggagggtaagttacttgctcaaagttccacagctgatgagtgtcagggcatggatttcaacccaggctgtctgactccagagccaatggtaactggggtctatggccatcttgaaaccactgcagtgcccttggtgaggagacagaaggaggccatcaggatgcacccagggcagtgccatgtcttccattcctgagtacaaacaagtcccagagtttcagtatcgcccagctggtcattcttcaggcctctgtcagtgcctttcagtgagaagcagtccccagagacagaataaatcagatcatttggctcaggaaaaggcattggagaaacaaattgctgttgcaccatgaatgtaataaggcagttaggtgggcggaaatagttctcttttgattatatgagtgaggattatgtgtagcaaatttgaattccaagctgccttttccttggcctcttccctaccctttcactagccatacacttctaactgcctctccaagctgtccagctggtatgtgctctgggaacactaatctaacttttcatattagtccaggcaaaatataattaggaagaaactcttctgccaaaacaaaaatcacatgctaatgtcaaatagagatgattttttacatctactatttttgtttatttgcaccagtattgactcataattatattgtataacccagatttgactgtattgccaaatacaataaaacaatttttaacagaaatttcatttgttttctctttcccctcccccaaatttggacagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctgtgagtaacttaacaacttttttccttagcaagggtagtgttgacacagtacttctctgctagcagtggccccaggttgctagttttgtcatcactttttaatgaggagcacatactgttttcttttatctttattttgatatgatttcaaacttatagaaagattggaagaataggatagaagaacacacacacacacacacacacacacacacacacacaccacttatttgtttctaagtcatttgagagtaagttgcaggcataattctttgctacccctaaatatctcagtgtgtatttcctaagaatgaggaattctcttaaccaggctataatgatcaaaatcagaaaagttgatgttgatacaatactaacatctaattcacatttcacattcatatttagccaattatcctagtaatttcccttataactattttttgcttggcccaggatccaactcaggatcacacattacatttagttgtcatgtctctttagactaatttggaatagattctcagcctttctttgtctttcatgacctagacatttttagcatacagtccagttactttgtctctcaatttatgtttgtctaatatttcctcataattagattcaggctatgaatttttggtaagaataccacagaaatgatgttatattcttctcagttcatcacatcagtagacacacggtgacaatttgtctcattattcataataactttgatcacttgattttggtgatgtctgtcagatttctccaccataaagttattattttttcctttgtaattgttgagtaatttctggggagatatttggaggttatgtaactatccccttcttaccatactttcacccaataggttttacatctattcatgattcttgcctgattcactaatcactatgatgtttgcaaaataatgatgtttaaaattccatttttttacatttattagttggcattctattgtaagaaagagctttttcttcttccatatttatgtgtttatttatttaagacacagggtctcactctagccaaggctagagtgaagtggcatgatcatagctcactgtaacctctaacttctgggtgggctcaagtggttttcctgcctcatcctcccaaagtgctgggataacaggtgtaagccaccacacccaaccttatttatgtgtttatttatttgaacatgaactcatggattctcattttattcaatgggttacaatctgctactatcatttattttgatgttcaaattggcccagggttggtcagtgagagtttttcaatctggctcttgtgtccttttgacaagttccccatcattctttgagcattttcttactctctggcacaacaagatgttccaggctcttcttgtacgttttctgctcagcccaaggagcagtcattttactaaggcgtccctcttccttttagtggggaatgatatttataaaccaattcattttttcttctgagagcaattatgatatgggagaactctttggaatggagttcttgtaaggaacctggcttcttggaattacacctgtatttgtctcctctcgagtttggggaaggaaagatgagattgcttttctctgcataatcccactctgctctcaaatccagtcctctccactatcagcagcagcagtctttagcacaggtagtcagtgataatagcatcaagacaagatttttttgcatttcccaaaactttcacttattcttgaaggagtattattgactgttgttatgggttttttccttccaggaggaagctgttaggaaaggaataggggctagatccatgcctaaaagggctctctcagactaaggggatatgttttcaccaacagtctggatgctgtttgagttaactgcagaggaacattccaggggatttctgtttctttgagattagaccaatgcaaaggagcaggaaagctattcctttgtgctaccacccaaagatatttgttttttctcttttctggggccttaaaaacaaaagagaatattcctagctggctctgattacaaaactgagctacagactagtaggttaagcctgaacagctcacccaaagcagtttaaagtaactttatctttgatctaaggaaccggaagtatggccttatatccatgtgctcagcagtggtgttttaaaaccacatctggccagcgaatggccatgagttttcctaccactttgtgggtagatagctaaatctaactgctgtgttaaagtactagacaaccctgttttattttgctcttttgtacactttttttttttttttttgagatggagtctcgctgcgacacccaggctggagtgccatggtgccatctcatctcactgcaacttctgcttcccgggttcaagcgattctcctacctcagcctcccgagtagctgggactacaggcacatgccaccatgtctggctaatttttgtatttttagtagagacagggtttcaccatattggccaggctggtctcgaactcctgacctcaagtggtctgcctgcctcgccctcccagagtgttgggattacaggcgtgagccaatgcacccggcctctttcatacactttttaatggacgaccatcctctgggtctgactgaatcatggtgggcataatgcacaatctaacgtaacaaacaaggaaattatcacctcaaacaaacaaaaaaaggtagtaaatgttctctctactattcagatctcttcaagtgttctttccaaaccttggaccaagagttcctaatctaggggccagaatggccttgaaggagttgacaaagcccccgaaatcacaacaccctaaaaatacagggcagattttttttcagagggtgcagtctatagtttccatcacatgctaacatattatggtaattggtgccttttactaagttcttaccgtgtgccaggcattttatacaaaaggaaataggggctcagagaggttgagtaaattgcctaatgtcaccaatcaaataagtagtgtagctggggtttgaacagattggtctggttgcaaaacacatgttcttttcacctcccaccgtacaggactatctcaagtgagtctgtggcccccaaaatgttatgctatgttactatgtcttagaagcttcctttggaggtaatggctggtttgataattcacctggggaaattaggctactagctgtagtcattgcctgcctcaccactgaaggatctgtaaaataccatagaatttcacctatttcgattttggctgtatggtatctgggacaaagggggcaatatatgaataaatatgagtgattacaacatgtctagcttcagcttttgcctaataaattgatatttatggtccatagaaggattatgacctttaaaaaataaattttaatgagtacattgctaggttacaaatctcaataaatctatttacacataaattatatatatatttatatattcatgagaacaaggcttttggggaacactgcctgaaaaacatgaaccctacctgggtttaataaacaagtattcactatagttggaaatgtcttggaatattaaacaacatggtgacaaataataacagtgaaatttctagtcattagaaatttagttttcaagtagttttaagcatcttctacttatttttaaaaattacaaatgtaatacatgtgtttgtgaataaaatatatttaaacaatacaaaatcatatgaaatatcaagtaaaacctacccttcactatcctcttcacagaggtgtctgttaaaaaattttttccatgggtttgtaataagtgtgtgcatgtatgtgcatgagtgtgtacagtttttaaaaagggatggcactgggagatatacctagtgttagatgacgggttgatgggtgtagcacaccaacatggcccatgtatgcatgtgtaacagacctgcaagttgtgcacatgtaccctggaacttaaagtataataaaataacataaaataaaataaaataaaaaggacagagtgggaaataaaataataataataataataataataatatatacatacatgtggttctgcaacttgatttattttaacttaatactatcatggacagacacataggtatatttagatctgtttttagggctacatatattccatgcaacataatttacatgtaacataatttatttaactagcccatcattgatggccatttaagttgctttcaattttttgcaattacaaataatgctacagtaaatttcctcatacatatatcttggtacgtttaggttttcaattttgtaagacacgttcctaagggtagaatttctcagtaaaagcctataagctgttacaatttaaatagatttatcatttttactagttattttattaatgtaactattcattgaaaattaattgacctctaaaagtaaaattactagatatatatggtaaaagatttaaaaatacataaaagtataaatctaaagtctcctttcacttcaatcttttactctatgtgtctatccccaaaagcaatgattgttaataatttcttatatatccttgcggaaaaaatgtaaaacttgaatttacatgtaaatatattttttttctttttcacagttgggttcatcattatatgcatccttttctgcatcttttaaaaatttaataatatttttggaggcattttcatatcagaaaatatagagctatctgattcttttggggggaggctgctgaatagtatgaaagaaaaagggtatggtataatttattcaacaagctctgtttgaaggactttgaagttgtttctagtttctagctatgacaaaagtctacagggcttttaaaagtaatgggtggtgacagaaatatcttgaagcaaccgtaaagaaattatcacaagctaaagttcctctcaagatatggccagcataatttcctaatctcaactcagacacatgatcaaacaaaggaattttttttgacctgtgaatgtatgaagaaaaagagtcttccaaagacatgcagattaaattccttttagatctgcatttaagaaatcctttctattgaaaagaatgaaataacctgaactgagttcatcatgggaaatctacactgtatcaaagcatagcatccctatatctgcggggtcattgatttgctgaggttcgttaattggtctaatgctccagcttctttgaattagtttatgaattgactattcttaaaatatgcagagatggattatatggtctatgtcctttataaaggcctttgtttggctcactattaattcctctatccaattatcagctctgataggaaaagttccatggtgatgggctctactagctaaaagacaatttggtcttgccctcatacatcaattctctgtgctaccctccttcctcatcacgaaaagtaagcatgagctgtttgtagttcactcaaagccttcttatttgtattctccttcacaggatgacattctcctatagactcagagatagaagctctagcctgtctgtctattgcagcattcgtttttcatgcttttgcctggaaactgaatgcagacaccactttgaaaaaaaaaagtttccttttcaccttaaagatactcatttcatatttttctaccccacaggcagatctgtctgtggcagtttctggtcaccattatctctcacaaatctaatcaacatgctgaattatatttatagaggtcctgactgaaagaaaaaccagatgtgacatgtgggctagaacgacacatagatttaatatgaggtgatatacccaaatcacaaccagaatttggtaccttagaaaatgttctacttaacattctgttggcaggtacatctgcaacaaaatgcctcataaatattcagctactctatacctctgttctccagctcccaatgattacaataatacaattttgtgtagagtgaaagagcaaatggcaattaagcccacagacccctgtgaattagtatggattatctccactttaaaatacagagacagcaaggcttatgcaaattatttgtgcaagtgatcacttgttcacaaacaggaacaaagtgaatatggcaaatcatgtttgtgagccctccaaggatggaggcctgacctcatggcttctgtccaatgtgaatagatggatattcagtcattgctcaagcacagtactggcttttgcatttgattttttttttttttttgagataaggtctcactctgtcgcccaggatgtagtgcagtggtgcaatcagagctcctcactgcagccttgacctcctgggctcaaaccatccccctgcttcagccaccccaccccgagtagctaggactacagatgtgtaccaccacacctggctaattttaatttattttttattattttattttattttattttttggtagagacggggtcttgctatgttgcctaggctggtcatttactttttattaactgaattttttattgagagataattgtagattcacatgcagttggaaattcttgtacactttgtctagtttcctctaatggtgacattttgcaaagctatagtataacaaacagaacattgacattgatacaacccaccaatcttactcaggtttctctagtttttattatattcatttatgtctgtgtattaagttctatacaattttatcacctgggcaaacttgtgtatctaccagcatactgatgctgaacagttctaatactagtaggatccctcatgttgaccttttataaccacaccaacttccttcccaccctttccccctacgctgcttcatacctaacccctgacaacactaatctgttccccatttctaaaattgtgtcatttcaacaatattatataaatggaatcacacattatgtaaacttttaggattaccttttttttttttttaactcagcataattctctgaagagccatccgggttgttgagtgtctcaatagtttactcatttccattgctgagtagtattccatggtatggatatgttacagtttattcaattattcacctgttgaaagacatttgggctgatttcaattttttgctgttataaaaaaaatccctgctatggacatctgtgtacaggttttttttgtgaacataagtttttatttctctgggaaaaatgccttggcttggctgtatggaagttgcatgtttagtttttttcttaatttaaaaaataattaaatttctgtgggtacatattaggtgtacatatttgtgtagtatatgagatgttttgatacaggcatggaatgtgaaataatcatatcatggtacccatcccctcaagtatttatcctttgtgttataaacaatccaattatactcatttagttatttttaaatgaacaattaagttattattgagtatagtcaccctgctgtgcaatctaatagtaggtcttaatagtaggtcttattctttctaacttttttttgttcacattaatcccctccttcccctcccccaagtccccctctacccttcccagcctctggtaaccatccttctactctttatatccatgagttcaattgttttgatttttgtagcccacaaacaaatgagaacatgcgatgtttgtttttctgtgcttagcttatttcacttaacataatgactccccgttccatccatgttgttgcaaatgactggatctcatttttttgtggctgaatagtactccgttgtgtatatgtaccacatattctttatctgttcatctgttgatggacacttaggttgcttccaaatcttagctattgtgaacagtgctgcaataaatatgtgagtgcagatatctctttgaaatacttattccctctcttttgggtatacacccagcaatgggattgctggatcatatggtagctctatttttagttttttaggaacctccaaactgtttgcacatttagctttataagaaactgtcagactgtttacaaactgtcagactgttttacaaaactgtttttcagttttacaaagtagctctatcactttatattccaccagcaatgtataagggatctagtttctcagcatctttgccagcatttggtgttgccactatttttcattgtagtcattcttgtaaatttgtagtgatattttattgtgctttcaatttgcattaccctgatgcttcatgatgttgaacatcttttcctgtgcttatgtgccgtcttcctgtgttcatcagtgaaatgtctgttcatgtgttttgcccttttttaaaaactgggttgtttgttcattttattgttgagttttgaaagtaaaaaaatatattctaattttttttttttttttgaggcggagtccggctctgtcacccaggctggaatgcagtggtgcgatctcggctcactgcaagctccgcctcccggggtcacaccattctcctgcctcagcctcccaagtagctgggactacaggcgcccaccaacacgcccgactaattttttgtatttttttttaatttttattttttttattatactttaagttttagggtacatgtgcacattgtgcaggttagttacatatgtatacatgtgccatgctgatgcgctgcacacactaactcgtcatctagcattaggtatatctcccgatgctatccctcccccctcccaccaccccacaacagtccccagagtgtgatattccccttcctgtgtccatgtgatctcattgttcagttcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggagtcgccacactgacttccacaatggttgcactagtttacagtcccaccaacagtgtaaaagtgttcctatttgtccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagcccttttcagatgagtaggttgcaaaaattttctcccattttgtaggttgcctgttcactctgatggtagtttcttttgctgtgcggaagctctttagtttaattagatcccatttgtcaattttgtcttttgttgccattgcttttggtgttttagacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaatcctagaagaaaacctaggcattaccattcaggacataggcatgggcaaggacttcatgtatttttttttagtagagacggggtttcaccgtgttagccagtatggtctcgatttcctgaccttgtgatccacccacctcggcctcacaaagtgctgggattacaggcatgagccaccgcacccagccctaatatattctaattttttgttgggtatatcttttgcaaatatttccttctagtctgtagattttttaaaattctttttgtatttatttgtttatttatttatttatttatttgagactgagtcttgctctgttgcccaggctggagtgcactggcacgatctcagctcactgcaacttccacctcctggattcaagtgattcatgtgcctcagcctcctgagtagctgggactacaggcacatgccaccatgcctggctaatttttgtatttttagtagagatgaggtctcaccatgctggccaggctggtctcgaactcttgacctcaaattctccacctgccttggcctaccaaagtgctaggattacagcatgagccaccacacttggcctaaaaattctttttatatgggctttcacagaacaaaagcttttaattttgttaaagtctagtttattatttaatttttttaatgagtcatgctttcgatgttcaagtttaagaactctttgcttagccctagatcccaaagattttctcctatattttttctaaatattccatagctttgtactttacatttaagtctgtggtccattttgagtcaatttttgcataagatgtgtgaggtgtaggttgaggttctctctctttctttctttctttctttctttctttctttctttctttctttctttctttctttctttctttttctttttctttcttttttttggtctattgatgtccagttgcttcagtattaattgttgaaaaggttatacttgctttattgagttgattttgtacctttgtcaaaaatcagttgagcaaatttttatgtgtctatttctgaattttccatcttttccaatcatctatgtatctatccctctgccaataccacactattttgattgctgtaactttacataaagccttaatattgggtagagagattcctctaaccttattcttcttttcaaaaattggttcagttattctaggacttgtgcatttccataaaaattttagactatgcttgtctgtttgcatataaccttgatggaatattgataggaattggattatatctgtatatcaatttgaagagagctgacgtctttactatgttgaatcttccaatccgtgaacacagtgtgcttctccattttttaaggttttctttgatttgtttcattagcattttgtgatacacatgctttgttaagtgtatacctaagtatttcattttcattggagcaattgtaaatagcattgtgcttttgatttcagtttctgcgtgttcatttttaggacatagaaatgtgattgctttttgtgtgttgattttgtattctgaactcatttataagttctggtagatttttttcttgaagattccttgaggttttctatctggactactgcataatctgcaatgccttaaaaaatttttttttgcctttttggggtgcctctaacttccagtaccacgttgaatcatactggtgagagtggacatccttgccttgttcctgatcttagctggaaaacattcaatctttcaccattacagttgatgttagctgtaggtttcttgatgatgccacttaccatgttgctaaaaatcccctctattcttaacttgcccagagattgtatcgtgaagggatatgaatttttgtcaaatgccttttttggatcagttgatataatttttcttctttatcttgttgatattgtgggttatactgatagattttcaaaggtttagccagctttgcatatttggaatagatcccacttggtcatggtatataattatttttatatattgtttcatttagtttgctcatatattgttgaggatttttgtatttaatttcaggagagatattggtctgtaatttctttctttttttttttttactgtctctgatttcagtatcaggatgacactggccttataaaatgtgtaggaaagtgttcctcttttctggaagagattctataaaattggtgttaattcttccttggcagcaaactccagtgaaatcatgtgggcctggagattattttgtgaaggcttttaaattagtagttcaatttctttaatagctatagggctattcagattgtctatttcctcttgatggagctttggtaaattatgggttttgaggagttgtctatttcttctaacttgttgaatttgtgaacataaagttattcataatattctcttattgtctttttaattgctgcagaataagtagtgatattctctgtttcatttatgatattgatgactgacttgtgcttttctctttttacttttatcagtcttgctataggtttatcaattttattgacttaaaaaatcatatttgctccattgatttttctctattgtcttcttatttttaatttcattgagttcttttatgatcttgcttatttttttattctgcctgctttggatttatcttggggttttttttaggctcttgaggtgggagctgagattattgttttgagatatttcctctttttaaatgtatgcatttagtgctataatctttcttctcagcactgttttagttgtatctcccaaatttttaaaattaaatttaatttgattaaaatagttttatttaattcaatgttttaaattttttttgttaaaatgtcttctttgattcatgggttatgcggaagtgtgttgtttagaacttttctatggtctttctgtaattgatttctagtttgatttcataataatcagagaaaaccatcttataaattcagttcctttaaatgaggtttgttttatggcccagtgtatggtctatgttggtgaatattccatgggtgcttcaaaaatatatatattctgctattgttgagtggagtgctctatatcaactaaagtctgttgattgtgttgttcagaacttctatatacctgctgattttctgtttagtagctttatcacttgttgagacaggggtgttaaaattcccaactataattatggatttactatttttcctttcagctccatcagttttgcttcatgtattttgaggctctgttgtttgatatgtatgcatttaggatcaccatgtcttcctggtgaagcaatgcatttattattatgtagtgtcctttcttgagtccagtaattttccttgctctgtactctagtgaatattattatagccatttttactttccttaaacttactgcttgcatggtataatttttccattcttctactttcaacctacctatatgatgatattcaaagtacattcttttgtgaacagcaacatatgggttacttgagcgtactttaatattccatcttgatttatttatggggttttgagtttctctttgcatggttttcctagtggttggacttggtattacaatatgaaaatgtgactactgttgtcagcattttatcagtttgagtgaggtatggaaacctcacttccattttggtcctttgactttcctcaccttttagattttttttgaagggatcttgttctgtcatccagactgcagagcagtggagtgcagtggtatgatcatagctcacagcaacctcaaactcctgggctcaagtaatcctcctgtctcggtttcccaagtagctgggactataggtgtgcaccaccacgcccagttatttttaaaaaaattttttgatagagatagggtctcactttgctgcccaggctggtcttgaactcctggcttcaagcaatcttcctgctttgacctcccaaatttctaggattacagacatgagctgccatatccagccacttttaaattttgttgttttaaatatcagatgatgttgcaatttttgtctcaatcatcaaatatgatttataaagctcatgaggaaaaggatcatctattttatgtacccatatttttgttctttcctttgctcgttttttctttctcattctccaagattctttaaaaaaattatttctgtttgaagtaattcctttagctaatcttttaaagataggtctgccagtgacaaggtatcttaattttccttcatcagagaatgttttcatttccattttattcctgtaagatagctttgctggatatagaattcatggttaacaattcttttctgtcagcttttgaaaaatattatgacagcttcttctggcctccttagttctggatgagaaatctgtcatttaagttgttgctcttctataagcaatgtttgtttctttctgtctactttcaaaattttttgtcttttagttttcaaaagttcaattatgatgtgccttgccacagatttctttggcttttatccttcctggaatttgtttagctttttgaatctctaggtttgtgtcttttgtcaaatttgggaagcttttagcctttatttatttattttttaatatacattcagccccactgtctttctcctctcttttaaggctatggtaatatgaatgttggatattttgttattgtcccacaggtcctagtggctgtcttcatttttcttttcaatgcattttctctattgtttagattgggtgaattctattattttatcattatgtttacctgttctatcttctgtcatctctactctactattaagtccatccagctcgtcttaaaaatttggttttgtattctttcattctataatttccacttggttcctttttttttttttcaatacagagtctcgttctgtcgcccaggctggagtacagtggcgcgatcttggctcacagcaacctccgtctcccgggttcaagggattctcatacctcagcctcctgagtatctggcactcaacaccatgtctggctaatttttgtatttttagtagaaacggggtttcatcatgttggccaggctggtctcaaactcctggattcagatgatccgtcttcctttcctcccaaagtgctgggattacaggcatgagccaccaagcctggccccattttttttccaaataatttcaaaaattttaagttcaggatttgcagatttgttacctaggtaaatgtgtgccatggtggtttgctgcacctatgaacccatcaccttgattctttcttaacaatgtttatttcttttctgagattctattttttgcatttcaagataatttgtaattgcttgcaggattatttatatgatgattgctttaatatcattgtcagataattccagtgtctaattcatctcagttttagcatcagttgattatcttttcttactcaagttgtgattttgttgcttctaaatatgacaggtaatttaaaaaattgtatcctggacattttgtcaattaggagattctgggtcttttttaaatcttttattttagcagtcagtcattctgtttaggcttagcacacaggtcttggtccatttttgtgggctgtgcttccaaatacaacttaatttttatagtctttgtgatgttatttcatcttgcttggtttatctggtacccctgaggcttccacctgtctctgctggtgcttcttgggtggggagcagaaggcatctccttaggccaggcctccagctgtctctcagagggggatggatgtgggggcatcaccctaccaatgcctcttgacttccgctagtctctggacaggaaaggaaaatcttgggctagttttcgtagacttggccacctgctgctggagagtccctttttcttgtttcccctgcctaccttggtgtctctgggtgagggaagagaatctcagtactgcagggacaaaaagacttcctggatcaggccacttgctattactggctccctttttcctcttatgcctgcctgccttggtttttctgaatgggcgaggaaaaccttgggttggcaaaaacaatagtcttcccagactgggttatgttcaaccagtgttttttggtggagaggggagattcaggcctgttagggaaggagagtgcttctcttggttgcttattgttagcaaggtgcccagtcagtcccccttgctggagtatccaacttgcctgaagttgtcagagggactcccatttgatccagaaggggaatgagcctacttggactgacttctgtttctaggttggggattaggaagcatagggcctgggccgcatttttatgctgggtttggtgagggggagaagataactgccactatgttgttcctttactcttggggtcccaaaccagtttgttttattcttagcacctttcatagttctcctttggttgtctcttacaccatttccaggatttatagttgtaccttttggggaggagcagggaaaagtggctctatgccatcttgttcagttgagaagtctgcatttgcttttaacatcagttcttgggcagtaaaagctcttgagtgtgtatgcgtagacagatagggtgcaacaaaatgacagagataatatcactggcattgtaactaccttactcacttacaacattttcttttctgagaaggacaggcattaaattcaatggagataagtgtgccatttaggataaaaaaaatccctaccacatatagggaaaagagaaagattgatgaagcagaagtaaagtgaacctcactcattagaaatgataggtgcacagaaagtctgaattactgaatttaagaaaaacaaaagtatgtacagattaagacaataaggtcaccaataaacaaattaagttataaaagaaatttatattcagtatcagcctacattatacaaaatgatcttgaatgttcaagatcattttcaatgccaacccattgcaattaatttctagacttaaggtttataggaatctttaattccaatggatcctgattctaaaaagctactgattgtttgattgaattgtctttatctaggatatgaatgattattcaaggcatatatcatatcagggaatgtccataatttgggatccccactgagttttgattcctgggccagcaaagtcgccttgatgttttagtttagcattgcaatgctgtcctctaaagtttgtttcactgttttggatgattgctgtttcttgcagtgttcagcacttgcagaacttggcatttagtatctaactttgtttctccttggtaccttcagaaagagtctctttctttctttgtttctcctcagattggggtgtttccatataaattgagggcatacatttatgaggaatttgagggcatacattatgagaaattgaggcatttctacatactgtctaatttcttctctaaatctttcatctgtggaaatctcatttcaacactgcacttctctgggcctcatctgtaaatgaaaggattgaatataatctccaagtcctggctctaaaattctgggattttaatgaatgaagactttagtctttattaatacagactttagaggaaaaatttgatacagcagtccctctggaagaaaccttgcatctgaaagatttaatggaaggtttgctgaaatatacaaacccaggctttaggttaaaacggagcaatgtaacatgcattatttctcgagatctctggtacttaaaatgccacctgcttggcaatttagctcaactcatttgtttttatctttctaaatcttatattccttcttgagatgcttactggaagtgttaataacaattgctacatctatggctcagccctctctgataaaaataccatgtctaactcccattccccgtcttctaaaagagttttccactacttatggattactccaatagtgctctttgaatgctgcatcaaagaagataacttagacttttatggtatttagtgttttattgttttcctaaaaagtgaatgcagttcaatcattaatcttttgtaaaggagagggaattgtgaactcttctctcaacaattagtgcattcatagagtgatttcaggctctaggatgccacactcctcaaatgtgctagaagtgacactttcacggaggtttgctaagccagttggctggtgtaaacccacctacaaaattggaaatgaagatcctgacaattctcctttcacgtggagttatggacaaatttgaaagcataaagcttaaaatactcacttggctgctgaaatataccagtttcttgataaggcctaacataatgtgcatctgtggtaattggaaaaatgtcataaaattaagtgaaaaagtactttttatatagctttgtcttttccccttaaaaatgtgtgtacttttatcaactcatctatacagtcaattggaagattgtcattcattctacttgctaatgaccacaaaatcctgaagaacatcctacacacacctcaaaatttctggatatgcaaattataagtaattttaatgctcaagacagtgaaacaaatcagtagattgtctactaccacaattattcctacatcataggtaatatgcttctcagatggataaattcaaaatactaatttccctaaggtaaatatggatgtttgggtgatttcaattggagaaagatcatgactcagtcttgaattttactatgtaccattttcacttggatattcactatcatcctaaattccacttatccacgtctgaactgggtgtttttcttctgagtgaggctgccttcccaatttttctgtttttatgaatattatcactattctccgagttgcccagaagcaaactttgagttctctgagatttctgtcttctttatctcttaaatctctttgttatcatacactgtcaattcttactttccagtagatatagggataggaatcttcacactgctctcacatcattccaagccttattcagttattctattagcttacaaatagatactaaacatctaccatgtgccaggcactgggatagacactaaagatacaatggtgggcaacaaaagatgaggactctgtccatgtggtctagcgaggaagacagacattaaaaatcacatgcaaacaaaggtaaatctccaattatgacgcattaaatgaagaagaggtatgaggcgtcataagagtctaaaatagattggtgtgagctagtcatggaagtcagggaaggtaggtttccctgaagaggtgatgcatgagctgagaactgaagaattggcagaagttaatcagatgaggaaggatgggaagtacattctaagtagaggttacagcaaatgcaatggtcttgtagtgggaaagagcatgccaagtattagagaactaaaaagaggaagactaaaaaaaaacagaggggacttagcacaaattgagactgaagagctagagagggaccaaatcatgcatagctttatatgctttattaagaaaaaattttctttttatcctatgagcaatagaaagcaactaaagagagctcagtgtgtgtgtgtgtgtgtgtgtgtgtgtgtgtgtgtgtgtgtgagagagagagaggaaggggatcagattggcacttaaaaagatcattttggttgtattatggaacagattagagggggtccaagagtagtggcagactagttcagttgggaggctactgcagtagtccaagtgaaagatgatggtgactggttagggtggtaagtgatggagatagagataaactggggtgagccaagagatatttaggagctacgatcaataggacaagattatggattggctatggcaggtgagagagagaatgaaggagacagagggagagacagagagttggagcttgcataatttaatgtatgatagtgtagggccagtcactaaaggaataccagaagaggacccagtttggagagaagctaatgagttcaagttggagaatgttgagcttgaggtgttaatgagatatccaagaaacgatatcaagtaaacaattggttatataaatgtggagctcaaaatagagcaaaatagagatctggtcaagagatataactttgagatttgtctgggtataggtgtaaattgaaatcctaggtgtagagaaactatacagccaaatgtgaagaggtcctgggacaaagcgttggtcaggtaaaataggatgagtctaaaaatgagtggacagagaagtaggagaaaacgcaggagtgtgatgtgtaatggaaagcaatgaaaagagtattttaaactcattacttctactaaataaatgttaatttgggagttccagattaaaacattttcaatctggtgtttaaatgactgatagaagtttgaccaagtgaaagccaactgttttttgagcacttactctgtataagaagctatgctaagtgttttatgcacattaactcaatctcataacgattttataggataggtgttattataatcctcatattatagaggaggaaactgaagcacggagaggttaagcaactagtccaaggttatgtaatgggtgtgaaagtgatggagccagcatttaaaactaatccatttgaatctaaggttgattttttctttttggaatattttaaactacacaattcaatttctttaatagatataggactattcaagttatctgtttcttcttaactgagttcttatagctgtatttttcaaggaattggatcctttcccaaagctaatcttcttaatcaatgcactactgtggcatgcatccctctttcaggaatgtttatatattttatgaagatactacgaaatggatatcttcctaccagttacttaaccagagtgttatgagtaccatatagaggtcttagagagtagaaaattatcttaaggaaaatcaagtgatcaagtgatttgattatatctatgatactttcttacaaaatgaaaagaaattatagagctctttctagttgtctctaatttccaaagctgaatccaaaataacacattctttctgatttttttagttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacaggtactgctccataatgcatgtggtgtagccccaacagaattcatgcactatgggtcatgtgttctccaaagtggcccgttcttggaaggcagaaaagaatgaagaagggtgcaggtgtttcttgtctccttcagacagtgggtacagtgagtaccttgtccaaatacaaaattctctagccatctttcttgtctttgccttattgaaatataatgtaaatgtatgttttcactcagcatgacaatttctaagcctactttccacctgttttgttcttgactgtctgactctgattctgccaatgtgcacatggactaggaacctcatcccttcccagtaagagaatcatacggccttaggtctgagcatgctgaccacacaccagaaaacaccagaaaaaaacaccagaatatatcttatcttgccttttggattccttttatgcaggtctcagccttctccaatccctacctgcagctgactaggagtgcttgtccaaggccagggaatatttggcttccatattgttcaaatttggaatattcctgcaacttttaacattctacaatagaaatttgataggatacacaagagcaaaagggaaaaaaggagagaaaaacccaaagcagaaaacaaggcacaggaagaaaaaaacagttactttctcagagaaaatgatcttctgagataatgttcagtttggccattgagtggactgaaagtctgttggccaatgagagtggagaattggtgggatttgtggagtgtctgtcaactagaaatcaaggaagtgcccaaataaagcaaaactgggatggtaacgtcctgttctgctttttgatatggagccgaaagtgttggttcttgaccttggagttaaattaagctaagtttaggcatgagacgttattatttggtttactttaaaacagagaacacttttcaccaaatttacagaagtcaaatttcttgaactaaatgaataaaattaacctccttatttttaattacagtttccttctacaatgttgaaatgagcttctctgtctttgttgaagagccaaggatccctattaccagtgttataaatgaatttacggaaaattcggtaaaataatcttttgcatatttatggcatatataaatatatgtgaatatatacatttatatatatgacagaatatattaaaactaggctttacttttttctaccaataataaatttcacagctaagtagtttttttttttttgctgcaaatctgtctactctgtaagcaacatcatgagaatgtatgcaatctctctttcatagtgccaatgttgaaagcttttatggaacgttattattttcatttgttgagatctgtacatttccctttagagacacaaattctgagtctttgccaaattttcctatttgggaaaagtgggagagcagtgataacaaaatgtatacttaaatacaatggtatttaagtattattgttttctgcattttatttctttttccaacacaatgaatgttttacttatccttaattttttcttgatatgactaatacatactctctgtaacaaaatcagacattgacatcaaaaacccagaaagtaaatgtcctctctctaatactgctctgtgcattaactcctcttaatagtttaaggtacattcttttagatattttttctgtgcatattataacattgatgcatgtgtgttcttttacaaaataattgtagttgtactagttatgctatttttcaacttgctccccctcctctgcacttaaccatgtatctttgcacatattcatgctggtaaatataaatcatacactttaacagatgcatagggtttcactacatggttgtagtatagttttttttttaaatcctttggtggacatttaagttgtttctatcttcttctctatttagaaacaatgctgggctgggcactgtggctcatgcctgtaatcctagcactttgagaggttgaggcaaaaggattgcgtgagccaaggagtttgagactagcctgggcaacatggcgagatcttgttttctttaaaaaaaaaaaaagtttaagaaagaaacaatgctgaaaacaattccctagaagtaaattttaaggcacttaagtatttttataggataaattcctagaattggaatcagtagatgaaaagatgtgaacctttcacatttaaatagctgtcactaaatggcctcccagataggtgacaccaacttgcaccatctcccaacagcaaataatcatatctgtttcccttctttccctgtcagcacttattttcaagtgtctatggcttggttataaatccttgaaaatgggtgggtgtattagtctactcaggctaccataacaaaatgccacagactggatggcttaaacaacagatgtttattttctcacagttctggaatctggaagtctaagattaaagtgctggcagagttggtttctggtgaggcctctctccttggtttgcagatggccatcttcttaactgtgtcctcacatggactttcctctgtgcatacgcatccctggtctctctttttcttcttataaggacactggtcctgttggagtagggctccacttttatgatcttatttaaccttacatccccaaaggccttatctctgaatataaccacattcggggttagggcttcaacatttgagttttggaaagacacaattcagcccataatagcaggtaaaacgtaaatggaaaaacttaatggagcagatggaaatgttgagccagctgaaataatgagtgcagcttaatgatcacaccatcccaagtgattttgctgagttaaactagaggagcagaatactaaaactgatttttttttgtcttgtacagttgaattctatatttcagaacagtgaattttctcttgctactctggaaacccaaattaaaagcaggtatgtgaatgacatttactgtgggtcaaagggcaatttgagggcattttgggtctgttcctatctggaggggatgtcctatgtttatgtctgagatttagggctgccacatttttagttgcatcttccttcctgagtaggttctttttggcatgaggaaaaaaattgtattactattgtagggcacaaagccaatgggagaacaaaacaaaagaaaatcaataggggaagtcatgcagttagactgagttacctctaatgcccttttcatctctaagtttctatgaatctgtgatttatacaaaaatcatgctttgaagtgctatgtatggacaatgcacgaggatttataaggccttttattttggaatgattcactttcagaaaagagaaattccaaagtgaacttgaaatgtctaaagcaagaatgttgactaatccaagatttgcttggggcacaaatttcgaaaggtgattgcagtgaaatgggcaggcactgagtagtatcatggaaactatggcaaaggcaattgctcacctgagaagtatttcctgtattctttcgctgcacatatactagtcctctgtaaagggacaccccgcagaagctctttgaaaaataggcatggctctgttaagccatggcaaactgatttttaaaacataaaatgctactgcctgtcttctgtacactgggactttggtttctcttacatatccaagtattaattattaatcaagtattaattcatatacatattaataggttcaagaaaattcatataaatgaatggaggtaaatgtacggtaggttattgtcttagtcagttttgagttactataacaaaaatgctatagactaggtggcttaagccacagaaatttattgctcacagttccggaggctgggaagtccaagatcaaggtgttggcaggttcagtgtctggtgatggccctcttcttgctgtgccctcaagtggcagaaagcagagagacagaaagctctcctgtctcttcttataagggtactgtttcaaaaaaattcaaactgttttttttcctctgttgtcataccaacacaacaatcaatatagaagacttctacgaccaaacgtgtggggattttcccccaacacaccaagcagctgacaccagctggttgttctctacttcaattctattctggtgttatcctctcaaaaatagcttcagatctcacaggtccccaagactgcccctcaccccagacactagtcaaaagtccaggcctccagaacttctgactaactgacttcaacttggggttcccgtgacccactctttgagcttgattaatttgctagagcagctcaaagaactcaggtaaatacttatgtgcattggtttattataaaggatactgcagaagatacgaatgaagagatgtgtaaggcgaggtaagggacaaggggaatggagcttctatgatctccctgggtgcaccaccctccaggaacctccatgtattcagctcttgggaagctctccaaacccagtcttcttgggattttatggaaacatcattatgtcagcattcctttcccaagtctcatatgaggcaagactctttctggagagggtcttaagactcacaatcagaaaggtgaagaaagattagagttccgccttggggcaggtgaaaggagggtgggagaagatcagagagattctgtttgctgaagccagcttctgaggcctagcacacctaacattataacaaaagactgtaacaagggctatgggagttatgagccaagaactgtggatgaaaacatatgtgtacacacacacacacacacacacacacacacagagacacatataacacatcaggcaccgattccattcatgagagttccaccttcatgatctaattacccctcaaaggccccgcctcctaatataatcacactggggattggacttcaacgttgaattttgggaggacacaaacattcacaacatttaactcactaaaccaaaactagagatgtctgggggtataaaacattctttttaaaaactgtgtctattatttttccttattacaaaagtaatatgtgaccactgtaaaatcttagagctttacagaaatatatatatatataacatggacggtaaaaatctctgaatacttgccttcccccaccccttcaagaactcctgttaacagcttattttattgatttttctagatttgttttcacacatttactaagagaataagattctcctctacatactgtttgacaactttcttttcatgctttgtaatacatcatgtatgccttttcaggccaatacatgcagatatagctcatttgttttaataattgtacaggattcttttatatgatatgccatgatgttttcctccaattatctagtgatggacacttgagtaatttccacttgtatgtctatttttatgcacttttgctggtaccattatggaatagattccaggatgcaaggttaataaatcaaaggcttgccaccattttggtatgcatataataagcaagcccattggaagcattcctctggagccctagcattatttgaattccaggctgggagaagtctactgttctgcctcagagttgcctttctcctgatctcatgccctgtatacttggtactatatttcattttcctataattttgtaatgcttttgatacagggacatttcagaggaagagatggtcatggatcgagctattgtaagtaatttttcaaaatgaatctacttgtgacctatcctatgcctgattagatgtaagtcaatagctcttccacccaagtatatattatcaggcgaggctttgttgtggcaattgggggtcaaattacattacttcctttgggattggtacaaaaagccatcaagaaaaccatcccctgcttttttgaactatccatgtggcagctttttgaggcacattttctggtctacagggattgtaaatggtaagtgaatttcttcgttatagatgtcttgcaaaaaaaacctagctcttccaagagtgacacaattgtttgcaagactggcattcacacaataaatccaccctctatttgtccagatttgaagccagagtgtgataaaactatctcccatcatccttgccccaattctcagttcttgttccattgcctcaaagctttacaatagcacactctaaaatgagtagcaagcacacagctttccaggtatttaagtgtgaggtaagtatttgatgatacagaatacaatcaagcccacagtacaggggccagaagcagtgactcacacctgtaatcccagagatttgggaggctgaggtgggaggattgcttgaggccaggagttcaagaccagtctgagcaacatggggagaccccatctctacaaaaaataatttaaaaatattagccaggcacggtggtgcattcctgtagtcccagctactgaggaggctgaggcggggggatcacatgagcccagatttcaaggctgcactacactatgattgcaccactgcactccagcctaggtgatagagcaaggctctgtctcaaaaaacaaacaaacaaaaacctatagtgcatagtgcattccaaattatccactatcattaaaaatattttctgtaaatagctgagtcagaaattttgatatatacacattatagcatgatataactaaaattcctttcagtaacaggtgtaaaatccttttggtgataatatggtcaagctgcctgggttggaacccctgcttttccacttcctgactatgagaccttgggcaacttaattaacttctctgtgctggagtttcctcatctgtaagatgaggactgttggaaggataaaatgagatcatctatgttaagtgtttaacactgggcttagaacatagtaaatgtttgatagtgtttacaattgtcaattgcatgttaatatctagatccagaaggcttagattctgctcctagttctgtgtcttgtcaactgtgtgatactgggcagaccatttaacttctctgtgactcagattcctcatgtaacaaagagggcgacaatccctgtattgcccaccctacagggttggtgtgaggagtaaatgcattgatgtttttgagggtagtttgcagacggcaatgagttacataaatgtgaagcataattatataattgttgttaacaataagccctgtactcagttatgacatttgtttaaagatttcagtgactatgtacttttcttttgcattagttggaacagagagaaggacaagaaatggctacaatttcctatgtaccatacaggtaggaagtaggaactgagtttattaatagctggcacatttagttctgattttccttccatttaattctgcatgtgcggccagttggccagagttgtcagaagaagatcaaagtacccagtgattatttcacatatgctgtaattaggtccttgccttcatgaaatatgttgtttcggttggtcatggcacaggctagcggccagcctgctgcctctttgcagtgaagagaaaaaggggtggtcataatctgggacgggggagtgaagtgtttgttttggtcaaaaaggtccacgaaacacttggcagggaaattggaaacaacaacaacatggaaagtagcttcggttctgttcagactcgtggtccagctcctcctggaatgctggctattgttgatctgttcgacgcacatcaggaagaacatatagtcaaaaaaggcccatgaagaggtctttgaaatggagtagagggtctgtcgcaagcaggaggagaggtttaaaatgaagactcctcttcggactggaaagatgaaagctgagaagagctaggctccaaaggaaggagacaggatgagcagggacttcaccaaatatagatcaagggaggggcagatatcacttagattagacatggagataagttttgagcaagtacaggtatgtctaacttgcaacaactggcaggaaacttagcaaatatcttcttcaaaaagccgtgtctacaaatggaaatggaaaaaagatataggtaagtttttgtatctgaaatgtgcttcctaatggaatattagaggaattcagaatatttgaggatcttgctgtagaggatagaggatgaagtcaaggacagctctatcctttcatcagtgatcttttagtggacataaatactgagtgagtttttgtgaccatgggaaacattatttccctgaggctgagttccatcatctgtgttatgggaataataatagcattacctcatacggtcgttgtgagaataaagtgaatcagaacatgtggaggaagggtttcacaaatgttagctactatcattatcattatcatcattattacttattatagaaatgagccttcttcagaacacttctttatagactaactgagcatcatatgcctatttgcctgatttcagtaatgatgggtaaattggagaccagaagaataaaaggttctctctgaaataataaatcctgaaaactccatcttctctattaattattacaaactcttagagaaatctcaaggctagcaatttcaacacaatgcatacgttactgaccattcttttgaaaataggttttgcattgtctgttttggataagagaaaatttatcagaacatttcagtatgctgtcttccatcacttcttaagattggctgcttaatagctgtaaaatgtttgacatttatgaactaccaattaaatcagctgtacagaatttctgcattgcaggccaagttgcactcccttgacataactgcaacaatctttcttttttattctgctttgtagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactaggtaatttttttggggggtggatattgcagtatgaacttacttcctttattataaaactcataatgcatacttggttaaggattctgagttcagaaaggagagaagtcatctttctgttttttttttcatattcttggtacccacttgatctgatgacctttctacctttaagaacttatggaagaacagaatgctggaggagttaccagagactgctggtcagctctggatattagcaatggccaatccgtcaatggaatgggaggattttctctcttgcataaatacacagagacctgaagagcttcctcattaacacacaataaatgcctaatagatacttgctaatttattgattgattcagccatcttattcatcttggcaagtgatcagggaactgtcccagatttctctcatgggggcattctctgattagcaaagctttactggtaaaagtgcaaggctaccaggccactccacctccttcccagtgcagctttgttccttttccccaatagactgctgtagaaatcattgagctcacacagctctaatgccagataacacacacaggcattagaacgcacaatccttggcaacagactaattaagtataagagggcagcctgtgacggtgcaggggtgtgagtgaaatggggggcagaaacgtgttgaagccacaggtagagcccaacatgtaaatgacactaatgaatgtgtcctaagaatgagaggaaggcacctttcaccctcactcagaatggagactgggatagctgagcaaagctggctgggccacttctcacagcattctctcaacacctgagggaaatatttccagaatcagggtcatgaaacccagtaagtgctcagaaaaaaatgggaacttatcatatagacttagcccatgtcacatctcccttcgtgtgacagcaaaaccttgccttaacagccctatgtggaagtttgccctgtccctcagcaacatcaaaaacagagccctagactgtgtgcagtggcttacacctataatcccagaactttgggagggtgaggcaggaggatcacttaaggtcaagagtttgagaccagcctgggcaacaaagcaagacgctgtctctacaaaaaataaaaaattagctggacatggtgatgcatgcctgtagtgccagcttttcaagaggctgaggcagggggatcacttgaggccaggaggttgaggctgcagtgagccatgatcacaccattgcgctccagactgggtgacagagtaagacctcatataacaaacaaacaaacaaaacagagctcccctgtctatactgatcatgtcagatacactgaatttactaaaatgaaatccatcccagagtccattaagaagggggccattccagagagagaagttcgtctatagtctcctgtctttggatataaaactgctaacagtgggtatctcagaagctgggcaattggtaggtgggaacttttgacttttgactctacactccaccacgtggcttgaaatttttcaattcttatgtattgttttaaaaacaagacagaacaatgtcaggtgaggtggctaatgcttatagtcccagatctttgggtggctgaggtgggaggattgcttgaggccaggagtttgagaccagcctctataacatagcaagacgctgtctgtacaaaattttagaaaaacctatctcatcaattcgttgttttaatgaaaaggactaaatatgtggttatactgggtggtttattatttaaaaaaaaaacactccatataatgatattttcaataaggcctggtccaaatggctaggtagaaaaagttttcttttttatttgctgatctttacgtgcagcataataatgacgttcataataatatataatattatattattatatagtaataataataatggatgtttgtaatacttttaagtgcctcttgtcctttaaaatgtgcatacattttctctgtagagcctggaaattgcaaagctgatgaaacagcctctaaatacaaagggacctataagtggctattaaccaaccctacggagacagcccaaaccagatgcataaaaaatgaggatggaaatgccacaagattctggtatgtacaggccaagttctaattgctgattcagatatacaaagatctacctaattggggacatgtttctatgtcatttgtctgagcatgctcccttcctccacctctagtgccagtctttctttctattacctttcgtacctgtttaaacatacatgcaacataacaagaaaaattttcaaggagacaaaagataaaagttacccatcatcccagaagaaaattcaagaagacaaaagagaaaaaagtcacccataaccccactgcctgaacacagctgtttttaggttggcatatatttttttcatgtaacctttctctgtatgcctttaagttttatgtagcagtaatcactattcttgtatcaataatgtaatttaccatttcattcaatggtttatcaaacattttccatgttttacatttattatcttaatgttcatttcaaaataacgaccttggaaaccatctagttgatgggctatagtaatttactaaatcacttttctattgttgactttatcattttcctttttaaaataatcagccctcttttctcactctctgctgttcatggtttatgccattaacttaagtgggcaaaaccagaggggcagcaggttttgacagaggcttaaaagcactcttttagaaagcaacattaggggctttccttttcctccctgtgtctaatcagttggcaagtcctgcagctttgatggtcatagtcagagcccacatctagcctttcctttccaaccccactgccactaccctggtgcaagcccttattgcccactattagagcggtctccttgccatctaacttaacagtatcccttacccgcctccgccaactatattctacactgctgccagcatgattttcctgaagtatggctgctatcatgccactgtcgtgctccagctccacattgcctcaagaattaagtccaaacccctaaatatagtccagaccgtaggcttcctctcctgctgtctcactcagcattctccctccctttatcatacgctccagtcaaaatgaccatttgctgttctgggctcaatggacgcttcctggtgtctctttctctgcctgtgctgtttgctcttcttggggttgggggaagagatttttctctacctctgtcctttcagcacacagctcagctcaaatgctgaaagtaacgtctctttccttggtagtttgatagattcagttttgtttatacagcttttcatcttatatttgccctaagtttcgagtagttacacttagaattttaaaccccctaattacaagttccttgagggagggatgaagccccaccctgtttgtgtgtgctacctattaccattcctagaatggagtgggtgctcaataaatgtgttagctgacttgaaatgaactggcttgaattgggtgaggcacaggggagggtggatgatgagggccgatgggccatcgagggttctatattaattgtcttaagttaatatgctgagatagagaccacattcgaacaggaatttccccttaaaagaggagtaagaagggacagtgagaggaaagagtcatgtctagaggaccagaatctctgtcttgatgcttggtcagtaggacattgccatgccccattcccagctcccttacctgtttatccactccccttcccccttcccacatgttgaccctagattcacttgctccctaagagcaaaatttcttcatttcacaaagaagtactgggctcccacctttgctttctatgccaggaggcttggggcaggcgaggagaaggcatgctaaggctatatccaccatttgctttaagactatctttgcctcatcctctgatgagaaagctctttcctctctttttcagttcaatcagcatcaacacgggcaaatctcagtgggaaaagccaaagtttaaacaatgcaaattgcttcaagaacttcctgacaagattgtggatcttgctaatattaccataagtgatggtaagattgttttgtacatataagacaaattatggaacttcaattactttgcctacttgaccccaaaccagagagagtataggcaaaccccacttaggaaaatctaccttacgacaatccaatttcagaacaaaggtaattaatgttggtggaggtggtggtgggacatgagatgttaggactatcagtgtttcagtgatttttgtttgtttttgctacatatatatatttgagatggagtttcgctcttgttgcccaggctggagtgcaacggcgcaatcttggctcactgcaacctctgcctcctaggttcaagcaattctcctgcctcagcctcccgagtagctgggattacaggcgcccaccaccatgcccggatgattttttctacttttagcagaggcggggtttcaccatgttggccaggctggtctcaaactcctaacctcaagtgatccacctgcctcagcctcccaaagtactgggattacaggtgtgagccaccgcgcctggccttattttactttttcggctaattattgtttttatttttttttaatttttaaaaagttttaataggtaatacttcactgacttcaatactcaaaaaacaaaaagagtatgtgtaaaacatctccctcccactgctgacctcagccattcagttactatccacagagatattttatggatccataatgaaatgtgtatacatatttgtgtatgtgtatattgtatacacacatatacttgccctcactttttgtacacaaagtggagcatactatacacactattctttacgttgcttttttctcttaacaatatattgcagagattattatatcagcctataaagaattttctctttcttttttccccttctgcattgtattatatataccacaataaatgtgccacaatttatttaacctgtttcttatggatgagtatttaggttgtcagtaacatttttctttgaaaacaagactgtacaactatttttgtgtttttttcattgtagggaaaatactataacatatttttaaaaatactcacatgtttgatagtgtataagatgttttagagttggtattgtctaagcagctgatatagaaggttgcatttctttcaaaaatacatttgtagaccacattagcttttatttttgtttgtgacactgttagcataattcatattattaggcaaaagagattcaaaataaagagtatctcttttaaaaaaccactgcttcgatgaatattacatatatgtcagaattttgagaaagtaggggtatacctaaagcataaatccttgaatgtagaatttctgggtcaatcatacttttgatggtgtcaaaatgctctctgtaatagttacagcaatttagattcccacttgcaaattatgaaaagcacctttttcgcaactccttcatcaacacagcatgtttgttatcagacttctggatctttttgcgatgtgataagcagaaattgatatctcaatgtagtttacaaactttttaatggagatatttacatatcataaaattcgctcatttaatgtgtacaatttagtgggtttttaaaagcatattcactagattgtgcaaccatcatcactaattccagaatatttcatcaccccaaaaagaaaccctgtacccattagcagtctctccattcctcccccaccccagctcctggcaaccactaatctacttttttgtctctatgaattttgccaatttggggcatttcatgtttctgaggttcatccaatgttgtagcatgtatcattgcttcattcctttttatggatgcattatattccattatatagatataccacattttgcttattaattcatcatttgacagatatttcttttccatcttttggttattattaaaaatctagctgtgcacatttatgtacagattttatgtagacatatgttttcaattttctcgggtatacactgaagagtagaattgctaggtcatatagtaaccctatgattagctttttgaggaacttcaaaactgttttccacagcagttgtgccattctacatccctgccaactctgtatgaaggttccaatttcttcacatccttgtaaacacttattactattgtctgtcttttagattatggctggtagtaatgccccccaacacacctttattcctaattttagtaatttgtgtcttcacttttttttatctttgtcagtctagccaaaagtttttaaattttgttaatgtttatagactttattttttagagcagttttagattcacagcaaaattgagtggaaagtacagagcttcagcatgtgccctcccccaaccacctgcagacttccccaccatcaacatcccccaccagagtggtatgtttgttacaattgaatgtacactgacacatcgttatcaccaatagttcatagttttacattagcgttcactcttgctattgtacattctgtgggtttggacaaatgtataatgacacgaatccgccattacagtatcatatgggatattttcactgctctaaaagtcctctatgctccacttattcatccctccttcctctcaacccctggcaatcactgatctttttactatctctgtgtttttgctctttccagaaggccatatagttggaatcttacaatatgcagccttctcagattgtcttctttcacttagttatgtgcatttaaatttcttccatgtgtcttttcatggcttggcagctcatttctttttggcactggataatattccattgtctggatgtaccacagtttatttattcattcacctactgaaggacatcttggttgcttccaagctctaactacgaatacagctactataaacatctgtgtgcaggtttttgtatagatgttaagtgttcaactcatttgggtaaagaacaaaaggtgtggttgttggattgtgtgataagagtatgtttagttttgtaagaagctgacaaattgccttccaaagtggctgtaccattttgcattcctatcagcaatgagagttcctgttgtttcacattctttccagcatttagtgttgtcagtgttttagattttggctattctaataggtgtgtagtggtatctcattgttgttttaatttgcaattccttaatgacatatgatgatgaatagcttttcatatgcatattttccatatttatgtctcctttggtgaggtgtattctataggctgaatgtttgtgtgccccaaaaattcatacgttgaaattctaagcccagtgtgatggtatttggagatgaggcctttgggaggggattaggtcatgagggtggaaccttcatgaatgagattagcacccttataaaagaggcctcagagagcttctttgcccctttcaccatgtgaggttatagtgaaaaaatggcggtctatgagccaggaaatgagttctcaccagacattgaatctgttcttcatagacaacttgccagacatggttctactgcataaaatgggtccctcccatagtgaaatgtcagaaattgaggcacaggcattccagtgcctcgcagaagggccagggaattggccttgaagcagtgaacttctcagacctgttttccttgcagatgatgcaagtttgagatccttgctgaggactatctagaagaattaggaaagcaagcacagttctgattatttctagatcagaaaccaagagtgagggcaataggaaatgttacagcttgaagtgagtgggcggaaagttagagggtttgtgtttcacactgacctccgtccttctgagtgacacattttctttagacatgctaatagaattttctcttgtgcaagaaaaagttaataaacagtcataacaacaacaaaaacactgcactgggttgggatttttagaaaattgactgagaagtcattttatatatataaaaaatctaccgcggagtaaaggaacagttggatgatgattgtaatgtatataactgaaaagtaaactatcaagtttattatctttggaagaatccttctattctacttgtaaattaggggcttaatgaacaatgaatacaatataaaggaaagaaaaatgtattcacgttgaaacaatttattttcttttgctttcaatcttgctgacaagcattagatatcttggttgaagaaaaactcttctgctctctcacttaaatgctcctttttcttaactctttaatatcacagagttagaaaaggtacttttatttcaaagttctttgggttctcttctgtgctcaatgtttgttacctccatgatattaaagatgcatcaggctctagtgaagttgactagaacttttcagaaaactttttcctgtctgtatccattccaccatcagggcaggatagtgagtgcttaagagaaaacagtggtattcccaggaggtcaggtagaaagactgcaaagcacagctgttccaacccccaacacggtggagaaaacggccaaagtcacagatgctgtaaaaagtgatactgaagagctcaagctttggaattagcactgggttagaatatttcaatgttttaacttcttactctatataaaggagataatgtgagtacttttatgactaatacaaaggttattgtgatgaatagatgagaaaatgcacatataatgccttgctgttgtatctacctccaaaatgcccaccgactcattccctctttgtcaattgggaattgaatcagggctggcttgtgactgcttagcccagtagaattagggagaagcggctttgccaatgatgggactaatttttaagaggactggaagtttctgcatcctttctcttggtacactctcatttgagatgcttcctcagagccagacaccatgctgtaagaagcccaaacagtggtgtgctgaaaaatatttaaaaaccagctctacccaaagaaggtgctgatttgtagcttttgccagttttcatgatataataccctctcctccatggctgaatacaaattacaatgtaacgtatagtgactgaactataaacttggtaaaagatgcatgcacagatatattagatatgtaaataatcacaaaagcacagattagtaaaatgtagcaaaataattagaaagtgaagaggtttcagtatcattttaaaatataatttatgcaattgtaagtttatataatttaatttttaataatggccgtgtttaacaactcgttcacagaattcctgaaaatttaacaattggttctcaccagctggtaaaagttggctccagcacatcacaagccagacccagcacactactgagcccacaccactgggggagtccatgtgtagggagtacagccaacagcttcaactgaccagtcagcatcaattgcctgccatgtgagtgagccctcttggacatccagcccagattagccttctgatgtattcagcctcagctgctatctgacttgaagtgtatgagacaatccaagtgagaacactcaactgagcctagttaacacacagaaccatgaaggataataatacattgttgctttaagccagtaagttttagggtgatttgttatgcagcaatagataacctggaacactggctcatagaaattgctcagtaaatagcagatattattattttgaatgttgcaattactggcagattaactgtaacagtatttcaaggaatgaggatcaatttattctgcaacaaataaaggagaagtccctttattacttttgcttgaggaccaggaatttttacacgatgagtgtaatttagcttgaattttccttaaaaactatacaactccagagaaaaagtctataattactttccacaatatagtctcccattggcctgctgtttactttcattctgccacagcagggactacgtgaaagtgaaattgcaccactgaagcccaaagaatcatgactaggcagctcttgttattccattttaaacaaagtctgagcgatttaataagagcagtagaaaggtccgtgaatgagctcactatctttttctatcctgcctagtcttaatattttctcagcttcttttagttaccagaagatagatgttaactgggacaaaatgttaatcgagaaacaactacaaccttgtttaatctcctgtcctcctcccatctcctcagggagaactctgtctttgctagttcagttcctatgtgagccattgttggacaaattggggtaatggttggggaggaattgagaggatctcagttatggttgcttaatttacattgatgagaacagaaagttgtttgcaggaaaaaaaaagagaataaagaaagaaaacaaagaggaaaaggagaaagcaaaaagtagcctgtgtaggcttttgaaggtgttaagttgtggggagcttggggtaggagaaagatttgaggagatgctgataactagggaggtcattgaaagagaggtagtaagagaaatacagacagagagagaggggatgaattttatgctgaattattttgttttctgaaacagagttgactatttgtagtataacctgggttaagtgtgttatgagtgttagctctctctggaatttttcttaacaaatggtattttttattattttcctttatattttggttattggacttgaatgtgagtgctttaagctagcaagacaccacaagaaagctcagctttatatgtgttatattcaactaaaatagaatttgtgctgtattcgtttaacaaagctcttcactttaaaagtgagtcatgattcaaacaaaacaactatttagaagaagcatttatgagataagaacttttgggcactgacaggatatttgatgattttgaatattattgctaatttttaaatttaatttgttattgtggtcgtgacatgtaaaaatcatttattttagagatacatactaaagtatttatggataaaatgatatcatattcaggactcactttgaaataatatggggttggggaaaaggtgagtggaagtgtagagaaaatgcgattatccattcattgacacttgttgaagttgggttattcatgaggaacatggagattcattatacaattctttctacttttgtgtatgcttgcaaatttccataataaaaagtgaagaaaaaagtgggcgagttaatatccattgttcttactctctggaaaatctaaattaactgctttttattatgacgtagtccatatttgctttttttttcctgtggtttgatggttcttgacaggaaaatgtaaccatcacccttaattatgaaaacatagactgagtgtttgctgatatttgagtataaggtgggatctacttaacacaatccaatactcaaaagtctcaatttaattagaatcaaatttcaagataattcttcagggacaaaacgatttccctggtgcatttgaaaaaggatttaatgaatgaaaactttttatgaataaaaacttgacttatgttctactttctgggactacacctattgtagaaacaaagggccaatattttccttctgtaaacacattaccttggtaggtgttctcatctcaccctctttactctttaaagggaaagaagcacaccagaatggcagaagactaagtcatgcagcttttatgtctcaactttctttccccagagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgagtaagtactaatactttggtgaaagacattatttttaaaaaatttaaaatgcagacggccctctgtatctgtgcattctgcatttgtcaattcaaacaaccatagattgaaaatatccttaaaaaaatcttgcgtcgatactgaacaagtacagaattttttctcattattcctaaacaatacagcataacaaggatttacatagcatttacattgtattaggcattataagtaatctagagatgatttaaaatatacattgatgttcataggctatacaaaaatacgaccctattttatatcaggaacttgagcatccgtggatttttgtattcatgggagtcctggaacaagatccctcaaggatacgaacggacgactgtatatattatcaatttcttggcatatagacatcataaattttaaaagtcaggtagttacacattgaaagctcagttagtacaatgcaatggggtcactttactagaatgttcattgtgaaaggatgtattcaaattcgaattgaatcttagtgatagcaagctttcaagtacacagttaccccaaaccaaacccccagtctattcccccaacttttgtgttccctcagtgttcttaatgtctataaaatgtatccaaccagtgctaaagtggaaaactcgagaacagtactagttaactccttctaactcacagccaattaataactaactcttgtatgcggcactgtacatccatttttaaaatcccttaaatattttggtggaattcttttacttctctccatctccaccactaccatcctattcctagccccatttctctcaccagactgtctacaataacctcctaaatggtctctctgcctccgttcttgaccctctatgggtcatcttctacatagcacccggagtaatcttttaatgtatatatcaggtcatgtccttactttgcttttaaaaccactcagtggctttccattacacgtagaataaaatccaaatgtcttataaagtcctacgaggccctgcagggtctggcttacatgtaacaatttcattaattttcacgacaatctttagagatgagtgtaatattacttttgactttcaggtgaggaaactgaagctaagtgagattactttatttgcccacacagttagaaattagagaagctaagatttaggtgtcaacttgtctgattccaaagccagtgctcttatttaataattcctaaatgatataaagatagtgattaaaactcaaagaaaagtcttgcaataaggaaatcttgcaaggaggatgggttttacttttaaaaggtaggatgctcttctccatctgtggtttcttgcagaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgaggtgagtgcagctcagggaactgagagccaatcagccaagcactgtttcaggtcttcattcatttactccttgggagagagagggcactccgttatggttttaaggggaccttatggaaatacagacatcccagggaagattcgtatataatctttagtaggctaacgtcttggttggaatggtgtctgggaattgtgcaatgataccacctttggccctgtgaccccaaattatctcaaatgtcagtttattattggccaccatttaaggaacacattatatgttggacattgtgctactgcctcctttgtacagataaggaaacagagaagtaatttgcccaagaacacatagcctaatgactaagccaggattgaaacctatgtctgtctggctttaaagcctgggccctttccaccatatcataccaccttagcctttggcatgttataggctgccaaccctactcaaaacaatttcagaggttagattttttttacaattaaaaagtaataaaatgtacatataagaaaatgcacaaatcctaagtatacaccctctgaattttgacaaatgcatacatctatgtaatccaaacccctattaagatatagaatgttggccaggtgcagtgccacacctgtaatcccagcactttgggaggtcaaggtgggaggatcacttgaactcaggagtttgagaccagcctgggcaatatagtgaaaccccatctccacaaaaaaattaaaaaattagccaggcatggtagtgtgtgcctgtggtccagctacatgagaggcttaggcgggaggattgcttgagaccagaagatcaaggatgcagtgagccctgactgcaccactgcattccagcctaggcaacagagcaagattctgtatttttaaaaagatatagaatattactatcacctctgaaagcccccttgtgccctttccaagtgaagctctgaaactactacctgcagtggcaatcactgttcttatatttttctgcgatagtttttcctgttctacaacattatataaatgaaatcttataatatgtactgttttatataaggcttctttcatgtagcataatttttttttttagtcatccttttgtttcagtagtttgttcctcctttttattgctgaataatattccaacgactgggtacacaacagattccttgtctgttctcctcttgatggacatttggattgtttccagtttggctattatgaataatcctgctatgaacctttgtgtataagtctttatgtgatcatattatttctatgtcttggataaatacctaggaatggaattgctggctcataggtacatgtttattatttatttatttattatttattttttgagatggagtctcactctgctgcccaggctggagtgcagtggcactatatctccccaccgcaacctctgcctcccagattcaagcgattctcctgcctcagcctcccatatagctgggattacagccactcaccaccatatccagctaatttttgtatttttagtagagacggggtttagccatgttggccaggccggtctcaaactcttggcctcaagttatccacccacctcggccttccaaaatgctgggattacaggtgtgagctacctcacccggcctgtaggtatatgtttaaatgtattagaaactgtcatagtgttttctagagtggtaaatgatgtggagtaatttttcatgttcatatttgttatttgtatgtctttggtgaaatatctgttaaaatcttttgcccatttttaaatggggtagttttctttctttattgcaatagtttttgggatacatgtggtttggggttacatggataatttgtttagtagtgatttctgagattttagtgtactcgtcacctgagcagtatacactctgtccccaatatgtagtcttttatccttcaccccccccaccactctttcccttgagtccccaaagtccattacatcattcttatgcctttgtgtccccatagtctagctcctacttataagtgagaatatatgatatttggttttccattcctgagttacttcacttagaataacagcctctagttccatccaagttactgcaaaagacatgatttcattcctttttatggctgagtagtattccatggtgtatatataccacattttctttatctacttgtttggttgatggacacttaggttggttccatatctttgcaactgtgaattgtgctgctttaaacatgtgtgtgcatgtgcctttttcatataatgacttcttttcctttgaatagatacccagtagtgggattgctagatggaatggtagttctcagtttagttctttaagggatctccatactgttttccacagtggttgtattaatttacattcccaccagctgtataaaagtgtttccttttcaccacatccatgccaacatctattgttttttgactttttaattatggccattcttgcaggagtaaggtggtatctcatggtggttttaatttgcatttccctgatggttagtgatattgagcattttttcatatgtttgttgggtgtttgtatatcttcttttgagaattgtctacgcatgtcctttgcccactttttgataggatcctttgattttttcttgctgatttgtttgaattccttgtagattctggatgctagtcctttgttggatgcatagtttgcaaatgttttctcccactctttggattgcctgttgactctgctgattatttcttttgttgtgcagaagctttttagtttaatttgatcccatttatttgtttctgtttgtgcatttgcttttggggtcttagtcatgaattctttgcctaggccaatgttcagaagagttttttccaatgttatcttctagaatttttatggtttcaggtcttatatctaagactcttacatttaagactttgatccatcttgcgttaatttttgtataatgcgagggatggggatccagtttcatttttctccgtgtggcttaccaattatcccagcaccatttgtggaacagggtgtcccttctccactttatgttttcacttgctttgtcaaagatagttggctgtaagtatttggctttatttctgggttttctattctgttctattggtctacatacctatttttataccaataccatgctgttttggtaactatagccttgcagtataatttgaagttgggtaatatgatgcctccagatttgttctttttgctttgaattgctttggctatgtggacttttttgattccatatgaattttagaatttttttctagttctgtaagaatgatgatattttggtgggaattgcattatctatagattgcttttggcagtatggccattttcacagtattgattctttccatcatgagcaagggatgtgtttccatttgtttgtgtcatctatgatttctttcaacagtgtttcgtagttttccttgtagagatctttcacctccttgattaagtatattcctgggtattgtattgtattgtattgtattgtattgtattgtattgtattgtattgtattgtattgtattgtattgtattttgcagctgttgtaaaaagattgagttttttatttgattcacagcttggtcgctgttggtgtatagcagtgctgctgatttgtgtacattgattttgtaacctgagactttactgaattcgtttatcagatgtaggagctttttgaatgagtcgttatggttttctaggtatacgttcacatcattggtgaacagcaacagcttgacttcctgtttccaatttggatgccctttatttcttactcatgtctgattgctatgactaggacttccagtactatgttgaacagaaatggtaaaagtgggcatcccttttattattgagttgtaagtgttctttacacattctggatacaaacaatttatcagatgtatgttttgaaaatgttttccgtatgacttgcctatctattttctcaataatgtctttcaatgagcagtttttcactttcttgttttctttccttttttttttttttttttttttttgttgttgttgttgttgtttgagagtgggtctcgctctttcacccagactgaaatgctgtggcttgaacacagatcactgcagccttgacctcctgggctcaagcaatcctcctgcctcaacctcacatgtagctgtggccacaggcacgcaccaccatgcctgactgattttttaattttttgtagagatggggctctcactttgttgcccagactgatctcgaactcctgggctcaggcaatcctcccaccttggcctaccaaagtgctgggattacaggcgtgtgccattgtgctcaccaaaagttttaaattttcgtgaagtctaatttatagttctgttttcttttatgaataaccatatatgacttgtctatgatacctttgtctatcaggaagccatgaagacattctcttatgcttttctttaaaagctttatgattttagcttttatgtttagaactcaattaattgatttatgtattgcatgaggtaggagttgaggatcattttgttttacgtggatatccagtatttccagcatcatttgttgaaaagacttttccttccccattggcttgctttggtacctttgacaaaaagtcaaattttgtataaatgtaaggctatttctggactttcctatactgtttttttttttttttaaactcgtatgttattaccaggtcgtcttggttcctgaagtgttgaagtcaggtaatatgaatacttcaacattgttgcttttcaagattgctttggttattctaagccttttgcatgtccatataaattttcaaatctgctgatcaatttgtataaaaaacttgctgagattacgatttggattgagttgaagttattggtcaattttgggagaatttatttcttagtaatattgagtcttctaatctaggaacatttatttagttctatttacatttctctgagcaatgttttgtagtttaggtggggagatattgcatgtcttttgataaatttattcctaagtattttgatttttgatactgttgaaaatggaatagttttaaaactagatattccaattatttgctgctagtatatgaaatgcaattgattatatatgaaatattatttatattatatgctatatatatacacattttgtttcttatgcacttgctaaattcacttattgcttctagtaattgttttagagattccttagaactttccatgtaagccaacatcatgtgacaatagagagttttatgtattctttactgatctttattccttttatttctttttgggggcctattctgatgtttaatacttccaataaaatgttgaatagaagtggttgaagtgggcatccttgtcttatttttaatattaggagaaaagtattcactgtttttccattactgtgatgttacccatttttgttttgtttttttaaaagatgttctttatttgattgaggtagttaccttctattcttggtttcctgaaaagatttatcacaaattgttgttgaattttgtcaaaacctttttctgtatctctcgaagtaatcttttggctttcctctttatcctcttaatatggtaaattatattgattttaaaatattaagccaatcttgaattcctagaaaaaaccctactggtcatcatgcatcatcatgtttatgtattgctattttctaagtgcttatgttttgtgaagtatttttgcccttacattcatgaagagtattggtctgaaattttcttttttttgtgatttctttgtcaggctttagaaagattttggcaacattctaaaagtgagttgggaaacggtccctcttctactttcagaaagagtttgtgtaacattgctgtcatttcattaaatgcttgatagggttcactaggaaaccctctgggtctgaaatttctttgtgggaagttttttgatatcaaactagatttatttagtggatagagagccattcagattttctgattcatcttgtgtcagtttttggatagttgtatttttctaagagtttatttcatctaacttgtcaagcttattggcaataatttataatattttcctatttttttaacatctgtaggatttatagcaggagtcagcaaagtttctgtaaagggcagataataaatattttaggctttgcaacccacaggtggtctctgtctgctgaatgttcttatatgtttgtttttgttctgctctccgttcctcttgccccctgccctctcctccccttctttctcttctctcttctccttccctcctttctcctgtcttctccttccctctcttctcctctcctctccctccctctcttctcctctcctttccagccctctctattcttctcctcttcttcccttgctgtcctctgttttcctttcctctcttattctctcctctccctctgcttctttctttgtgcaaccgtttaaaaatgaaatgtatgttgtgcaactctcaccaccatatgtctgcagaacgttgttcatcttcccaaagctactggggaggtcagcctcctcagtagctgacccgttgaataacaagtccccattcgtccctttcctagcccttgacaaccacaattcttccgatccctgtgattttgactactctaggtacctcatgtaaatggaataataccatatttgtcctttgtgactggcttttttcactttgcaaaatgtcttcagggttcatctatgttgtagcatgttagaatttgctaattttttagggctgaataatgttccattgtatgtatttaccacactttgttcatccattcatacaggggttctttttgaagtgatggaaatgttctaaaattgattgtagtgatagttgcacaactctgaatgtggtgaaagctaatgaactgtatactttaaatgggtgaagtatatggtatgtgagtaaagtctcaataaagctgttaccaaaaaaaaaaaaaaaagccacgaaacctaaaagtgacatgtaaaatctattcttagctcagggcaacataaaaacaagccttaggaaggatttggcttgctgattcatttgtcaacctctgatttatagtaataaatcctctttcatttctgatattggtaatttctttttttgctcctttatttttgatagtatagggatttttccattttgttgatccttttaaacaacctttggccttgttaattttccctattacttgttttctactttttgatatctgattttatgtttattacttcctttcttgtacttattttggttttagttttatcttctttacatagctgctgctgctgctgctgcctcctcctcctcctcttcttcttcttcttcttcttcctcttcttcttcctcctcctcctcctcctcctcctcctcttcttcttcttcttcttcttcttcttcttcttcttcttcttcttcctcctcctcctcctcctcttcctcctcctcctcctccttcttcttctccttctccttcttcttctttttcttcttcttttaagatgaggtctctctgtcacccaggctggagtgcagtggtgtgaccgtagctcacagcagcttcgaactcctggactcaagcaatcctcccacctcagcctccccagtagctgggactacaggcacgtaccaccacacctggctaatttttagattttttatttttgtaaagacagggtctttctttgttgcccacagtggtctcgaactcctagcttcaagcaatcctcctgcctcagcctcccaaagtgctggggttacaggtgtaagctactacccctggcctgtctagcttcttaatgtggatctatatatcattcattttagacctttcttcttttctaacataatcctaaaaagctgtaaatatctttctaagcactgctttagctgtagtccacaaatttttatatgttgtattttattatgtcagttcaaaatattttatattttttttagtccgtgaattatttaggagtgtattgtttaaattacaagtatttgggggctatctaagatatcgtattattattttttcagacagggtctcactctgtcacctaggctgaagtgcagtggcacaatcacgactcactgtagcctcagcctcctgggctcagatgatcctcccacctcagcctcccgagtagctgggaccacaggtgcatgtcaccacacctcgctactttttaaaacattgtttgtaaagatgagatctctccatgctgcccaggctggtctcaaactcagcctctcaaagtgttgggattgcaggcatgagccaccccaccaagcctgagatatcttattgttattgatttcttgtttatttcattttggtcacagaatatacttagtataatttcaatccatttacatttgttgaaatttattgtattagtcagagttctctagagggacagaactagtaggatatatatgtatgtatatatatatgtatataaatacacacacacacacatatatatgagagtttattaagtattaacttacatgatcacaaggtcccacaataggctgtctgcaagcttgaggagcaaggagagccagtccgagtctcaaaattgaagaatttggagtctgatgttctaaggcaggaagcatctagcacaggagaaagatgcaggctgggaggctaagccagtctctccttttcatgtttttctgcctgctttatatttgctggaagctgattagatagatggtgtccattccaattaagggtgggtctgcctttcccagcccactgactcaaatgttaatctcctttggcaacacccccacagacacacccaggatcaatactctgtattcttcaatccaatcaagttgacactcagtattaaccatcacaagtccatcccttttcaagttgaacccatacacatttcctgagatcatacataatcttcaaataaagacaacaataaggtcataattatgcctaacataatacaactatcctttgtacaactggaaatgcacaaatccccaacacaaatactattacataaaattaacaatacttaaatgctgatatgaagtcagtaaatcctatgtcacacgataaaagaaaaaaaaataaaatgaagatttttcttagtacaagtgtatacatgcacaaacatgtttttaacaaaagaaggaggaaatattcatgacaattacagtctccgtttttgtagctggtcatgtggtcgtagctggtattgatgactacattcttctgctacccattctctattccctttgccttcagcaagcacctctgcaggtcgtggtttttttcctggtggagtgacccaagccttcatttttgaagggtctgggccatttgtagtcctgcctggattgggctgttgtagtttcccattgaccttaatcacagggcatggtaattctaagagatgccctagtggatctcctgtattccatgcataccttacctccgttgtagagtagtagactgatttcatcttgatagtccggatcaatcaccccagccaacactgtaactcccttcttagcctattgacttaaaggtaggaggaacccaaagtgtccaggtggcaatcttaacttccagtttaaggagatcgatgttgtgtctcttggtggcagcgttcctccctctggaactaagacctctaggccagcagaatgtaatgtcgtgggaacaggaagcaaaagttttgctagtggatcattaggggtgatggtgagtggtgccacttccacttccaactcttgattcctggaactgtgaatcctggctatgggaaaaaaagtaccatatattggacgctgatttagagcacttattttatatcccaatgtgtgatttattttggtgaatgtttcacatggacttcaaaaaaaatgtgcattctacagttgttggatataaatagcaattaggtcaaggtgccagcagtgttgttccaatcatctttgttctatcctagttgttctctaattgagaagggtgttaaaatctctaactttgtgcaactgtctatttctccatttagtcctttcaaattttgctttgtttattttggggctcttttattaagcacatatacatttgtgttggtttgtctttctaatactaatcctacccctaaacatatttatcattattaaatacccctctttatctctgtcttgaagttattttatctggtttgaatataaaaaaccaagtcatccaagccttcttatggttactctaaaaggtatgtatgtatattttatattcatttgcttcctagctgtctttatatttaaagtgtacctcttgtagatagcatatagtttgtgttttattttttacccatcctgataatatctgacttttaattggagcgtgtagtttttttaacatttaatgtaattatttatgtggttggatttgagctaccattttattttaatttctgtctatccctctggcttttgttcctctgttccttctttcctgttgtctcttgctttattttaatatttattatagttgctttttaattgtttactgactctttaattatatatatttgcctttctttctttctttctttctttctttctttctttctttctttctttctttctttctttcttctttcttcctttcctttcctttcctttcctttctttttggagtctccctctgtcaccgaggttggagtgcagtggcacaatctgggctcagtgcaacctctgcctctcgggttcaagcgattctcgtgcctcagcctccagagtagtggggactaaaggcatgtgccaccacgcatgggctgttgtttttttatttatttatttttttatttttagtagagacagggtttcaccatgttggtcaggctggtttcaaactcctgacctgaagtgatccaccagccttgacctcccaaagtgctgggattacaggtgtgagccaccatgcctggcctgcattgttttcttaatggttgctctagagattataatatacacttgtatatttttttacagtctacttagagttaatattgtactgcttcatgtaaaatgtagaaactttaaaccagacgtgtcaatttataccccctgttttttatgctataattgtcacacacatattttacacaagaagattataaacttcacaagacaatgttatagtcattactttaaaaagtcctatgttacttaaaaaattgagagaaaaaatggttttttacatttacctagatatgtattatttttggtgctcttcactccttcctgaaggtcagagttctatttggtatcacttcccttcagcttaaaaaaattcacttaggatttattgtagtgcaggtctgataatgataaattttctgagtttttaatttatctgaaaatgtctttattttatctttatgcttgaaggatatttttgtttgtaataggattcaggattggcaagtccttcccccagcccccagcattttaaagatgtcatttcactctcttctggcctttatgttttctgaagagaaatcagtaatcatttgagttcttgtttctctgtatataatgtgtaatttttctctggctttttaaaatattttctttgatattctgcagtttgactattatatgcctgggcattttttttttctttgtacttatcctgctaagggtttgctgagcttcttgaatatgtaaatttataccttttactgaatttggggaaattttcactgttattccttcaaatactgtttcctcaccattttctctttcctctccttttgagactccaattacttgtatgtaagatcttttgatactcccccacatatccctgagactgttcatgtttttaatcatttcactatctattcttccaaaaggatcatttatattgatctacctttaaatttgcagacatctgttgttttcatgttactattggacccatcctgtgcaattttttaaattgtacagtttttagaattcatgctaaatgaatagattttagctactcttgccacaaaaacaacaaaaaaagaggtaactatgtgagaccatggatatgttaatttgcttcactatagtaacctttttactctctatatgtatcccgtaatattatgttatataccttaaatacacacaataaaatttactttttaaaaattccaattatactcaaagtttagaatttctgttttgtttgtttctgtttctttttaaccattatttcctctctccattaattgcaaacatattatcttttaaatacctcagcatagttatactagctgctttaaaatccttgtctgctaattctaatatctggaaaatctcaaggtttaactccattgattatcttttaaaaatgggtcacattttttcttcacgtattgagtaattttggactatgtcctgggttttataaatgttatatatatgaacactctagattctactctattcttttgtagattatagatttttgtcataacaggcaattaacttggttggactatactgtagacaccaactcttgattggcagttcaaatctcagttaattcctttattcttagtggaagtatgtcctgtacatatgtggtccagaggtcaggcatatatttgggcagaatttatactcagaattttggatcccgctttccattccagatgtccaccacaacccccatcacctcccagtggctatggttgccctggcttttgtttctggttcttcattccacaaagactgcaattaaaaaaaaaatcaaagttttagatgtccttcacagcattagtttcagcctgccatcaggctacaagatgtaaaaacgggtaccccaccttgtgatgttacctttttccaagtgtttactcttctccagaaactgtctgcttttggtaattttccagtgccttcaagtcgttgttactttgtattgttgttatatgcaggagagttgagtttattaggagctacttagccatattgaaacagatgttgaattcccagtgtattttgtttacaatggggttttctatcatgaatcttggtggagagacaaaccaaacaacaccagttgtattcttggtgccaaactgcttacatattgaagctaaatcatgacctctccatggtacttgattgccctagcagagttcatttctgcttagcaaagagccatatgggttttgagactacaagtcatttttagaaatattattcacttttaacccccactatacacccagctagataatagcaacttgagaggcagcatagataattttaaaaagtgggccaaaattgcatatatctttgttcacccacatcccagttgtgtgatcctaagcaattcacttaatctttctacgccatttcctgttgccataatacaacgtacctctcagagttgatagagagattaaatgggagaatgcaggtaagtgtgtccacatattctgttttgtatgggagaatccagatttatggctgtggacttagtgtaattattaacaaagcccttttgactctcaaaaatgttccagtacttgtcaaatactattaccaatcaactcagcaaatacttctgatagtggatgtcttgttccattttgtgctgctataacagaataccacagaatggataatttctgatgaacagaaatttattggttcacagttctggtggctgggaagttgaagatcaaggggccgcctgcggtgagagccttcttgctgtgtcatccaatggcagatgtgcaaagagagggagagagagaacaaaagattgaactcacagcctcaagcccttttataattggcattaatccattcaacagggtggagccttcatgacctaaacatatcccattgtgccccagcccccattattatcacattggggattaagtttctagtacatgctttttgggggacatattcaaaccatagctgtgagcatgcagcagaattgctaagcgctaatgcctcacttccctgcttcactttttaaccaaaacattgctccataaactatgaggaaagtgcctaatatcattgtattgtgttttttattgttactttgttttttccttttaacatatggaggaaggtagcctgagttccaagactggtctttatttctgataatcagggcaaatgacctaatttgtcatttccctctcatctctattattacccaggtgaaaggagatcaaagggagagaacctcaggaataggcttagaaaggaaaagatgatgtgtgtttgtgtctatgtctgtgtgtaccaggatcatgtcttggcctgtgactgtgtgtgtgtgtgtgtgaaaagtgtatcatcgcttatggagctagttcccacctttcagtcctttgggtgatattctgaggctgagctggggtgggaggtgggcaggacttcactatgatgaatgaagactccaattttcattttttggcttttcttggcagattttcctaggcaatgtccctgtgggagggattttggcttccatatatttgcctaaatcactgacggagagaattcctcttagcaacttacaaacgatcttgtttaatttctttggccaaacttcactctttaaggtaaattcttgcctgtggtaactgtgatgaactggcatatggtgactcattgtaattatgaactcttgctattttcatgatgttctgcttattttagaatatgctgattgattccacaagtcttccaacacaacccctgccccttaacatgaatcaacgtctactttaatgatgttctacagtttttagttttcacaatatctcagctttggaaggaaacttaaggattatctggtggctaaacagaggcctcaagatgtttcaaagccaaaaaagaacagcgagttctcctgatgaaatgatgtttcggcttatcagtgctttcctcccaaatctcccctggctcctcaaagccaacatgtccactattcttggccaattcctttgaagttgggtggtatccagaaggacatttgcctgcaggcatttgttgctacttcccacagcccccacagaactttctctgaaggctgcagtcctcacccactagaaaacagaggcagcatgatgtgatgctgaagagtgtggactcaggggcaggctggttgaattaaaagctggcaatgccatattctgcctgtgtgtcctcaagcaagttactcaaccttcatgtgccttaatttccttctctgtagtatagggtaataagaattccttatagagctattgaaggattaaaggaattggtgtatttaaagtgcttacaataccgcttggcacataagtaccatgttaagtgtttgctctactattattagtatcctgtcttaggtctctgcctaacaaaagcctcattcgtttagaccactctgtctcatctagctattgggaagacagtaatcagagtttgcatgaatttgaagataatgaacactattaattgttaatatttacatttattatttcatctacttctcatgagaagctgatactcaaaaaggttaagtaatttttcccaaggccacatacctaaaaagtggcatagctaggaatcaaacccaggctatctgacttcaaagttcatgtatttaaagtcaatacaataattttcccagatgtgtttgtatttctaaagaggttatccaaagtaatgaatttctaatggtcaaatatccacatttcttttgtgggaggttgcactgggccagctcaaaatatagcacatacccataccacacgccacctcaaatataccatgtcacctccagctatgtctgtaagactttctgttcccctggagttctctagccactcctttctctctctaaattctatgtgttcctgtgggcttagctcaaatcccacccagggtggctgcctggagtaagtgagtctctgctctccttcctgcctcctgggcaaaatatttagtgggcaaaacattttaataaaaattaaaaatatgctccacaacactttgacccttttggtaggcttacaatttctctttgtcacttgagatgccattattttggtcttaatttctctcctttcttcagagggctgtgcttgtctcgtagaataagagataaacttgttttgcatagatttcacacttaataagtcatttttattcactaacactttctactggaagagattaaagatctttgccaaaattaaactgcaaacatcatagtaccagatgaagaaggattagaactagcctgcttcaaattcagagttgaaagggccctcctaactcatatcatcccatctattcattttaccattggtaaaagtaaaatggatattgaggacctcgagtctcagagaggggaaggaatctgctgaaggtgtcacaatttattcattcattcactcaatcatttattcattcagcaaatatttatttaattcctactgtgtgtcttgtacggtgctgaatgctgaggatgcaatgctgagcaagatacatagtgcctgctctcatggaacttccagtctgctggaggggaaaacagacctaaatgttctaacattaaaggggtgaccctaggctgggatctgtgccactggttattggggaaagagtacttacaaaaatgctgctctttaattctatttttcttgaatccccgagtatcacagccttgctttcgcactactttctctaatattttttgatcaaaatcttaagtcattatgacacataaccttagaaatttgtttgtttgtttgtttgtgtcttttaaagacaggatctcgctctgccacccaggctggagtgtagtggtgcaatcacagctcactgcaacctctaactcctgggttcaagagatcctcctggctcagcctcccaagtagctgggaatataggtgctcaccactgtgcctggttaattttcatatttttttgtagagatggggtctcactttgttgcccaagctggtctcaaactcctggtctcaagccatcctcctgtctctgcctcccaaagcgttaggtttacaggcatgagccaccgtgcctggtccatagaaattgttgataaggcaccactcttggataatatgtgtctcctcctccacacctcctctagctgtgattctcagggagagggacaggcactaggcggttacaatatggcacaggggctctgggtgcatagaagagggaatctaccactcatctggaagatcaggaaagtgcagtgagagaaaggtctcagcggagccctgaagttgagtaggagctcaaagatgaaatagggcaaagagaaggagagaagagagtttcagagagagggaatagcttgtctaaaagttcagaggtgtaacagataaaacttgagcctacagtgcaaagggtggaaggatgaggaagtttctattcctttcctggcatggctaccgttttgtagtaagggaaatgaaaccagagaaaaggctaattaagttttggatcatagtgtgtgtctcctcctttggccttttcactacagaaaactgcgtcacttagactaagttgggaggatcattaaataacatctagtctgccatctttcctagtgtcaccaatagaccaggaaggggtaatagggcttaggaggaacaagagagctagggttagcccttagccttttgagtgtcagcagggcccttcccattatatcttgctgttggccatctctaaatcaggttgccccaggctggttttgaatgaacagaacaggtcagaaacaggaagtaagtagagtcctagtggagccccaggctgaatttgcaactacccaggctgcagggctcaggtgtgtagggtaggtagtagggactgcacactgtttcttcagaaatatgaagccttggcatcttctaaaagtggcccagcaggatctccaaggaatgtcatctgcgttcacgtcctctaggcttttgtggggaagtcctcagagatttttcttcctctccctcttgtctggtatcaccagccctacctgtggcctcttcacatgtgcctgtgccccagaacaggcagcatctcagctgacttgcatcctggagccttggcctggggtactttggcactgttagttagcaagccccacttctcaagagatacattctagtttgttgcctttaaaccaacatttattaagcattcctgccctgtcacccactagctgagtgatctttatccatttaggcactgagccactcaagcctcagtttatctgaaaaatgcttatatggcttcaatgaggactgcaaatggcatgtgcatgaaaagcacataataagtggctcactgtgggcacaagacacctgctgtgtcctaggatatgtgaggaacaccaggctatacaatgcctgggctctggcctcagagctcacagtcccctaagaaggcgatgactgtcctctgaaatttgtttcaaactgggtgttgatcaacctgcttccatctctgtcagaatagaacaagaagtggtttataacttacaaatgatagatttaggtttcttatagaggagctccctaaaagtaagcaaggatggttgagagttagaactgggataagttgtgaaatgtcaaggtccagaaagttaccaaaatagagaatagtttcattttgttgctagtgcagtactgagtagcaggtgcaaaacaaatgcgtgctaaatacacatttggttggatggatggatggattaatgaattgttctagcttggtataatggagaccttatgtgaagacaggagatgagctgaataacctttgaccttagcttgcaattttattttccacatttctgtacctaacattgtgtgtagcacttcaaaattccagattgattattaatatgtaagtaattagaaatttaggtcctgaactcctcttttgtttcatctgcagaccaaaaatgtcactaaagcattaaccacctatgttgtgagtgccagcatttcagatgatatgttcattcaaaacttagctgacccagtggttatcactctgcagcatattggaggaaaccaggtaatatatctattttcagctcagaatcaaatggcctcaggaactcttcacgacttttctgttaaaagtaatttgttaattaacagatgtgattctaacacttaatgaggaatgtcctattccaggtagcaaatgtgtgttataattggaaccttccagaaataatgccttatcctaaagtgatagggaatgatgggcattctagcactgtgacagattggtggggcagtgactggatcttttggatgtcccatcacactaaatgacatgtgattccatttatttttgagcgagacaagcaacttcactcaaaataattgaatatttgtattacttgaatttccagaaataacattaaaacgtgtatgaattatcaccaaagaactaaaagcatagtcatatggcataacataagctatatattactaaataatcaactttagcctaagtacaagtatgaatgactattccattatttgacgttagtgtatggccagtgtgacgtctcaatagatttctcagttcccagtctaaaagaccatatagttcagcatacttttcactggtcttgattctagaagggaagaagagaaggaagagagggagaggaaatttaaagaaacaaataccaaatgaaacgtgttagataggtaagatctctcaatttggtctgggctacagcacttcaattatccccggtaactaattgctccttgcctgcagtttcctggagactacaggagctggtgaagtcttaggaatgttctgtaggcctaatgatggggcagatcaaatttctgtccataaggcttgatctcagcggtgagccccgaattccaaagctccagaaggaacacatcagccctgcattgactatccatagccttgtaccagaagggcatggcaatttttaatactaccaaatattttaaaggacatatcagatcaccagccggtgacatgctgttttctcacttgtaaatccagagttagatggtggagttagtctaaaagccaattcacaaatggcccaaatgtgtatgtgtatgtgtgtgtgcatgtcagtgtgtgcatgtttaccatgggaaaaaatattgggaagaaaacacttatgtgtatatgttactatatggtaaatatcacaaggcaagatgtttacctctgatttctttttttccagaattatggtcaagttcactgtgccttttgggattttgagaataatagtaagtatttttgttagcaactttgactttgccccagaccattttcccacttggcagttaaatgggagggggttgtgctgaaactactgtcttatcagaccctacagagcattctgaatgaccaagatacaggatatgatttttatatcaaattagggcatgggaattaagacaactttcctttttgataggtaagatctctcaattggtgctggggctacagtgctccaatcatgcccaataactaattgctccttacctgcagtttcctgaagattataggagcttattacaagtatcttaggccccaaaaataattatttggaaaatcagaaaaattacacaactcgagggtaagcaaagttggaagaaagaaatttggaaggcccagcgcagagtagccttgaactgtttgaagaaagttgaggaaggaatacctggttctttatctgtgctctcccacagggttttgcaagatctatgatctccttccctttttttttcctcacctcttttagactgactgtgtgaccttgggtagacaatttaccccctctgagccccagtctttttatcttttcattgaggagatgaaacttcttggttggtctctaaggaccctacttgcttgaataagcatgagtctttggagacagacagtagaagactgggaatggtcattgctgactgggttgctcttagcattgccatcttcactggaaatatccagggttatcaccaaatctcagagaatttccacacagaataaatttccctaagaacgccaggagtggctaagtgaggagtccttctgcctgtggaaactctgcctggaacctttccctttttcactatccttggaattctgggacaaaatggaaattctcttcccattcggctccctagagtataagaatactacttctttctgacaaacaaaaataacactgccctttcctgatcccctccaagtctctcaggataaaactctataaagcgatgagctttgtcccctacaacctcaatatgttgatctctatgttcattaacgcaaattgctggggtactcccaggtcaccctttgcccctgcacctctgccccgtggatctagaacctctggaatctatggcattatcccagatggacaaatgttgaccaaacttagctgcctgcccggggataacccctttggtctagtgccacttgggaagttctagtctcaaatctgatctagtacctgagatctacaggttgtggaggtatgagtgttagttctaaacctgagtgtgctcagaagaaactagccagatgtctagtagagcagaggctctaattggccctgcagagctccagaccatgatctgactttgattgaaagcacttgagaccctttgaattgcgggttcagctgggtgttcagatgtctattccagtccctctgagtaagctcaagtaccagcttatattccatacgtccatgtccttaaaaatattctagatctgcttgcttcctatttattggctacttaaaaaaaagttcatggttagagtctgtcctaatttgtagaggtatggtacaagaacaggaaaagggagagccgaagaagttgtgccatttacgaagtccccaaaaagtcaatttagtctgttagacttaatttaatttcagtgttcaattatacccctaatcttgctatctcagcaaataatattaattataacacacgtttggatagtgaatataatgaaaagttaaacatttctgagaaaaacaaaattgctttgaaatttccttctgtctcctacagatgggctgggtggatggaattcgtcaggctgtaaagtaaaggaaacaaatgtaaattacacaatctgtcagtgtgaccacctcacccattttggagtcttaatggtgagttgtctcttagtcactcctcgatggaagtttgacaatttttattagaccagtaatatatgtgtgaactgttattaaaaaatggtatgcatttggaaaaaaatcccccttccaatttgttcatccaaagtagatcagattgagacaaatatttatttatttattctccttataaaattaatgcttgcttctcaaatttcaaacagtacagaaaaggtccctttaacctccctcccaagtgatcaccacctttaacaggctaacatgtatattcatttaggttcttttcctgtgtatataggaatgtacatttttgttttataaacatggtatcaaattattcatactgtttttaccgattgcttttctcatttaacaatatatattgcacaactttcaggcaaatgtgtatgtatctattatacttcaatttttaaaatacctttatagtataccattgcttgggtttaacacaataaatttaactaatccctgactagtggacattatagctgttgctgtttttctcattataaatattgctgtaatacacattcttactcatgtatcttcaaacattggtgtaagtatttttgcaggataagttgacagaagtagaattgctggattaaagggtctggtcattaaaatatttaaatttaagaaggatcataagtatttgctgagtttttcttccaaatgactctcaaatgtattcctttttctctacccgcatcagaatactttcctggatttcttaggtaactttattacatactgttatctgaatgtgtcatatgttacttattcctacaaagaatggttagctttttgagggctgtgggtctgttttatatttatttattttacatatatatatatatatatatgtatgtatatatatatattttttttttgagatggagtcttgctctgtcacccaggctggagtgcagtggttctatcttggctcactgcaagctccgcctccctggcagaggtgggaagaatcacctgagtccagggaggttgaggctgcagtaggccgtggtcaggccactgcactccagcctgggcaaaagagtgagaacctgtcccaaaaaaaaaaaaaaaaagagagagagagagagagaccagggttcttgttccagctctgtctgtaactaactatgtgatcttggtaaggttgtttccctcttttggatcttagattttcttctgaaatgtgaatgactggaatacaccagggtttctcaatcttggcactatagatattctggccaaatagttctgtctttttttttttttttcttaacggagtcttgctctgtcaccaggctggagtgcagtggtgcaatctcgggtcactgcaacttctacctcctggtttcaagtgatactcctgcctcagcctccccagtagctgggattacaggtgcccaccaccacacccagctaacttttgtattttttaagtagggacggggtttcaccattttggccaggatggtctcaatctcctgacctcgtgatctgtccacctcagcctcccaaggtgctgagattacaggcatgagccaccccgcccggccccaaataattctttgtcgtgggggattgttctgtgcattgtgagaagtttagcagcatccttggtctttccccactagatgccagtagcactctccccagttgtgacaaccaaaaatgtctccagatactgccaaatgtccctgggagaggggtaacatcactcctggttgagaactaccaaagtaaacactgcttcttaacctttgatgagtcatgaatctctaatcatctgatgaaagctatggactttgttcttagaccagtgcacacatatattcaaataattttacatgtcatttcagatctttaatagtaattaataaatcactgaactttgtgatctctaaggtccattttgtttgttaattttgtgaaggctatttaaggactaaggaaaaggacttttttttttttttttttttttttgctgttctgtgtagtgttttgagatgctcagttcagataattattcactttgcatcccaaattcacatctctcagcttggttatattttaaatgtagaacatgttaatgatgatgaagccaaggaccaaatgttcttccaatgctattgatggctccccatgccctgtacacagtcagttggactaggcatactcagcaaacaatatttggtcttaccatacatccattcacataatctggttttagaagagctatggcagaaatgttatacatcctgggaacttcctgttagtgaacactggaagcattttgccataaacttgctctggtgtatgtgtaaaacacaacacattgtgttccttaggatttatccaggtctacagtggattcagtgaatgaacagatattagcgcttataacatacaccggatgtggaatctcctccatttttctgggagttgcagtggtgacatacatagcttttcagtaagttgatacagccttgctctgagcacatttaatttggtttgatggatgctattaccattgtaactttgttaatttcatgaacacatcacaataggaagaagtcagatccattagcttatgaagtggacaggttaaaaacaaaacatcaaggcttctctaaaaatattttaattggatttttgtaaaacaagggagttgggataggaaaagatttctctataggatataagagcaccaaccctaaaagaaaatttgataaagtggactttattaagaacttctttaatcaaaagacacaattcagatagtgaaaggcaaaccttacatagagagaagatattcacaatgcatatatcagataaaagacttgtatgcagaatgtataaataactccacaaatcaaaaagcaaaagacaataaagtttataaatggacaaaagacttgaacaggcacctcacaaaagagaatatccatgcctaagcctaacccttaccaaatggccaataagcatatgacaaagttctttacatcattactcatcagagaaatcctaattacaaccacagttatgtacttctctgcacccaccagaatggctaaaattaaaaataatgacaatagcaagtgtcaacaagcatgtggaacaactggaactcatacatttgctagtgggaatgtaaaatggttcagacactttggaaaattattcggcaatacctgttaaatataaatatacatctcgctgttggcccaggaatttcactcttagatatatactcaagacaaatgagcacatatgtccactgaaagatatgtacaataatatttatagcagcttcagtcacagtagcttcaaattagaaacaaccccaatttacattaacagttgattagatgaataaattgtgatatatttgtaaaatggaatgctacacagcagtaaaaaatgaattacttctatgcaatgcaacataatatttaaatctcatagacatagaattgagcaaaggaagccagaaaaataagacaacgtactgtgtggttccatttacaaaaagttccaaacacaggtgaaatctatggggatagaagtgagagtattggttacctctggtgggtgatattgaatgggagaagcatgaaggagccttctgggatgttgaaactattctacctcttgatctgtgtcgaagttccacaggtatatacatatgtaaagatccatcaagttatattgttaacacttgtgcactttaatatttatctcagaaaaaaattcacacaaaatgaaaacagcaaaatttaaatcaataaatatttaataacagcgtaaaataatcaaagggggtaatactttttttattttgaaaaatactgggtgagtttctgcaaagtaaagttgcaatcacttaataaaacttaagaccatatttccatgaggccatatatcgggatctttagaactatccaagtagctctacttggaatggtttccacagtcatcctgctatttggtaatatgtagctccagcctgctgaagcagtggtgatagactcatagtacccaggaaactccttccttctttctaaaagataaaaagaaaaataatagcctctctcaactgcgtagttgagagagactattattatttctgttagttaaggtcactatatttattatgcttcgactttacctggaaagagaatgagggacttcaaagtataagcaaagatgagtaattcttttattctttcacttattatgtagataagatgtggcgatgtttaattaaaaaaaaaaaaacagactttacctaacaacattgtactttctcttttagcaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggtaagtatatctgccattgtttttgatatttatgtcttaagtctgtctttctaattctagctctgttagattctgttaatatcataggtaaaaaattaaggatcgccttgctggtgtttgggcatgcatcttttttttctgcctgtattgctctataaattcaatttttaacctttatggtgaggagctggtgcacaaatatttattgagcacttattgtgtattgtgctaagtgctggctctatagtagtgaacagattttatcccttcctttacagaagttacagtcacaacaaatactgataaaacagctaacacttaggtagcacttacatgtgccagatgctattctaagtgctttatatatgcatttaatcctcataatatctccacgggatagattccatcattattcccatttaatagatgaggagactgaggcacacagaaagatgaggtaatttgccaaaactcacacagctagtaggcaagagagctgggatttgagccaggaagtttgtctccatagtttggacttctaacctctatggtcttgccatattgtttaaagaacaggaaaagacttgaaatgggtgaaagagtgctgggtcagccagaacctgattctcatcacacctcatgactgtgatgatcactgctggccttggaagaagccaggaatggttctcagcatagatctttctgaatacaaatgtcatttcattggcttgctttcctgtatttctaactgacatggtcagctcggctcctttcctctctctcccttgtgtattcaaggcagattttgggttcagaaaatgtgttagatgtgtaggagatgtatattaagtagcataccttgggtacataggaacacagattttatcttccactgcctttgtgaagacaatactctcctgattagctactcatccctttaatgagttcattaacatagtacatgctttcactggatacacagtcagtgctattatctatgttaatatggggagcagagacaggcaaatactgaacagatcataatctaaaagcttgttttagtacacttcggaatccatcggaagcacagagacaaaagcagtcgatacactccccttagtgccttgtgtccctcatcttgattcaatcagaggattgaaaaatgtggaagaggcttcatgaataatccaaaaagcagataacccacacatggccaattgtgaaagggctgtaaatatcacttcatcctggctttccttctccctcatcatcactcattcccagcttcttttttaaacccttcctccaggactcacttcttatctctttgatcttctaatttcatacacatttcttgggttacaaggagaggcaggaaaggctaaagcttggtacttggaagcaggaaaactttagttacacacagaagctgagaagtctgactggctcaatcagtaaagaaagatacaataagccactcttatgttcagtttattacttacataaactgtgaaaggaagagtacctaaaagtgccatctttcacattcttgtcccccacactaaaaagaacgaccccaaaacaaagggaatggatgaccgccacgtgagttgtaggattcccagtggctgaggagctagttttgaatggaagtgatactgtttcctattctgcagccctattctaagggggcagggtacaaaggcccacacctctgcagaaccctgggagatgatgagaagctgtctcctgacagcctcctggaggagatagggaggtgagtaggagatggccccggagcacctcctcacaggcctcccaccttctcaaatttgtggaggcctgcacaccgcccaaattcagataagcctttacctgtgtggtctatgtggatacatgcacggtcaccagggagccacagctgagctgtcccactacagggagttttggagcatttcaatattagacaaaagcaatcaactgtaaggaaaataggtattaatatctgtttatgtttgatgctctgccttatgaatgccaaagcaacctgttggaaaggtttattacttttaatgacaaaaaccacaattacttttgcaccaacttaatgaacccctgtccaagacagtagatttgtttatatttttaaaataacaacagaagggatcttttttttttattttcaatatgtaaacacagcttgaagactgccgcacaacttccatcctaaatatgaggccttcccctgtctctcccttccagccttctattttaaaaaacatctgcagcattctaggtgctgtgcttggggtgggctatacagatttgaagtgaccatcctgtttatcacagaatgggacagtggaggatttttcaagatacttggcattctgggctttggaacagctttggaaagcatttaacaaaacccctaaaatgtatgtaggtgcatgcgcttagtctaggagaaatacaattgagagataaagaaatcatttttttttttgcaaatgtacaagaaattggatttttaaaccctgtgtctacactctcctcacgtttgaccattttgactgaactgattgctttattatagtctgactgaattgagtggttgttaaccggtcgatctagtcaaaatgtcaaactagtaacgagtgtggaaacagtttccctgtcaaaaaagcactgaaggctgcagctgattgcctgtgcccttctcctaaggtgacctagacaaaaagctattgggaacaaaggggcgatgtgaaagggagtaaaaattaggggctcatgatctaagaagaaatgcttgatgcgaacttgcattccactcaactagatacttcttttgccaagttgattttctggcacttgagctatttttaataactagtgggcgttgtattggagccattggcatgctgtctagtttagcagattggagaactccttgaaatgcttaacttggaagaattcacaaacattttgcaaacaatagtattttgatgcccgcacatctgtggcttatttaaacagtgtcttaatgtatcatcacccacagtcattgattaggttgcctccctgctacctgatgaaatgcctttgacttgctttcccactgcaggaatcccggctatcatggtggcaatcacagtcagtgtgaaaaaagatctgtatggaactctgagcccaacaactccgttgtaagtaccagcatctctgtttctctggtggtggggctctggcccagcagggtatagtaaaatgttcttggcctgggattggtcttgacccttggcttcaggaagaaatcaacctaagtccttttgccctaaacataggccacatttatgtgatggttagttgcccgggtcctctatgaccttgggcaagttaccttacctttcagttcaatttcctcttctggaaaatggggataataatgttttctcttaatgtcctgtgcaaattaaaatgatatgatgtatgaaatgtgctcagcatattgcctgttctatgctgtgtaactggcaggtattatgattacaaagctcacacatcaggtcattgcaaagagttagtggcccctacaaggaaattctgagatgatttggaaaacattttttacctttcaacaacaaaggtcttccctgaagaacgctgaacagctttcctttgtaaacggcctcggctttattgtcctcttgtttcttttcatttttttccttttctcccatttgatgtataagttcatctctttagttctctcaaccacaatcacgcgagagtagcaattcacttcaccccacctctccagaaccttcttttacaggcatgtagatagttgccctgtggtcctttaggctgcacaatctcattttacacttctgattgttccattctttttatcattgcctctcaagttctcttccactatagatttcctctcccactggactggaattaaatgtagaaggtcctgctctaagactcccccatctttcatactgagatgacagtttccatggggtcaaaattattttgccctttgcagcagatgctttctaattaaaattccttgttatgttttctttctcttccattttctcttcccttccttctcatctccccctccatcctccccctttgcccgttttgtgacttaaaaagtccccagtgtctacctaatggtgacccttcttgaaccatcaaaagcaagagcaaaagcaaaatcagaacaaaatcaactccactttttcccaaaagagatttttcagatgtgacttggttagtaagaggccgactgctctaatagttttttttcaaattatattttgaagaagtaattcatgcacatggaacaaaatccaaacgtacaacagggtagaggatgaaaagtaagccccgcttccaacccctagctacccagtttccctcctgaggtaactcttattaccaatttattaccaacgatcaaatttgtatggatattctcttgcacactttgttacccaagtggtagatatacaccatttagcaccttggtctttccacttaacaatatatcttggaggtgattctctacccaaacatataacactatctcattttaacagttttctgtggcgtcttttaaggatgctgatgacattcagggaactctaggtgtcagaatctattaggaaaattaaatgtttttttaacatgtttgcaacacacacacacacaaactcacacatatgtgtaagtatccacgccaacataaacgacatgaccaaaagagattttcctggttttagaaaagagagctcagctaagttgacacacagttaaattagtcaagcttctctgtgttcaaaaatcagggaaaatgcctccagtaattgcaaatgttattaaatggactatctgttcatatgaatcactgcatattttttctttaataaaaaccgtagagttgttaatcaatccagtaaccagtgttgcctttgtcatccaaatacatcatattttaaagcagtacacctagagttctctttttgtagcattttcattaactttcataatttcaccattgtttgatgtagctttcagaaaatccattcattgctcacatcctttcactgtgatatttatcatgtaaagtagaattaatcctgcaaataagagcttaggtgtaaggtggtggcgggggggcagggcgtgcgggggcggtgtggggagcacggcgacagagagccactttgggggaaaatgtatcattcgtttttctgctgttaacgaagagaaccatttcctagggaattggactgacaggtttctgcatatgtagggcagaaacatcctctaggatttctgacttagtgttggaaagaaccctgaactggggctcaggagattgaggtttttgtcccagctctgcctccagttggtatgagtgaactctgtccagttcatttctctagggcagatgcccttagggtgaaataaaattgactagatgatcttcagtctctgagaaataggactttatgtttccctatctcatgatagtcttctttgtttcttacagttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggtaactggtgcttttttgccttttctgtggccagctacacatgcagcaaagcttttgttgctttggaaaataatcacctgttggaaacattaactagatgttagtcttcattaaatgcacccacagcccactctctcttgctcagtggtatagggagaagcccagataggtaacccaactttaggtaattggaaatgtctatatcaaacactgattggcaatacttcttatagtgttcattgtatcaacacattgtgctagaaaatgtacagattcacactcacgttgactttttgaggtacacaatccagctaaacatagcaattaactggaaagcaaaaacattaaagttttgaccccataggctctatctgcatctgatatcctaatattttgggaaagagccaggctagactatcatagaatcatacaggaatgaaggttaaaatcaaagggctgtgggaaaggccaaggttgtagccttgagtttgctgtaaaacaacctttaaaaagttacaataattggttgaattagatgatcctaagctaaaggccctagagctcttttaattattttcctttattccgatgaaatgaacaaataatcaatgaagtgatgaaatggtagacaaaagatggcatgagaagtaaaagctaggggccgggtgtgatggctcgtgcctggaatcccagcacttttggaggccgaggcaggcagatcacttgaggtcaggagtttgaaaccagcctggccaacatggtgaaaccccgtctctactaaaaaatataaaaattatctgggcatggtggtgtgtgcctgtagtcccagctacttgggaggctgaggcaggagaattgctcaaactctgggaggcagaggttgcagtgagctatgatcgtgccactgcactccagcctgggcaacaaagagagactctgtcaaaaaaaaaaaaaaaagctagagtctggttcatatagctctgaataattgctgacgttcatcttaacttgattttgcctattaaaaatattggggggaagaggcatgcaaaatgattttgtgtgagtctctaattctaccccatacttttatcctcaagtgtcgtccagtccatttgggctactgggacaggctgagagtcaagttggcatttcattgagttagagtctcccttcgtgctctccactatttttttttcattcaataaacccttattttccatactgaagcccactgatggtaccatgggatgctcccacaaggaaaaagttctatggtcaaataactttgggaaatgtggcaaattacattccccctttcttggaatagcactgtatacattagcatggtaaaagctctattatgaaaaaaaaaaaacctttaaaaagttgttttaatgtagtgtcttaaaaacctctgaaccttttattgtggtcattgttaatccttgaggaaccttgagaaaaataaattgacatgcagttattatatgacaggcacttgcaaagtgctgcggagttgagggggtgggaagcaatgtagcagaaggcatggtttttgcatttatgttttaggactcaagaaactatcttattttagagcaatgaggtggatcaacggaaactttttgtcccaccagatcctgccaaccatatacatccatgttctaattggaatgtaagaagtcacaaaatatgttgttcttccttcacatgccatttttattgcctctggtagtaggaatggaatttttagaaactctcaataccatcctcgcttggttccctttgaggctactggcacttggttgaattctagtgtagaactgaaggttgtattctagtgtaggactgaggccctggtgatggttctacactttttctctggatagaactgtctggcccacactacagtattctaacccgatgctctaacctcaagaactaaccagtcatggtatagaatgtccacggaaacggtttagaacccaggtgcctgtgaagacttcatccacagtggtaactccaggcttctctttggctcagtgattctgaggagaaatgtactcactctgtggaaagaggggttaaaggaaagctggcaaaagatcaagaaagctaggcaatttcgagcttataaaggaggggcaggggtgttttcaaaaccactcttatggtggaaagtagcatctaaggaaggagcctgcatggatagaagcagaatttaataggatatttcttttcttttcaacatttatttcagattcagggggtagatgtgcaggtttgttagctgggtatatcatgtcatgttgaggcttggggtatgaatgatcccatcatctaggtagtaagcatagtacccaatagttagctttttaacccttactttttccctcttctccccctaatagtccccagttgtctactgttgccatctttatgtccatgtgtaccccatgtttagctttcacttttaagtgagaacatgcagtacttggttttctgttccttcattaattcacttagcgtaatagctcctagctgcatccatgctgctgcaaatgacatgatctcattctttttttatagctgtgtagtattccatggtggctatgtagacagtttctttatccaatccacctttaatgggcacctagtttgattccatgtctttgctattgtgaatattgttgcaatgaacataagggtacatgtgtctttttggcagagtgatctgttttcttctggatatatacccaataatgagattgctgagtcaaatagtagctctgttttaatttctttgagaaatcttcaaactgctttccacagtggcagaactaatttacattcccaccaacagtatataagtgttctaattgggtatttcttgaaaactaaaatcaaagtcccatagatccagcaccaaaagagccaagctgtctctgtctgtcagatatgccttatgcccatcaagcacaaagtcttgccagtcctgcctaaaatgactgcaagatagcatgtgccatcttgtagcaagggagttttcagagctcagagtttcaaattcaagacacacacacacacacacacacacacacacacacacacacaacccgaataacctccaaaacaaacagtggaacaagtgaacaaagtagtcgtttaaaagacaaatgacaagcttgcaatgctggctgaaggggatgggggcgacctgtggtcaagtgggaaaaaattatgctcatgatgagctatttgtgaaggaggaatgcacaaataaaaatgcaggtgacaaaaacctgacatcttccctcatgcctgtgttttcctagtgagtaagcagatcaatctgttatgggaaaggaaaaggaaagctgtcaggcagagggggagagttggcaggcagttcattggaattcacagaataaccttttaagtcggaaaactaaactccatgcaagaaatcagagtagtaataggtgcttgatgtcactgtcaccccttgtacatgctgaagttggaggagttttgcctgctctgagactgtggtttgctctcctcggggtgctgcaccgccttccaggtggctgctgctcagaaaaacagtgaacactgctgaattcatccccgcagttgtttggttacacatggagataaaacccttgggagagttagcgagacatgccattccgtttagcctccagattgctgcctcccacctggaatccgagtctcagggctggggctagggagccaagatcttcccaatcaaacttcccattgagtgacaggaagtcacttgcctctgcctgaaactttccagggactaagagctcaccattctgtaaagcaaagcatttaacttcttatcagctctgatgtggtaccagttttccttacctgaggctagtatagtacagtagttaagcccttgtgttctatagtcagactgcctgcattcagaactggtgctgctagctccatgttagccctgtgacctgggtcaagtttactagacttcttggactccaagttccctcaactataaaaatgagactaatagtacaatgcctgccatatactaattgctaaataaacactagctgtgatttgttagtacatggttgctctgaaactttcttccattgctcctggttctaaccgggcaactgtacagatacaagcctagtttgtccttttcatgacagccctttcagatctgtggctaagtaagcatctcttctcaccctatgttttccactccaagtttttttttaatctagatacaatatcccaactctttcagctttttttcactatccttcttcaccgtattcttgaatacttctgtttgtcatcttcctctcctcccaaactgaacatggtgctggtgggaggtatggtcaaacaaggacagaatatggcaggagactgtcactcgcctcagtcaagattctttacttccagtagtgctgtagctgaaatttgctttgggacatttacaatagactggtgctcagtttacaatgggttaagacctctttgatactaatcatttaccttcaggacaaccagccaatttagaggcaagctgaacctgtatagagaataaaggtttccaaactgcacttggatcaaaataaatattttgaggctcaagcagttatcactatgttgtagatggatgtgcgagtttgtgtatcaagtgtcttggagttcaaatcaacatacatttattgagcggccgcacttagtgtatcaaagacaaagggcaaaatgacataaatatgaaaaggaaacatatctcggccctcaaagactcaacagctaggtggagaaatgggaaatagacgaataattgtatggctacatatagcaaataatacaagaaacaaaatgttatgagagttcagaagtgggaaaaatgagtttcagtttgaggcatctggaaagattttgtggataaagactttttgtaatggaacataaatataagtcaggctattgacaggagttatttctgccaatcctacccccaactgcaggaaatctaattggtcctccagggaatttgcaatcaagataattttttttttaagacagagtcttgctctatcacccaggctggagtgtagtggcttgattctgactcactgcaacctccgcctcctgggttcaagtgattctcagcctcccaagtagacgggattacagacatgtgccaccacacccagctaatttttgtatttttaatagagatggggtttctctgtgttgaccaagttggtcttgaactactgacttcaagtgatccacctgcctctgcctcccaaaatgctgggattacaggcgtgagacatcacgcctggccaagataatcttaagtcatatttttatcttccaaggacatattttagagggtgggaatgagaaatggccagcactgctggcaaagactttcagcccttccctcccccttgcaggacaaaatcagggctggcattagaagttgagggtcaaatccatggtttccacatggtgtcattatgccaaaaagcatgtgtaatagttatttattgctatataacacattaacaatttttaccagcctaaaacaacaaaaatttattatttcacacagtgtctgaggatcaggaattcaggggcagcttagctgggtgtttctgactcagggactgtcgtgaagttgtagtcaagctgtcatctgggcctgcagtgatctgaaaacttgactggggctggggaatgtgcttccaggaaggctcatccacatggttgtggactggaagcctcagttcctcaccatgtgggcctctccacagggatgccaggatgtcctcaggacaaaatacttggcttccttcagagtgatgagagagggctcgctcttttataacctaaccttggaagtgacatgccatcccttctgctatattctattggtacaatgtggaagtaaactacacaaggatgtcaatgccaggatgtggggatcattgagagcaatctcagagaggggctaccttacctctcacactctaggatgaacagcagtccaggggcaaaacagtggttgacatgaagtcttgatatagacatttttgcctttgggagggagtctacaaagacaagatcagaaagccagtaatggccctggggttccttgaaagtagtatctctcatgacagaagcaggcctgagtcagggcattggtgacagctggtgaaagaaaccaaaaaagactgaccttcttcttctggcttaggattcttcatttttgtgtttcactgtgtgatgaaggagagtgtgcgggagcagtggcagatacacctctgctgtgggtggttgcgattggataactcttctggtaagatgtcagtttggatgaagttttgaatattacatgttttacaaaactgatcagattaatttgtctcctaacttgagtacttacagcatatcagcatcaaaacacaggctgtttccatgtcataaaaatgatttgtgcttttgagctgagatgagtgaagtcaagtgaagaatgtgacttgggccatattttaaactagggatgcttttgttttggcccagattccctggattgcttaccttcactgtcacatcagtctcaattcaattaaaagaacactgaatgcgtgcctactgtgttccaggcactgggtctcaggggcttctggctggtagccaacagtgggttgagtggatgtaggaagcaaggagtggtggtggagatggagagaacttataaacattcctaagatgcctggccagtgggctgtacaggtgtactgatggcccacgaactgggggatgtagtgaactcagatgttgcctcttagcactggtgcttcccttgagaatgtttccactgcaggcaaactgctgttctatgtatcaaaaggatcttccattcaattcaggcagcttctctcagtctcaatacaaagcctaatccattttctttagtgaaggcagcacttgaactctaagattctacaagtagcactgagattccccccattccccactttattttattttttttcttccagtattttattttatttatttattttttttattatactttaagttttagggtacatgtgcacattgtgcaggttagttacatatgtatacatgtgccatgctggtgtgctgcacccactaactcgtcatctagcattaggtatatctcccgatgctatccctcccccctccccgcaccccacaacagtccccagagtgtgatattccccttcctgtgtccacgtgatctcattgttcaattcccacctatgagtgagaatatgaggtgtttggttttttgttcttgcgatagtttactgagaatgatgatttccaatttcatccatgtccctacaaaggacatgaactcatcattttttatggctgcatagtattccatggtgtatatgtgccacattttcttaatccagccagaatctacaatgaactcaaacaaatttacgagaaaaaaacaaacaaccccattccccactttatgctggccatatcagcaacctgctggtccttgtgctctgggaaaagcaggcatccttggtatgtgaattgtctcttcctataccacacattacagtacaaacctacttcttacaacttcatagaaaagctgactccttcaggtacccggaatgaacactgtgcatcaagctttgtttttttgtttttgtttttgtttttgtttttttttttgagacagagtctcgctcttgttgcccaggctggagtgcaatggtgccatctcggctcaccgcaacttccgcctcccgggttcaagtgattctcctgcctcagcctccagagtagctgggattacaggcatgcgccaccccgcccggctaattttgtattttttagtagagaccgggtttctccatgttggtcaggctggtcttgaactcccgacctcaggtgatccgcccgcctcggcctcccaaagtgctggaattacaggcgtgagccactgcgcctggcctaaactttgtatttttaaaccaggttattgaagtgtaatttatataccatacaattcactactttaagtatagaatttcatgagttttatatttttaacttttcttggtatcatttcagatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatggtaagaaaaaaaggctgtgttgtctacatttatattccagagatattgaattaatgtgagaccacatactgggtcttggatgatacttcctcttcaaaactaaatgcacatgtgcatgtgtatacctcgactcattcttggctgagaaagtgtgtatagaagcatagaaatgtgtacagaagtgtgtataggtgtttctgtgcctagtaaatttagtaagtatgaatgtgttattagactaatagaggaaagaagagatgagaggttagaaaattcatgagtaattaaaaacaattgtcacagaccattaaaaccagaaggaaccttagacattgtctagtccaatccgttcattttacagttgaggaacctcaatcagagaaaaggaaaatgccttattgacagtcactgagcccatctttaccatccagtagaactggggccagtcactcagccctcagccatccagcagaactggggccagaattcaggtcttctggctctcagggctagtcctatcaagaaaacagagatacacatcactcttagatgctgagcttcttccataggaagccatatttctaagctgagacagatgttcagttgggaatggggtgttgtacctaattatgtaaaaagagaaagtgtaggaaaaggattggcctacaggcttaaagtaaagagaaaggcaaagtgagcaagaacttaagaacttcaggatgatactgtgatgagtctgcattgtgtgcttctagttagatgatagtgcagtggtctttggttgcctttctttaagaccaaagtatactccagttcacacacactttggtggcctggctgtagtcattctcctgccttctcagtgctggaggtaggactgcctcattcgctagtatttttctttatgttggctccaaaaaccagttctatgtccaagggctgaaggcaatctggaagcagcatggtgggttaaaaaagcatcaaacttggagttggaaggctttggttcaggttccagctctgtcagtcactctgtgaccttgagcacatcacttctctgcttggagctacattctttctacctttcatatgaggggactagaatggataatctcttaagtgcctgccagtttcaggaccgtgtatggggcaacgctattttccagtttgggctggttgactagtgtatagcatctcagtctcccatctttgtgtgggaaagttagtgatgcacatgagaaaaacctttccctggccacaagcatttatcaaactctggccaagtaacctgtggatatgtcttggtgctcatataaagtcactggggtgccatgacatagacaaggcatgggttgtgggagctccttagtagataatagttggggctggttggaaaataacatttttcaagagggttatttagcattggatttcttgatgtccctggggactatttaattagcaaatatacagcccaatgtgtacatattttgcttcagaggatcagtagcaaataccatatccaggatattgatgttgtcttaccaagcaatcgacctggaaaaccaacattaaagtgctcatcagttgagaggaactgagccagtggggcaggtagacctgccacaggttctaaaactgaaatctgggtccttccattgtactagtgacagccagaagcttgattctattagcagagagtgaaaaatcatgccctctgtaccaccaggcattctcaagcttgagaaatagccaaactttcagtgcaagaatatcaaatatgtaaggggtataaatgtgtatgttcacattttatgtcatcttctcttgaaggcctccgagtttgtacataaatatcctctcctaggttaaggttaaggtcaataatgctgcctcttattcacaatgtaggaagaacatatgcactggttgtccaaacagtgctgtcaggatgaattaattcaccccggattttatataaaacagtccaaagaaagcaccatatccttcccttctcttctaattgctttattttttccttcatttgataaaattttcttatgcttctactatgtgcaaagtccctgatgccgcagctgaaaattttctttttttctttactgcagatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaa

SEQ ID NO: 5100 - DNA, 132203 bp, human
ggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgaggtgagttccatggtcagcattttacaaatgaggacactgggggctccagagaagttagggaactagccacaagtcacacaggtgggactcaaactcaagcctgtctttccacaaagcctaggttcttattcactactctgataacagtttgtgggttttggggtgaatcatggattattccaatacacctcctccttctccattcccctgtgaagaatcctggccttaagctgggtcgactcagcctcctattagactgaattttctgttgaagatatgagatgaagaggaaaatgcactggtttggtagtcaggacaccttggttctagctcctgctttacctttcacaagctctatgactttggatgagtcattctacccttgggaccccaggggcctcacctgtaaagttcagaggctgacagggatcatctctgaatcctccacgggattttggtggtatttctgtcacccctaaggggctgtaatgacaccttctgggacaaaaacaacatccccttcttgagacgaacataaagccagttcaataaatctatttactttcaaggcgacttgaagaataaatgtccagtgagggtaaatagctggcttcaccttacagatggagtaagatgtgaatatgttcatgcctctttggcctttgctttctgctcatagttctgaacactacacctcctcctccccactttcttagtaaagtgaaatgagccttagtcaagtaaacaagtacccttttaatatatccaatttaattaaagcaataatcaactaggaactgaaaataatccttagtgaaaactgggaaagagccctcaaattaatgggttattgcagggttgtaataatctgagaactttgcccatgctgattttatgctcaggagagcagccccatgacgtgctacaagccgcaaaaagaggatctacccggatcaataagccccataaagctaagagcagagaggctggtttgatgcagaaaagaaggtgactgaggcatggacagcagaaaatgagtctcctgtttagtacttctttcatttcacatcaaacataggaatttagagacaagatctggtcatttgagggtgggaagttaaaagagtccagttctcaggtaagtgtttctcttcctcccttcctccttccctccctctttcctttccttccttctttccctctttccccctctctccttctttcccttaaatttttctgaaccacaaaattaagaaatacgcatcatgaaataaccaaattgcttgaaattgtgtgaggtataaaattcaagtctttaatcctcaccctttctttctcttttcctctttctttacttttcctccttccttccttttatgttttttcaaaattatgaaagtaatgtatgctcattgtaaaagcaaacagtacagaatcacaggaagtataaaggaaacatttaattcccatttttccttcctatctctttcctccccttcctatcttccttaccttcctctctctctccctttcttcctttctcctttcctttgatttttaaaagtatgtaactaatttataatctttgtaaaataaccagacagtacagaacagtatggaaaattcctcatgccccatcccctttcctcaacccaccttttcatgccttatatatagacttaccttattcctttttttttttttttttggagacagaatctcgctctgtcgccctggctggagtgcagtggcatgaacacagcttactgcattgtctgtctcccagattcaagtgattctcatacctcagcctctcaagtagctagaattataggcatgcgccaccatgcccggctaattttgtatttttagtagagacagggtttcaccatgttgcctaggctggtttcgagctcctggcctcaagtgacccagctgcctcagcctctgaaagtgctgtgattacaggcatgagccaccatgcccagcctttattccttttaatggttgcatagtattctgttgtgtaaatgtcccatgatttatttattgggcaccaggtaagtttctgaaacataccttgaagttgttataaaagtttaggggaaatggaagaaaaatataaattggattacttgctgctgaaaatcccattttatagatagcaatcatatccatttctatagcactttatgctttgaaaattgccttcgaaatatcatctcatttgatcctcttcaagagcagctctgagaaatatgcagattattatctccatttttacagataaggaaactgagtcccagggaaattaaggaacaaaaatatgtatggcctcacagccagttactgattctcagcctagtcctcttatagcactataaatttaagctgcatttcattttgcaagtcatgaaagatttagacacccccttacttctaagctcatagtttagaaaatccatccaactcatacaaattcccttattattctaatgagaatggtggtagaatccttggtaaatatgaagagcctgattaatggctggcattcatagcaagctcaagattcatttgacttcctaattggcttctgttacattaaatgtaaagtgggtctattcattccaaatcccacttggaggtagaaagaaatacaatacgttgcattatcctatagaaaaagaaatgtttaaatcagtagtaaatcattcagaagtatatttcatttaaaatcagaaatgcccatcagcaccctactgccaattttctgtaacatgtttcagtaggatttgcagttttaacaccattttgtttggagaaaagagggttttaagtgcattttccacataagacactatagttacaattaattaaggagagaagctgggtgaacataatgaaatggtgattagatttctctaaacagatctgttttaaaaatacaaatgatttgatgagttacttttgtcaacaaggtcttcttgcataacattccttcaagaaatttaggatcattataactacaagtagttgaattgaagtttgtgcattagggttgaatatatcacattttggttttttgtttgtttgtttttgagacagagttttcacttgttgcccaggttggagcgcagtggcgcaatctcggctcactgcaacctccgcctcccaggtccaaggaattctcctgcctcagcctcccaagtagctgggattacaggtgcccgccagcatgcccagataattttttttttggtatttttagtagagatggggtttcaccatgttggccaggctggttgcaaactcctgacttcaggtgatccacccgcttcggcctcccaaagtgctgggattacaggcatgagctacagctcctggcctcacattttgtaattatgcatttaatgtctgtcctccccacagggctaactgtcctatgatggcagagatgtgtgtcttgtcttctcagcactgtattcccagggagcaacacagtgtccagcacatagaagggattcaataaaatttattgagctagtatatagataaatccatcagtgaggtttcagccaggctgggtatctctggtaaatgcctatcatgtggttggctgacatgactttaagcaataggaaaaaacccttaggtggtatgcaaaggagaagtgtggtcacatacgcttagaaattgtattttctgaatatctgagctgggcatatttttgactttttaaacacagacttagacaatgaaagaacacatcatatatcagaagctttatggattgattctcatgtcgagttttatctttctctcaggtaagaaaatgtattcttattatctctttcaatgtctcatgtatagtaggttatagaaataaaccatttgaaaaatactaccaatggagatttgctgggctgcctcttaatggtcaccttttggtcaatatggctacagaagaagctgaagcatcagtaagtgaattaattcattcatcattctgtactactgatagagagctggcctcaagaaggcagtagcttggactactacctttgacatttcttaaagcaactctgaaatgccatttggcggctaatgcacacctaacagaagatttgggttttcttttggactgtttcctctcctccgtaatgctttatttaaagctgtctgaagcattgtgatatcatctttctgtctccattatatgtatatggcaagaatcatagaatacagatggggaaactgaggcatgcaaacagctggtaacagattcataaagcaatgggcatatattctggaagcacccagaccttccctagactctatgacaggaatgaaaataatttgtctctattttacagtagataattaagacaattcactgaagtagctggtaatttggagacttcaggagaaggtcttggtaaactgcaatcttgtccacattaagtaaattcagtttgtagcattgcttatttagcacataagtacttagctaaaaggtcataaatgccagtgagtgacaacgcctgatgaaattgacctgtgtttaatttgaacggtcctcaagcgtaagagctaatctgcaaaaataccaaatcatcattgccatcaagagcaaacactggcttcttgctgcatgcagagcctgataggaaaccatgtttcttataatagagattgaaatggggcctacggggtacagtggcaactttgtcacctggcctggcctacctgctaaaaagttgatttatttttcctctacctgtttcctcaagggcaagaaactgtattttcccaatttctttatccaaagcatccaacacaggccttgacacacagtttaggcacttggttcatatgtgctgatttaatgaattcatgcaatttgaaatgatgaaaattttcaacatctgtatggtggtggggtatatgacacaaactccattggtttttgtgaagggctacagggcatggtatagagcaatctagaatagtggaatatgggaatctagtgtagtcatggaataaaaagtgaagagtgtgtggtactgaaaagtttgcatgggtttgcgaggaatgtcaccactcagtgaaaattattattattgttattattattattattttgagacagagtctcactctgttgcccaggctggagtgcagtgacgcaatcttggctcactgcaacttctgcctcccagattcaagcaattctcctgcctcagcctcctgagtagctgggattacaggcgtctgccaccatgcccggctaatttttataatggtcagtgaaaattatgatagatgtgcaggtcctcaacctgcagaggtcaatttaaagcagtcacaaggttttccagactgtttaagtctcaaattcatgagtcaaacaagttttttttgtaggttatcaaacattgaattataattgttctttgattgccgagaaattcattacttttttcttggaaaaaaaagaccctgtccttggaaacaacggcataactcaggttcagttcccttcaggctccagatgagtcaccagcctcccaactgtgagggtcattattggggagagattaaggccagattaagtggagggtgactcagagatgctctaactgggaggagccagagtgtggagcaaaactgtctccatagaagaatatcaagggttgagaaggagaagccaaatctgtattaaagtctatggggtgagagcagagccagaaagaagagatgaagactgaggtcaagagctgaatagttgcagaatggagcaggaggtaaaaaataaggcataaatgagagaagagggcctaggacttaggctgtatgtgggactcggtttcctagttctctgtcttagtctgctcaggatgccataacaaaatactatagattggatgatttaaaccatgggcatttatttctcatgtttctggaggctgagggttcaagatcaaggtgccagatgattcaattcttggtgagggccctcttcctggcttgtagacagctgccttctctctgtgtcctcgcaaggctgagagagagcaagagagctctgctttcttcctcttctataagggcactaatcccaccataggggctccaccttcatgccctcatgtaaacctaattactttccaaaggccacaccttcaaataccaacacattagaggttggggcttcagcataggattttaggggagggggaaacaaacattcagtccataacatgattttcctcttaatggtgctggctattggctgtgtaatggatatgggtaggtttgggttgaagacatagggctatagtagttgtcctaaggtcttgctcataccatgtacacacacacacacacacacacacacacacacacacgctcacaccccaagtggagtaggacaggctttgctggctgaaagagtgtaacgtgttctggagcattcttgaggcaggaggctggggttttgtgacattcttgaggtgggaggctgggtttttgaggcacctagcctctacagtcagtaacttttgctcctgtattggataggcaattagtcaatctgggccggaatcaactttcctgagaagttgtcacatatgcagagacgacctgactaggaattgttttgacacaggaaagccccagagccatgtcagaaaatcagtccttaggctgtagagacaaactaggccagggcagtcaggacacagtaggagtgtagaggtaaagaaattcttcttctgaaaggtgtttgtgtagccagggttcaggaaaagccctatcttttctttttttaaaaaattttattttttaaattgtaaatagacacaggatctcgctgtgttgcccggactggtcttgaactcctgagctcaagtggtcctcccacctcagcctcccaaagtgctgggattacaggcatgtcccaccctgcctggtctatcttttcttgagaaactaattccacgagaaaagagaagtggaggataaactttgagcagaaactaaatttctgtatgaattcaagagttgagctgtccaatatggtaattacttgcaacatgtggctaggttttaattaattaaaattaagttaaaaattcagttcttagtaatacaagccaggttttaagtgcttaatagctacaggtggctggttgctaccatattaggcattgcagatacagaacatttccatatcacagaaggttttattagacagcactgttctagaaggttgtagagactggcatttgagaaaagatatttgttttaaacagctttattgggctgggtgtggtggctcatgcctgtaatcccagcactttgggaagccaaggcaggtggatcacttgagctcaggagtttgagacagccttggcaatatggcaaaaccccgtctctactaaaaatacaaaaatgagctgggcatggtggtatgcacctgtaattccagctactcgggagactgaggcacaagaatagcttgaacccaggaagtggaggttgcagtgagttaagatcgcgtcattgcattccagcctgggcaaccggagtgaaaccctgtccctaaaataaaataaaataaaataaaataaacagctttactgaaatataatttacataccatacagttcacccatttaaagtatacaattcaatggttttcagtatatttagagtggtggaaccatcactactatctaattccagagcatttttataacccccaaaagaaataccatactctccgttcctcccccagcactccaggccttgacaatcagtaatctgttttctgcctctatgaatttgcctattctggacgtttcaggtaaatggaatcatacgatatgcagccttttgtgactggcttcttccactttacacaatgttttcaaggttcatccatgtgtagcatgcatcagcagttcatttatttttattgctgaacaatattcaatggtatggatatacctcatatttttttccattcaccagttgatggacatttaaattgtttctacattttgactattatgaataatgctgtatgaacatttgtgtacaagttttgtgtgggcatatgctttcatttcttttgtgaatatacctaggagtgcaatggcagagtcaaatgtaacttcatgattaacattttgaggagcacgcagaccattttccaaagaagctgcatcattttacatccccactagcagtgtatgaaggttctgatttctccacatcctcaccaacacttgttattgtctatctttttgatcatagccatcctattggaaatgaagtgatactccactgtggttttgatgtgcatttccctatgactattaagcattttttcatgtgtaaaaacagacattttgtctaacaatactcaaagcctttcacctgggaaattgtgcattctagactctgaagcataagttctttctttttaattttttcagatacatatttccttgagttggcacaggcatagcacatttgtctagcataggacagatgaaaaacgctcatatgatagcctgtttgagcttgagcatgtcacttaggagggtgactgaccaccatattctgtctcaggctagtaagttgtacaaatttccttcaacagtaaaaatattgacagggaattgcataggctgaaaagtaggtctgaaacagttttccccatgttgttcaccgcccggaggtggatgggcttctaggatccttggcctggatttttgttacctaggtgcttttgagttggtctatcaaggtagggcttatgggagctgttagcatcacaacatagagatcttagtagagggccctgtatttccactgccaggtaatgatcagtagtctttcctcttctggaaatggcttctctgcacacaccattatgcaaacttaggggctatctttcattcttccctttctctcactctccacatctaatccattgagtcttgttcatgccaccacaaaaatacatcctaaatctgaccgttttcttttcttttcttctctctctctctttttaaaccattttaactgcttccgccatgggctgagccaccatcattttctcttggctgacttcagtagcctcctaatgttctccctgctttcactcttgctctgctacagtctattctccacacagcagccagagtgatcctttaatatatcaagtcagatcataccactcttttactcaaaacttgccaataagttcctatcaaaattagaatataattcaaactctttaatgagacctaaaaagcactacatgatctgatctcccactgcctcttgggcttcacttactaccatgcatcctctttctccctctgctccagacacactggcttcctagtattccgtaaacacaccaagcacagtcccaccaaaaggcctttgcacgtactgttacccatgtctgggtcactcttattccacatctttgtaccctggctcttttttcatcccttgggactaagctaaaaatgactctttctcagagaggcctttcttaactatcctacataatgtagacatttcctttcccctcatctctgcttttcccattacctaactcatcaacctgtcaatttctttcagagtactgtatgtaatttgtgttttttcctttacttgtttattgactgcatctgtccctggaatgtaagctgatgagctcagggaccttgtgtgttatgtctcctctattactgcactctaacactgacacatagtcaatgctcagtgaccatcactgttgagtaaataattttttttcagggagcttctggctttatgagtaaggacatctatttttttgggtgagacatgggccttgaatccaagatttgaaggaaaaatcacatgacctatgtgaggataattcctctgtctcctatgccaagaactcttggcaggccacaaatggagtcagcagcctaggtactagaggaagggatgtgttggacaactctgtggctggtgattggtgacagaaatgaggatcagggttggacgcttctatatctggtaggcctggtttatctaaggattagcctggttacaagaccagtggaaagtgtgggcagtgggtggcagatagtgactctgattctctgtggttgtgcacactatggccatggtgatgtgggtaatggagctccccagtatcaggtacctattgattatatctactcagacagtcatggggctgctagaccagggcctggtctacaaagtttttcagtgctccagaacgttgaattccaaggatttgtgattctaagagccagaagactccctcctcaagtgagtatctgctcacctgcccttttatgagtgggtagtgacacttccaagataaggcagacatggagtagccttggtagaacgctcactctcagagtggccagattcttcaaagtataaacacaactgatgcctctggtgggcccttttcctcaaatctgctctgcagcctcaccttgctctcataggtattaccaggtgattagctgggttctgagccctacacagtgttgagtcaagttgtgtcttcccagcattcatatgttgaagtcctaaccctcagtacctcagaatatgatcttctttggaaatagagtcattgaaaatataattagttaagataaagtcatactgcagtagggtgggcccctaatccaatattattggtatctttataagaagaaaaagtgtggacacacacatgcacacagggagatcaccatctaaagatgaaggcagatatcggggtcatgtgcttataggccaaataacaccaaatattgccagaaaaccaccagaaactaggaaagaggcatagaacagattctctctcacagctctcaaaaggaaccaaccctgctgacaccttgaccttggacttctagcctccaaaactgtgagatgatacatttctgttgtttaaacaacccagtatgtggtatgttgttatggcagccctggcaaactaatgacacagacactgatgctctggcaggctcactgggttagaattaaaaagaggaaagcaggttacctcatggagaagagacagtgaccagatcatgcccagagtacctgaccatggaagaacctcatttgtcctttgccctgaacgtagtgcaggacagtggacctggaaccacagtcccccaaactttgaaacacttgaacattttaaggagaaactttgccttctaagaaagggtagaaaaacctgtataggatatgtctgatgttacttaatgctgtcataagcagaaaacaaagggattttgctgaaaaaaaaaaacaaaccattcagattgtctatctcttagagttttaaaccatttactctctgactttttattttatttgtttatctatttttgagacagagttttgctcttgtcgcccaggctggagtacagtggcgtgatcttggctcactgcaaccactgcctcccgggttcaagtgattctcctgcctcagcctcccgagtagctgggattaaaggcatctgccaccacgcctggctaatttttttatttttagtagagatggggtttcgccatgttggccaggctggtctcaaactcctgacctcaggtgatccgcccgtctcagcctcccaaagtgctgggattacaggcatgagctgccacacctggccttactcactgacttttaaaataaatgtatttattacttttggggtctgacagggacagagaattctcccttgatcttttgctaaaagttccctaaaacagaaggcagagcacgagttcagtatacagtccagaacttctcattctatgccagatgcttcattcctgatacctttgcacaagggacagcactccatctgcccacccattagcctccaactcagtgccctaatacaggatacaactatttattcagtaaacagctacaaaggacctactctgtgtccatgaacttggacttccccatctcaaactgtacatgaaaattaacttgaaatggatgaaagacttaaatgtaagaactaaaactgtaacattcttagaggaaagcataagggagaatcttcacgacctttggtttggcaatggattcttagaaatgacaccaaaagcggccgggcgtggtgtctcacacctgtaatcccagcactttgggaggccgaggcgggtggatcatgaggtcaggagatcgagaccatcctggctaacatggtgaaaccccgtctctactaaaaatacaaaaagttatctgggcatggtggtacatgcctgtattcccagctactcgggaggctgaggcaggagaattgcttgaacccaggaagcggaggttgcagtgagccaagattgcaccgctgcactccagcctgggtgacagagcaagactccatctcaaaaaaaaaaaaaaaaaaaagaaagaaagaaatgaaatgaaatgacaccaaaagcatgagcaataaaagaaaagaaaaattcgatacattgaatttcattaaaattaaaaacttttacacatcaaaagacactatcaagaaagtgaaaagacaatacagaattggagaaaatatttgcaggtcatctatctgataaggttctggtatccagaattaaaaatgggcaaaagacttgaatatgtatttctccaaagagtctatgcaaatggcaacaaacatatttaaaaaaatgctcaatgtcatcagccattagggaaatacaaatcgaaaccacaatgagataccactccataacctctaggatgacaataataatagtaaatggaaaacaacaagtgttggctaagatgtggagaaattggagccctcatacattgctggtaggaatataaaattgtacagctgctgtgaaaaacagtttggctgttactcaataagtgaaacatagagttactatatggcctagcaattctactcttacgtttataccccaaataaataaaaacatgtgttcaaacaaaacaaatgacatgcatgttcatagcagcactattcataatagccaaaagagagaaacaatccaaatgtctattaacgtgaatcaataaacagaatgtgatacatccatataatgaatcttattaagccatggaaaaggatgaagtactgacacatggtacaacatggatgaacattatgctaaatgaaagaagccgacaagaaaggacacatattgtctaactccctttatataaaatgtccagaacaggcaaatccagagacaaaaagcagattagtagttgccaggggctggaggggaggggcaaactgagagtgagtgcttaatgggtacagggtttcctttttggatgatgaaaatgttctggaattagataatggcgatagttgcacaacattatgaatatgctaaataccactgaatagtagactttaaaatggtttaaatggtaaattttatgttatatgaaatttcccagtacaaataaaatggtgcttggcactcctagggtagtaacagccatttaagtgagatttatgatgagtttttcctaacacggaaaacacttatgctatgagtgagaaaagcaggggacccaattttccttacaatatgatctcagcctcacaaaaacaagcaaagcctgtgcacagaaaaaaactgaggaaatataccaaaatgttaatggtgattatctctgagtggtgggactctctggctggctttgttttcatctttttacttgctaatacttttcagtttttctttaagaaaacatgtacagtatcacttttataatggaaaaaacaccttaaaaacagtaaggaagacaataaatgtcatttaaaataaaaggaaacagtggatagaggcgaagagacacagaggagccaaatcaagagagaacacgcttcaggggagcaatcatgcaatttggacttgaaaattgccagggaacagatggcagcatctaagcagacatctgcaatggatagcgaaatcatatgcaaagacacaagtggcctttgaagcaggcccttgagaggcgcggcagagaacgctacttgcctggccaaacataagggcaaagcccctctccaccttgtcacagtctggcctcctcagagccctgctggaggcccagaggctgcggtggggctcagctcagttgggcttccatgtgtgagggtgcaaaagaggctgtggaggaaggaagaggcttctgatagtgaccctggcaaacatggcagctgacatttacatggggttgcacagtttataaacattctcacacacataacctaaatgttagttatgattgcatcatcttttatcatggccctatgaggtaggcagttattatttccatcttactgtggaagaacgaggcatggagaagtgatatgagctatttatttaacttttatatagtgttctctatgtgccagacactgtgctgagagctttcacaggcatctgttgcctatgttcacacagctagtaagagacagaactgggactcaaatttggctttttagacttcactataccacatttctgcttatgtctaagcagaatttacctatatcttcagaatcttaagtaaggccacagtgattctatctatctatctatctatctatctatctatctatctatctatctatctatcatctatctattatctattatttatctgtctacctatccattcatccatacatctctccatccattcatctatctatccatccacccatccatctttatttttctgattataggtgtaatacatgattgtttaaaacatgcaaatatgctgaaataagtaacataggaagtaaaacatttccctaatctcacacctaaagataatcattcttaactgtttaatatgtgctcttccacacttttttctgtgggcatactacctgcatatttttcttttagtttttaataggataatactgcacctgcacttaatataactcctatttcacacaatagtaagccttgaaaaactctccatgactatagaggcctatcttgtttgtttccctattccattgtatagaggtagcaattttcctaaatagtcacttattgatagacatacaggttcgtcaattgttcttgattataaacaatgtggcaataaatatcattgtactctcatctttgtctatctgtatatttgtctaaaatgaattgatagaaatgaaattgctgggtcaaaggatacacacaattatatacaattaagattgccatagataatggcaaattgcccttcagaaaaataatacttaattggcactcccactagcagcgtgtaagagtgactcatttccccacaggcttgccaaagctggatattctgtcttctaaaattctatcaaccaagtaggcaaaaatggtgtctccttattgttttaatttgtgcttagaaatagtaaggtggcatctttctatagtattggcctttatatttctgcttttgtaaattgctttttcccatcttttggcaactggttttaaattagtatactgcaggctgggcatgatgtctcacacttgtaatcccagcactttgggagactgaggtgggaggattgcttgagcctaggagtctgagaccagaccagcctaggcaacatagtgagatatcatctctaaaaagaattaaaaaatttgccaggcatggtggcatgcgcctgtggttccagctaattggaaggctgaggtgggaggattgcttgagcccgggaggtcaaggctgcagtgaaccatgttcatgccactgcactccaacctgggcaagagagtgagaccccccctcttaaaacaaaaaatcaaaaactaaattagtatactgcagagaggagaggcccttgtagaccatatgagattatgatacattctcttttaaggtgcaactaggccctggagatttatgctcaccgtaaaaccagttcttaaatgtatctgacatcatttcagagggctgaacagaaaggcagttaaccaacaataattgagacttgggtttcatatcacttattgtcttgtgggattaactcttgatttattagccacacaaaagatgataaagtaatataatcacagaagccagggacagaagtaagcattttctcattcatcaatggatagttcagaaataactccccggcaggtggatagtatgagttcctgcacatgggagtgtgtgatgcaggtggaatgtatatgagtgtgtgtggggggcaggcatatacatgttattgtttgcttttggaaaatgtccactagaggaatggagggagagaatactatatggtcagagaatatctggaagctttcatttggcggcatctcccagaagcagggaagtatttacttcctgctagcctctgtagtgttctgttatggctgtcactgttttagagtggtggtcccaacgttacaactgtaattcagggagtggttacagttccaattctgccacagagctctttatcttctggcttaggctgtactggcactggaattaggttgataattaggtaatcctcagatatttacctagtagactgggggtgtaagatttgtagtggtgatagtatcatcactcatctgcagcttcttgtgaaacaaagggcatatccaatgtaaagtttcaaagatactgccgaactacttaccaaaagaccgcacccaatggacatgtccttcagcaatgtttaacaaggttttgcatacatcatctcacttaatcttcaaataatcttgtaaagtcatcagggagaggctattatctggcatagactataatgtgaatggtggcccttaaagttgaacgggcatacaatgctgtggccccaaatctccattttactgaagcaaacattgaggtatcaggagggtaagttacttgctcaaagttccacagctgatgagtgtcagggcatggatttcaacccaggctgtctgactccagagccaatggtaactggggtctatggccatcttgaaaccactgcagtgcccttggtgaggagacagaaggaggccatcaggatgcacccagggcagtgccatgtcttccattcctgagtacaaacaagtcccagagtttcagtatcgcccagctggtcattcttcaggcctctgtcagtgcctttcagtgagaagcagtccccagagacagaataaatcagatcatttggctcaggaaaaggcattggagaaacaaattgctgttgcaccatgaatgtaataaggcagttaggtgggcggaaatagttctcttttgattatatgagtgaggattatgtgtagcaaatttgaattccaagctgccttttccttggcctcttccctaccctttcactagccatacacttctaactgcctctccaagctgtccagctggtatgtgctctgggaacactaatctaacttttcatattagtccaggcaaaatataattaggaagaaactcttctgccaaaacaaaaatcacatgctaatgtcaaatagagatgattttttacatctactatttttgtttatttgcaccagtattgactcataattatattgtataacccagatttgactgtattgccaaatacaataaaacaatttttaacagaaatttcatttgttttctctttcccctcccccaaatttggacagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctgtgagtaacttaacaacttttttccttagcaagggtagtgttgacacagtacttctctgctagcagtggccccaggttgctagttttgtcatcactttttaatgaggagcacatactgttttcttttatctttattttgatatgatttcaaacttatagaaagattggaagaataggatagaagaacacacacacacacacacacacacacacacacacacaccacttatttgtttctaagtcatttgagagtaagttgcaggcataattctttgctacccctaaatatctcagtgtgtatttcctaagaatgaggaattctcttaaccaggctataatgatcaaaatcagaaaagttgatgttgatacaatactaacatctaattcacatttcacattcatatttagccaattatcctagtaatttcccttataactattttttgcttggcccaggatccaactcaggatcacacattacatttagttgtcatgtctctttagactaatttggaatagattctcagcctttctttgtctttcatgacctagacatttttagcatacagtccagttactttgtctctcaatttatgtttgtctaatatttcctcataattagattcaggctatgaatttttggtaagaataccacagaaatgatgttatattcttctcagttcatcacatcagtagacacacggtgacaatttgtctcattattcataataactttgatcacttgattttggtgatgtctgtcagatttctccaccataaagttattattttttcctttgtaattgttgagtaatttctggggagatatttggaggttatgtaactatccccttcttaccatactttcacccaataggttttacatctattcatgattcttgcctgattcactaatcactatgatgtttgcaaaataatgatgtttaaaattccatttttttacatttattagttggcattctattgtaagaaagagctttttcttcttccatatttatgtgtttatttatttaagacacagggtctcactctagccaaggctagagtgaagtggcatgatcatagctcactgtaacctctaacttctgggtgggctcaagtggttttcctgcctcatcctcccaaagtgctgggataacaggtgtaagccaccacacccaaccttatttatgtgtttatttatttgaacatgaactcatggattctcattttattcaatgggttacaatctgctactatcatttattttgatgttcaaattggcccagggttggtcagtgagagtttttcaatctggctcttgtgtccttttgacaagttccccatcattctttgagcattttcttactctctggcacaacaagatgttccaggctcttcttgtacgttttctgctcagcccaaggagcagtcattttactaaggcgtccctcttccttttagtggggaatgatatttataaaccaattcattttttcttctgagagcaattatgatatgggagaactctttggaatggagttcttgtaaggaacctggcttcttggaattacacctgtatttgtctcctctcgagtttggggaaggaaagatgagattgcttttctctgcataatcccactctgctctcaaatccagtcctctccactatcagcagcagcagtctttagcacaggtagtcagtgataatagcatcaagacaagatttttttgcatttcccaaaactttcacttattcttgaaggagtattattgactgttgttatgggttttttccttccaggaggaagctgttaggaaaggaataggggctagatccatgcctaaaagggctctctcagactaaggggatatgttttcaccaacagtctggatgctgtttgagttaactgcagaggaacattccaggggatttctgtttctttgagattagaccaatgcaaaggagcaggaaagctattcctttgtgctaccacccaaagatatttgttttttctcttttctggggccttaaaaacaaaagagaatattcctagctggctctgattacaaaactgagctacagactagtaggttaagcctgaacagctcacccaaagcagtttaaagtaactttatctttgatctaaggaaccggaagtatggccttatatccatgtgctcagcagtggtgttttaaaaccacatctggccagcgaatggccatgagttttcctaccactttgtgggtagatagctaaatctaactgctgtgttaaagtactagacaaccctgttttattttgctcttttgtacactttttttttttttttttgagatggagtctcgctgcgacacccaggctggagtgccatggtgccatctcatctcactgcaacttctgcttcccgggttcaagcgattctcctacctcagcctcccgagtagctgggactacaggcacatgccaccatgtctggctaatttttgtatttttagtagagacagggtttcaccatattggccaggctggtctcgaactcctgacctcaagtggtctgcctgcctcgccctcccagagtgttgggattacaggcgtgagccaatgcacccggcctctttcatacactttttaatggacgaccatcctctgggtctgactgaatcatggtgggcataatgcacaatctaacgtaacaaacaaggaaattatcacctcaaacaaacaaaaaaaggtagtaaatgttctctctactattcagatctcttcaagtgttctttccaaaccttggaccaagagttcctaatctaggggccagaatggccttgaaggagttgacaaagcccccgaaatcacaacaccctaaaaatacagggcagattttttttcagagggtgcagtctatagtttccatcacatgctaacatattatggtaattggtgccttttactaagttcttaccgtgtgccaggcattttatacaaaaggaaataggggctcagagaggttgagtaaattgcctaatgtcaccaatcaaataagtagtgtagctggggtttgaacagattggtctggttgcaaaacacatgttcttttcacctcccaccgtacaggactatctcaagtgagtctgtggcccccaaaatgttatgctatgttactatgtcttagaagcttcctttggaggtaatggctggtttgataattcacctggggaaattaggctactagctgtagtcattgcctgcctcaccactgaaggatctgtaaaataccatagaatttcacctatttcgattttggctgtatggtatctgggacaaagggggcaatatatgaataaatatgagtgattacaacatgtctagcttcagcttttgcctaataaattgatatttatggtccatagaaggattatgacctttaaaaaataaattttaatgagtacattgctaggttacaaatctcaataaatctatttacacataaattatatatatatttatatattcatgagaacaaggcttttggggaacactgcctgaaaaacatgaaccctacctgggtttaataaacaagtattcactatagttggaaatgtcttggaatattaaacaacatggtgacaaataataacagtgaaatttctagtcattagaaatttagttttcaagtagttttaagcatcttctacttatttttaaaaattacaaatgtaatacatgtgtttgtgaataaaatatatttaaacaatacaaaatcatatgaaatatcaagtaaaacctacccttcactatcctcttcacagaggtgtctgttaaaaaattttttccatgggtttgtaataagtgtgtgcatgtatgtgcatgagtgtgtacagtttttaaaaagggatggcactgggagatatacctagtgttagatgacgggttgatgggtgtagcacaccaacatggcccatgtatgcatgtgtaacagacctgcaagttgtgcacatgtaccctggaacttaaagtataataaaataacataaaataaaataaaataaaaaggacagagtgggaaataaaataataataataataataataataatatatacatacatgtggttctgcaacttgatttattttaacttaatactatcatggacagacacataggtatatttagatctgtttttagggctacatatattccatgcaacataatttacatgtaacataatttatttaactagcccatcattgatggccatttaagttgctttcaattttttgcaattacaaataatgctacagtaaatttcctcatacatatatcttggtacgtttaggttttcaattttgtaagacacgttcctaagggtagaatttctcagtaaaagcctataagctgttacaatttaaatagatttatcatttttactagttattttattaatgtaactattcattgaaaattaattgacctctaaaagtaaaattactagatatatatggtaaaagatttaaaaatacataaaagtataaatctaaagtctcctttcacttcaatcttttactctatgtgtctatccccaaaagcaatgattgttaataatttcttatatatccttgcggaaaaaatgtaaaacttgaatttacatgtaaatatattttttttctttttcacagttgggttcatcattatatgcatccttttctgcatcttttaaaaatttaataatatttttggaggcattttcatatcagaaaatatagagctatctgattcttttggggggaggctgctgaatagtatgaaagaaaaagggtatggtataatttattcaacaagctctgtttgaaggactttgaagttgtttctagtttctagctatgacaaaagtctacagggcttttaaaagtaatgggtggtgacagaaatatcttgaagcaaccgtaaagaaattatcacaagctaaagttcctctcaagatatggccagcataatttcctaatctcaactcagacacatgatcaaacaaaggaattttttttgacctgtgaatgtatgaagaaaaagagtcttccaaagacatgcagattaaattccttttagatctgcatttaagaaatcctttctattgaaaagaatgaaataacctgaactgagttcatcatgggaaatctacactgtatcaaagcatagcatccctatatctgcggggtcattgatttgctgaggttcgttaattggtctaatgctccagcttctttgaattagtttatgaattgactattcttaaaatatgcagagatggattatatggtctatgtcctttataaaggcctttgtttggctcactattaattcctctatccaattatcagctctgataggaaaagttccatggtgatgggctctactagctaaaagacaatttggtcttgccctcatacatcaattctctgtgctaccctccttcctcatcacgaaaagtaagcatgagctgtttgtagttcactcaaagccttcttatttgtattctccttcacaggatgacattctcctatagactcagagatagaagctctagcctgtctgtctattgcagcattcgtttttcatgcttttgcctggaaactgaatgcagacaccactttgaaaaaaaaaagtttccttttcaccttaaagatactcatttcatatttttctaccccacaggcagatctgtctgtggcagtttctggtcaccattatctctcacaaatctaatcaacatgctgaattatatttatagaggtcctgactgaaagaaaaaccagatgtgacatgtgggctagaacgacacatagatttaatatgaggtgatatacccaaatcacaaccagaatttggtaccttagaaaatgttctacttaacattctgttggcaggtacatctgcaacaaaatgcctcataaatattcagctactctatacctctgttctccagctcccaatgattacaataatacaattttgtgtagagtgaaagagcaaatggcaattaagcccacagacccctgtgaattagtatggattatctccactttaaaatacagagacagcaaggcttatgcaaattatttgtgcaagtgatcacttgttcacaaacaggaacaaagtgaatatggcaaatcatgtttgtgagccctccaaggatggaggcctgacctcatggcttctgtccaatgtgaatagatggatattcagtcattgctcaagcacagtactggcttttgcatttgattttttttttttttttgagataaggtctcactctgtcgcccaggatgtagtgcagtggtgcaatcagagctcctcactgcagccttgacctcctgggctcaaaccatccccctgcttcagccaccccaccccgagtagctaggactacagatgtgtaccaccacacctggctaattttaatttattttttattattttattttattttattttttggtagagacggggtcttgctatgttgcctaggctggtcatttactttttattaactgaattttttattgagagataattgtagattcacatgcagttggaaattcttgtacactttgtctagtttcctctaatggtgacattttgcaaagctatagtataacaaacagaacattgacattgatacaacccaccaatcttactcaggtttctctagtttttattatattcatttatgtctgtgtattaagttctatacaattttatcacctgggcaaacttgtgtatctaccagcatactgatgctgaacagttctaatactagtaggatccctcatgttgaccttttataaccacaccaacttccttcccaccctttccccctacgctgcttcatacctaacccctgacaacactaatctgttccccatttctaaaattgtgtcatttcaacaatattatataaatggaatcacacattatgtaaacttttaggattaccttttttttttttttaactcagcataattctctgaagagccatccgggttgttgagtgtctcaatagtttactcatttccattgctgagtagtattccatggtatggatatgttacagtttattcaattattcacctgttgaaagacatttgggctgatttcaattttttgctgttataaaaaaaatccctgctatggacatctgtgtacaggttttttttgtgaacataagtttttatttctctgggaaaaatgccttggcttggctgtatggaagttgcatgtttagtttttttcttaatttaaaaaataattaaatttctgtgggtacatattaggtgtacatatttgtgtagtatatgagatgttttgatacaggcatggaatgtgaaataatcatatcatggtacccatcccctcaagtatttatcctttgtgttataaacaatccaattatactcatttagttatttttaaatgaacaattaagttattattgagtatagtcaccctgctgtgcaatctaatagtaggtcttaatagtaggtcttattctttctaacttttttttgttcacattaatcccctccttcccctcccccaagtccccctctacccttcccagcctctggtaaccatccttctactctttatatccatgagttcaattgttttgatttttgtagcccacaaacaaatgagaacatgcgatgtttgtttttctgtgcttagcttatttcacttaacataatgactccccgttccatccatgttgttgcaaatgactggatctcatttttttgtggctgaatagtactccgttgtgtatatgtaccacatattctttatctgttcatctgttgatggacacttaggttgcttccaaatcttagctattgtgaacagtgctgcaataaatatgtgagtgcagatatctctttgaaatacttattccctctcttttgggtatacacccagcaatgggattgctggatcatatggtagctctatttttagttttttaggaacctccaaactgtttgcacatttagctttataagaaactgtcagactgtttacaaactgtcagactgttttacaaaactgtttttcagttttacaaagtagctctatcactttatattccaccagcaatgtataagggatctagtttctcagcatctttgccagcatttggtgttgccactatttttcattgtagtcattcttgtaaatttgtagtgatattttattgtgctttcaatttgcattaccctgatgcttcatgatgttgaacatcttttcctgtgcttatgtgccgtcttcctgtgttcatcagtgaaatgtctgttcatgtgttttgcccttttttaaaaactgggttgtttgttcattttattgttgagttttgaaagtaaaaaaatatattctaattttttttttttttttgaggcggagtccggctctgtcacccaggctggaatgcagtggtgcgatctcggctcactgcaagctccgcctcccggggtcacaccattctcctgcctcagcctcccaagtagctgggactacaggcgcccaccaacacgcccgactaattttttgtatttttttttaatttttattttttttattatactttaagttttagggtacatgtgcacattgtgcaggttagttacatatgtatacatgtgccatgctgatgcgctgcacacactaactcgtcatctagcattaggtatatctcccgatgctatccctcccccctcccaccaccccacaacagtccccagagtgtgatattccccttcctgtgtccatgtgatctcattgttcagttcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggagtcgccacactgacttccacaatggttgcactagtttacagtcccaccaacagtgtaaaagtgttcctatttgtccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagcccttttcagatgagtaggttgcaaaaattttctcccattttgtaggttgcctgttcactctgatggtagtttcttttgctgtgcggaagctctttagtttaattagatcccatttgtcaattttgtcttttgttgccattgcttttggtgttttagacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaatcctagaagaaaacctaggcattaccattcaggacataggcatgggcaaggacttcatgtatttttttttagtagagacggggtttcaccgtgttagccagtatggtctcgatttcctgaccttgtgatccacccacctcggcctcacaaagtgctgggattacaggcatgagccaccgcacccagccctaatatattctaattttttgttgggtatatcttttgcaaatatttccttctagtctgtagattttttaaaattctttttgtatttatttgtttatttatttatttatttatttgagactgagtcttgctctgttgcccaggctggagtgcactggcacgatctcagctcactgcaacttccacctcctggattcaagtgattcatgtgcctcagcctcctgagtagctgggactacaggcacatgccaccatgcctggctaatttttgtatttttagtagagatgaggtctcaccatgctggccaggctggtctcgaactcttgacctcaaattctccacctgccttggcctaccaaagtgctaggattacagcatgagccaccacacttggcctaaaaattctttttatatgggctttcacagaacaaaagcttttaattttgttaaagtctagtttattatttaatttttttaatgagtcatgctttcgatgttcaagtttaagaactctttgcttagccctagatcccaaagattttctcctatattttttctaaatattccatagctttgtactttacatttaagtctgtggtccattttgagtcaatttttgcataagatgtgtgaggtgtaggttgaggttctctctctttctttctttctttctttctttctttctttctttctttctttctttctttctttctttctttttctttttctttcttttttttggtctattgatgtccagttgcttcagtattaattgttgaaaaggttatacttgctttattgagttgattttgtacctttgtcaaaaatcagttgagcaaatttttatgtgtctatttctgaattttccatcttttccaatcatctatgtatctatccctctgccaataccacactattttgattgctgtaactttacataaagccttaatattgggtagagagattcctctaaccttattcttcttttcaaaaattggttcagttattctaggacttgtgcatttccataaaaattttagactatgcttgtctgtttgcatataaccttgatggaatattgataggaattggattatatctgtatatcaatttgaagagagctgacgtctttactatgttgaatcttccaatccgtgaacacagtgtgcttctccattttttaaggttttctttgatttgtttcattagcattttgtgatacacatgctttgttaagtgtatacctaagtatttcattttcattggagcaattgtaaatagcattgtgcttttgatttcagtttctgcgtgttcatttttaggacatagaaatgtgattgctttttgtgtgttgattttgtattctgaactcatttataagttctggtagatttttttcttgaagattccttgaggttttctatctggactactgcataatctgcaatgccttaaaaaatttttttttgcctttttggggtgcctctaacttccagtaccacgttgaatcatactggtgagagtggacatccttgccttgttcctgatcttagctggaaaacattcaatctttcaccattacagttgatgttagctgtaggtttcttgatgatgccacttaccatgttgctaaaaatcccctctattcttaacttgcccagagattgtatcgtgaagggatatgaatttttgtcaaatgccttttttggatcagttgatataatttttcttctttatcttgttgatattgtgggttatactgatagattttcaaaggtttagccagctttgcatatttggaatagatcccacttggtcatggtatataattatttttatatattgtttcatttagtttgctcatatattgttgaggatttttgtatttaatttcaggagagatattggtctgtaatttctttctttttttttttttactgtctctgatttcagtatcaggatgacactggccttataaaatgtgtaggaaagtgttcctcttttctggaagagattctataaaattggtgttaattcttccttggcagcaaactccagtgaaatcatgtgggcctggagattattttgtgaaggcttttaaattagtagttcaatttctttaatagctatagggctattcagattgtctatttcctcttgatggagctttggtaaattatgggttttgaggagttgtctatttcttctaacttgttgaatttgtgaacataaagttattcataatattctcttattgtctttttaattgctgcagaataagtagtgatattctctgtttcatttatgatattgatgactgacttgtgcttttctctttttacttttatcagtcttgctataggtttatcaattttattgacttaaaaaatcatatttgctccattgatttttctctattgtcttcttatttttaatttcattgagttcttttatgatcttgcttatttttttattctgcctgctttggatttatcttggggttttttttaggctcttgaggtgggagctgagattattgttttgagatatttcctctttttaaatgtatgcatttagtgctataatctttcttctcagcactgttttagttgtatctcccaaatttttaaaattaaatttaatttgattaaaatagttttatttaattcaatgttttaaattttttttgttaaaatgtcttctttgattcatgggttatgcggaagtgtgttgtttagaacttttctatggtctttctgtaattgatttctagtttgatttcataataatcagagaaaaccatcttataaattcagttcctttaaatgaggtttgttttatggcccagtgtatggtctatgttggtgaatattccatgggtgcttcaaaaatatatatattctgctattgttgagtggagtgctctatatcaactaaagtctgttgattgtgttgttcagaacttctatatacctgctgattttctgtttagtagctttatcacttgttgagacaggggtgttaaaattcccaactataattatggatttactatttttcctttcagctccatcagttttgcttcatgtattttgaggctctgttgtttgatatgtatgcatttaggatcaccatgtcttcctggtgaagcaatgcatttattattatgtagtgtcctttcttgagtccagtaattttccttgctctgtactctagtgaatattattatagccatttttactttccttaaacttactgcttgcatggtataatttttccattcttctactttcaacctacctatatgatgatattcaaagtacattcttttgtgaacagcaacatatgggttacttgagcgtactttaatattccatcttgatttatttatggggttttgagtttctctttgcatggttttcctagtggttggacttggtattacaatatgaaaatgtgactactgttgtcagcattttatcagtttgagtgaggtatggaaacctcacttccattttggtcctttgactttcctcaccttttagattttttttgaagggatcttgttctgtcatccagactgcagagcagtggagtgcagtggtatgatcatagctcacagcaacctcaaactcctgggctcaagtaatcctcctgtctcggtttcccaagtagctgggactataggtgtgcaccaccacgcccagttatttttaaaaaaattttttgatagagatagggtctcactttgctgcccaggctggtcttgaactcctggcttcaagcaatcttcctgctttgacctcccaaatttctaggattacagacatgagctgccatatccagccacttttaaattttgttgttttaaatatcagatgatgttgcaatttttgtctcaatcatcaaatatgatttataaagctcatgaggaaaaggatcatctattttatgtacccatatttttgttctttcctttgctcgttttttctttctcattctccaagattctttaaaaaaattatttctgtttgaagtaattcctttagctaatcttttaaagataggtctgccagtgacaaggtatcttaattttccttcatcagagaatgttttcatttccattttattcctgtaagatagctttgctggatatagaattcatggttaacaattcttttctgtcagcttttgaaaaatattatgacagcttcttctggcctccttagttctggatgagaaatctgtcatttaagttgttgctcttctataagcaatgtttgtttctttctgtctactttcaaaattttttgtcttttagttttcaaaagttcaattatgatgtgccttgccacagatttctttggcttttatccttcctggaatttgtttagctttttgaatctctaggtttgtgtcttttgtcaaatttgggaagcttttagcctttatttatttattttttaatatacattcagccccactgtctttctcctctcttttaaggctatggtaatatgaatgttggatattttgttattgtcccacaggtcctagtggctgtcttcatttttcttttcaatgcattttctctattgtttagattgggtgaattctattattttatcattatgtttacctgttctatcttctgtcatctctactctactattaagtccatccagctcgtcttaaaaatttggttttgtattctttcattctataatttccacttggttcctttttttttttttcaatacagagtctcgttctgtcgcccaggctggagtacagtggcgcgatcttggctcacagcaacctccgtctcccgggttcaagggattctcatacctcagcctcctgagtatctggcactcaacaccatgtctggctaatttttgtatttttagtagaaacggggtttcatcatgttggccaggctggtctcaaactcctggattcagatgatccgtcttcctttcctcccaaagtgctgggattacaggcatgagccaccaagcctggccccattttttttccaaataatttcaaaaattttaagttcaggatttgcagatttgttacctaggtaaatgtgtgccatggtggtttgctgcacctatgaacccatcaccttgattctttcttaacaatgtttatttcttttctgagattctattttttgcatttcaagataatttgtaattgcttgcaggattatttatatgatgattgctttaatatcattgtcagataattccagtgtctaattcatctcagttttagcatcagttgattatcttttcttactcaagttgtgattttgttgcttctaaatatgacaggtaatttaaaaaattgtatcctggacattttgtcaattaggagattctgggtcttttttaaatcttttattttagcagtcagtcattctgtttaggcttagcacacaggtcttggtccatttttgtgggctgtgcttccaaatacaacttaatttttatagtctttgtgatgttatttcatcttgcttggtttatctggtacccctgaggcttccacctgtctctgctggtgcttcttgggtggggagcagaaggcatctccttaggccaggcctccagctgtctctcagagggggatggatgtgggggcatcaccctaccaatgcctcttgacttccgctagtctctggacaggaaaggaaaatcttgggctagttttcgtagacttggccacctgctgctggagagtccctttttcttgtttcccctgcctaccttggtgtctctgggtgagggaagagaatctcagtactgcagggacaaaaagacttcctggatcaggccacttgctattactggctccctttttcctcttatgcctgcctgccttggtttttctgaatgggcgaggaaaaccttgggttggcaaaaacaatagtcttcccagactgggttatgttcaaccagtgttttttggtggagaggggagattcaggcctgttagggaaggagagtgcttctcttggttgcttattgttagcaaggtgcccagtcagtcccccttgctggagtatccaacttgcctgaagttgtcagagggactcccatttgatccagaaggggaatgagcctacttggactgacttctgtttctaggttggggattaggaagcatagggcctgggccgcatttttatgctgggtttggtgagggggagaagataactgccactatgttgttcctttactcttggggtcccaaaccagtttgttttattcttagcacctttcatagttctcctttggttgtctcttacaccatttccaggatttatagttgtaccttttggggaggagcagggaaaagtggctctatgccatcttgttcagttgagaagtctgcatttgcttttaacatcagttcttgggcagtaaaagctcttgagtgtgtatgcgtagacagatagggtgcaacaaaatgacagagataatatcactggcattgtaactaccttactcacttacaacattttcttttctgagaaggacaggcattaaattcaatggagataagtgtgccatttaggataaaaaaaatccctaccacatatagggaaaagagaaagattgatgaagcagaagtaaagtgaacctcactcattagaaatgataggtgcacagaaagtctgaattactgaatttaagaaaaacaaaagtatgtacagattaagacaataaggtcaccaataaacaaattaagttataaaagaaatttatattcagtatcagcctacattatacaaaatgatcttgaatgttcaagatcattttcaatgccaacccattgcaattaatttctagacttaaggtttataggaatctttaattccaatggatcctgattctaaaaagctactgattgtttgattgaattgtctttatctaggatatgaatgattattcaaggcatatatcatatcagggaatgtccataatttgggatccccactgagttttgattcctgggccagcaaagtcgccttgatgttttagtttagcattgcaatgctgtcctctaaagtttgtttcactgttttggatgattgctgtttcttgcagtgttcagcacttgcagaacttggcatttagtatctaactttgtttctccttggtaccttcagaaagagtctctttctttctttgtttctcctcagattggggtgtttccatataaattgagggcatacatttatgaggaatttgagggcatacattatgagaaattgaggcatttctacatactgtctaatttcttctctaaatctttcatctgtggaaatctcatttcaacactgcacttctctgggcctcatctgtaaatgaaaggattgaatataatctccaagtcctggctctaaaattctgggattttaatgaatgaagactttagtctttattaatacagactttagaggaaaaatttgatacagcagtccctctggaagaaaccttgcatctgaaagatttaatggaaggtttgctgaaatatacaaacccaggctttaggttaaaacggagcaatgtaacatgcattatttctcgagatctctggtacttaaaatgccacctgcttggcaatttagctcaactcatttgtttttatctttctaaatcttatattccttcttgagatgcttactggaagtgttaataacaattgctacatctatggctcagccctctctgataaaaataccatgtctaactcccattccccgtcttctaaaagagttttccactacttatggattactccaatagtgctctttgaatgctgcatcaaagaagataacttagacttttatggtatttagtgttttattgttttcctaaaaagtgaatgcagttcaatcattaatcttttgtaaaggagagggaattgtgaactcttctctcaacaattagtgcattcatagagtgatttcaggctctaggatgccacactcctcaaatgtgctagaagtgacactttcacggaggtttgctaagccagttggctggtgtaaacccacctacaaaattggaaatgaagatcctgacaattctcctttcacgtggagttatggacaaatttgaaagcataaagcttaaaatactcacttggctgctgaaatataccagtttcttgataaggcctaacataatgtgcatctgtggtaattggaaaaatgtcataaaattaagtgaaaaagtactttttatatagctttgtcttttccccttaaaaatgtgtgtacttttatcaactcatctatacagtcaattggaagattgtcattcattctacttgctaatgaccacaaaatcctgaagaacatcctacacacacctcaaaatttctggatatgcaaattataagtaattttaatgctcaagacagtgaaacaaatcagtagattgtctactaccacaattattcctacatcataggtaatatgcttctcagatggataaattcaaaatactaatttccctaaggtaaatatggatgtttgggtgatttcaattggagaaagatcatgactcagtcttgaattttactatgtaccattttcacttggatattcactatcatcctaaattccacttatccacgtctgaactgggtgtttttcttctgagtgaggctgccttcccaatttttctgtttttatgaatattatcactattctccgagttgcccagaagcaaactttgagttctctgagatttctgtcttctttatctcttaaatctctttgttatcatacactgtcaattcttactttccagtagatatagggataggaatcttcacactgctctcacatcattccaagccttattcagttattctattagcttacaaatagatactaaacatctaccatgtgccaggcactgggatagacactaaagatacaatggtgggcaacaaaagatgaggactctgtccatgtggtctagcgaggaagacagacattaaaaatcacatgcaaacaaaggtaaatctccaattatgacgcattaaatgaagaagaggtatgaggcgtcataagagtctaaaatagattggtgtgagctagtcatggaagtcagggaaggtaggtttccctgaagaggtgatgcatgagctgagaactgaagaattggcagaagttaatcagatgaggaaggatgggaagtacattctaagtagaggttacagcaaatgcaatggtcttgtagtgggaaagagcatgccaagtattagagaactaaaaagaggaagactaaaaaaaaacagaggggacttagcacaaattgagactgaagagctagagagggaccaaatcatgcatagctttatatgctttattaagaaaaaattttctttttatcctatgagcaatagaaagcaactaaagagagctcagtgtgtgtgtgtgtgtgtgtgtgtgtgtgtgtgtgtgtgtgtgagagagagagaggaaggggatcagattggcacttaaaaagatcattttggttgtattatggaacagattagagggggtccaagagtagtggcagactagttcagttgggaggctactgcagtagtccaagtgaaagatgatggtgactggttagggtggtaagtgatggagatagagataaactggggtgagccaagagatatttaggagctacgatcaataggacaagattatggattggctatggcaggtgagagagagaatgaaggagacagagggagagacagagagttggagcttgcataatttaatgtatgatagtgtagggccagtcactaaaggaataccagaagaggacccagtttggagagaagctaatgagttcaagttggagaatgttgagcttgaggtgttaatgagatatccaagaaacgatatcaagtaaacaattggttatataaatgtggagctcaaaatagagcaaaatagagatctggtcaagagatataactttgagatttgtctgggtataggtgtaaattgaaatcctaggtgtagagaaactatacagccaaatgtgaagaggtcctgggacaaagcgttggtcaggtaaaataggatgagtctaaaaatgagtggacagagaagtaggagaaaacgcaggagtgtgatgtgtaatggaaagcaatgaaaagagtattttaaactcattacttctactaaataaatgttaatttgggagttccagattaaaacattttcaatctggtgtttaaatgactgatagaagtttgaccaagtgaaagccaactgttttttgagcacttactctgtataagaagctatgctaagtgttttatgcacattaactcaatctcataacgattttataggataggtgttattataatcctcatattatagaggaggaaactgaagcacggagaggttaagcaactagtccaaggttatgtaatgggtgtgaaagtgatggagccagcatttaaaactaatccatttgaatctaaggttgattttttctttttggaatattttaaactacacaattcaatttctttaatagatataggactattcaagttatctgtttcttcttaactgagttcttatagctgtatttttcaaggaattggatcctttcccaaagctaatcttcttaatcaatgcactactgtggcatgcatccctctttcaggaatgtttatatattttatgaagatactacgaaatggatatcttcctaccagttacttaaccagagtgttatgagtaccatatagaggtcttagagagtagaaaattatcttaaggaaaatcaagtgatcaagtgatttgattatatctatgatactttcttacaaaatgaaaagaaattatagagctctttctagttgtctctaatttccaaagctgaatccaaaataacacattctttctgatttttttagttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacaggtactgctccataatgcatgtggtgtagccccaacagaattcatgcactatgggtcatgtgttctccaaagtggcccgttcttggaaggcagaaaagaatgaagaagggtgcaggtgtttcttgtctccttcagacagtgggtacagtgagtaccttgtccaaatacaaaattctctagccatctttcttgtctttgccttattgaaatataatgtaaatgtatgttttcactcagcatgacaatttctaagcctactttccacctgttttgttcttgactgtctgactctgattctgccaatgtgcacatggactaggaacctcatcccttcccagtaagagaatcatacggccttaggtctgagcatgctgaccacacaccagaaaacaccagaaaaaaacaccagaatatatcttatcttgccttttggattccttttatgcaggtctcagccttctccaatccctacctgcagctgactaggagtgcttgtccaaggccagggaatatttggcttccatattgttcaaatttggaatattcctgcaacttttaacattctacaatagaaatttgataggatacacaagagcaaaagggaaaaaaggagagaaaaacccaaagcagaaaacaaggcacaggaagaaaaaaacagttactttctcagagaaaatgatcttctgagataatgttcagtttggccattgagtggactgaaagtctgttggccaatgagagtggagaattggtgggatttgtggagtgtctgtcaactagaaatcaaggaagtgcccaaataaagcaaaactgggatggtaacgtcctgttctgctttttgatatggagccgaaagtgttggttcttgaccttggagttaaattaagctaagtttaggcatgagacgttattatttggtttactttaaaacagagaacacttttcaccaaatttacagaagtcaaatttcttgaactaaatgaataaaattaacctccttatttttaattacagtttccttctacaatgttgaaatgagcttctctgtctttgttgaagagccaaggatccctattaccagtgttataaatgaatttacggaaaattcggtaaaataatcttttgcatatttatggcatatataaatatatgtgaatatatacatttatatatatgacagaatatattaaaactaggctttacttttttctaccaataataaatttcacagctaagtagtttttttttttttgctgcaaatctgtctactctgtaagcaacatcatgagaatgtatgcaatctctctttcatagtgccaatgttgaaagcttttatggaacgttattattttcatttgttgagatctgtacatttccctttagagacacaaattctgagtctttgccaaattttcctatttgggaaaagtgggagagcagtgataacaaaatgtatacttaaatacaatggtatttaagtattattgttttctgcattttatttctttttccaacacaatgaatgttttacttatccttaattttttcttgatatgactaatacatactctctgtaacaaaatcagacattgacatcaaaaacccagaaagtaaatgtcctctctctaatactgctctgtgcattaactcctcttaatagtttaaggtacattcttttagatattttttctgtgcatattataacattgatgcatgtgtgttcttttacaaaataattgtagttgtactagttatgctatttttcaacttgctccccctcctctgcacttaaccatgtatctttgcacatattcatgctggtaaatataaatcatacactttaacagatgcatagggtttcactacatggttgtagtatagttttttttttaaatcctttggtggacatttaagttgtttctatcttcttctctatttagaaacaatgctgggctgggcactgtggctcatgcctgtaatcctagcactttgagaggttgaggcaaaaggattgcgtgagccaaggagtttgagactagcctgggcaacatggcgagatcttgttttctttaaaaaaaaaaaaagtttaagaaagaaacaatgctgaaaacaattccctagaagtaaattttaaggcacttaagtatttttataggataaattcctagaattggaatcagtagatgaaaagatgtgaacctttcacatttaaatagctgtcactaaatggcctcccagataggtgacaccaacttgcaccatctcccaacagcaaataatcatatctgtttcccttctttccctgtcagcacttattttcaagtgtctatggcttggttataaatccttgaaaatgggtgggtgtattagtctactcaggctaccataacaaaatgccacagactggatggcttaaacaacagatgtttattttctcacagttctggaatctggaagtctaagattaaagtgctggcagagttggtttctggtgaggcctctctccttggtttgcagatggccatcttcttaactgtgtcctcacatggactttcctctgtgcatacgcatccctggtctctctttttcttcttataaggacactggtcctgttggagtagggctccacttttatgatcttatttaaccttacatccccaaaggccttatctctgaatataaccacattcggggttagggcttcaacatttgagttttggaaagacacaattcagcccataatagcaggtaaaacgtaaatggaaaaacttaatggagcagatggaaatgttgagccagctgaaataatgagtgcagcttaatgatcacaccatcccaagtgattttgctgagttaaactagaggagcagaatactaaaactgatttttttttgtcttgtacagttgaattctatatttcagaacagtgaattttctcttgctactctggaaacccaaattaaaagcaggtatgtgaatgacatttactgtgggtcaaagggcaatttgagggcattttgggtctgttcctatctggaggggatgtcctatgtttatgtctgagatttagggctgccacatttttagttgcatcttccttcctgagtaggttctttttggcatgaggaaaaaaattgtattactattgtagggcacaaagccaatgggagaacaaaacaaaagaaaatcaataggggaagtcatgcagttagactgagttacctctaatgcccttttcatctctaagtttctatgaatctgtgatttatacaaaaatcatgctttgaagtgctatgtatggacaatgcacgaggatttataaggccttttattttggaatgattcactttcagaaaagagaaattccaaagtgaacttgaaatgtctaaagcaagaatgttgactaatccaagatttgcttggggcacaaatttcgaaaggtgattgcagtgaaatgggcaggcactgagtagtatcatggaaactatggcaaaggcaattgctcacctgagaagtatttcctgtattctttcgctgcacatatactagtcctctgtaaagggacaccccgcagaagctctttgaaaaataggcatggctctgttaagccatggcaaactgatttttaaaacataaaatgctactgcctgtcttctgtacactgggactttggtttctcttacatatccaagtattaattattaatcaagtattaattcatatacatattaataggttcaagaaaattcatataaatgaatggaggtaaatgtacggtaggttattgtcttagtcagttttgagttactataacaaaaatgctatagactaggtggcttaagccacagaaatttattgctcacagttccggaggctgggaagtccaagatcaaggtgttggcaggttcagtgtctggtgatggccctcttcttgctgtgccctcaagtggcagaaagcagagagacagaaagctctcctgtctcttcttataagggtactgtttcaaaaaaattcaaactgttttttttcctctgttgtcataccaacacaacaatcaatatagaagacttctacgaccaaacgtgtggggattttcccccaacacaccaagcagctgacaccagctggttgttctctacttcaattctattctggtgttatcctctcaaaaatagcttcagatctcacaggtccccaagactgcccctcaccccagacactagtcaaaagtccaggcctccagaacttctgactaactgacttcaacttggggttcccgtgacccactctttgagcttgattaatttgctagagcagctcaaagaactcaggtaaatacttatgtgcattggtttattataaaggatactgcagaagatacgaatgaagagatgtgtaaggcgaggtaagggacaaggggaatggagcttctatgatctccctgggtgcaccaccctccaggaacctccatgtattcagctcttgggaagctctccaaacccagtcttcttgggattttatggaaacatcattatgtcagcattcctttcccaagtctcatatgaggcaagactctttctggagagggtcttaagactcacaatcagaaaggtgaagaaagattagagttccgccttggggcaggtgaaaggagggtgggagaagatcagagagattctgtttgctgaagccagcttctgaggcctagcacacctaacattataacaaaagactgtaacaagggctatgggagttatgagccaagaactgtggatgaaaacatatgtgtacacacacacacacacacacacacacacacagagacacatataacacatcaggcaccgattccattcatgagagttccaccttcatgatctaattacccctcaaaggccccgcctcctaatataatcacactggggattggacttcaacgttgaattttgggaggacacaaacattcacaacatttaactcactaaaccaaaactagagatgtctgggggtataaaacattctttttaaaaactgtgtctattatttttccttattacaaaagtaatatgtgaccactgtaaaatcttagagctttacagaaatatatatatatataacatggacggtaaaaatctctgaatacttgccttcccccaccccttcaagaactcctgttaacagcttattttattgatttttctagatttgttttcacacatttactaagagaataagattctcctctacatactgtttgacaactttcttttcatgctttgtaatacatcatgtatgccttttcaggccaatacatgcagatatagctcatttgttttaataattgtacaggattcttttatatgatatgccatgatgttttcctccaattatctagtgatggacacttgagtaatttccacttgtatgtctatttttatgcacttttgctggtaccattatggaatagattccaggatgcaaggttaataaatcaaaggcttgccaccattttggtatgcatataataagcaagcccattggaagcattcctctggagccctagcattatttgaattccaggctgggagaagtctactgttctgcctcagagttgcctttctcctgatctcatgccctgtatacttggtactatatttcattttcctataattttgtaatgcttttgatacagggacatttcagaggaagagatggtcatggatcgagctattgtaagtaatttttcaaaatgaatctacttgtgacctatcctatgcctgattagatgtaagtcaatagctcttccacccaagtatatattatcaggcgaggctttgttgtggcaattgggggtcaaattacattacttcctttgggattggtacaaaaagccatcaagaaaaccatcccctgcttttttgaactatccatgtggcagctttttgaggcacattttctggtctacagggattgtaaatggtaagtgaatttcttcgttatagatgtcttgcaaaaaaaacctagctcttccaagagtgacacaattgtttgcaagactggcattcacacaataaatccaccctctatttgtccagatttgaagccagagtgtgataaaactatctcccatcatccttgccccaattctcagttcttgttccattgcctcaaagctttacaatagcacactctaaaatgagtagcaagcacacagctttccaggtatttaagtgtgaggtaagtatttgatgatacagaatacaatcaagcccacagtacaggggccagaagcagtgactcacacctgtaatcccagagatttgggaggctgaggtgggaggattgcttgaggccaggagttcaagaccagtctgagcaacatggggagaccccatctctacaaaaaataatttaaaaatattagccaggcacggtggtgcattcctgtagtcccagctactgaggaggctgaggcggggggatcacatgagcccagatttcaaggctgcactacactatgattgcaccactgcactccagcctaggtgatagagcaaggctctgtctcaaaaaacaaacaaacaaaaacctatagtgcatagtgcattccaaattatccactatcattaaaaatattttctgtaaatagctgagtcagaaattttgatatatacacattatagcatgatataactaaaattcctttcagtaacaggtgtaaaatccttttggtgataatatggtcaagctgcctgggttggaacccctgcttttccacttcctgactatgagaccttgggcaacttaattaacttctctgtgctggagtttcctcatctgtaagatgaggactgttggaaggataaaatgagatcatctatgttaagtgtttaacactgggcttagaacatagtaaatgtttgatagtgtttacaattgtcaattgcatgttaatatctagatccagaaggcttagattctgctcctagttctgtgtcttgtcaactgtgtgatactgggcagaccatttaacttctctgtgactcagattcctcatgtaacaaagagggcgacaatccctgtattgcccaccctacagggttggtgtgaggagtaaatgcattgatgtttttgagggtagtttgcagacggcaatgagttacataaatgtgaagcataattatataattgttgttaacaataagccctgtactcagttatgacatttgtttaaagatttcagtgactatgtacttttcttttgcattagttggaacagagagaaggacaagaaatggctacaatttcctatgtaccatacaggtaggaagtaggaactgagtttattaatagctggcacatttagttctgattttccttccatttaattctgcatgtgcggccagttggccagagttgtcagaagaagatcaaagtacccagtgattatttcacatatgctgtaattaggtccttgccttcatgaaatatgttgtttcggttggtcatggcacaggctagcggccagcctgctgcctctttgcagtgaagagaaaaaggggtggtcataatctgggacgggggagtgaagtgtttgttttggtcaaaaaggtccacgaaacacttggcagggaaattggaaacaacaacaacatggaaagtagcttcggttctgttcagactcgtggtccagctcctcctggaatgctggctattgttgatctgttcgacgcacatcaggaagaacatatagtcaaaaaaggcccatgaagaggtctttgaaatggagtagagggtctgtcgcaagcaggaggagaggtttaaaatgaagactcctcttcggactggaaagatgaaagctgagaagagctaggctccaaaggaaggagacaggatgagcagggacttcaccaaatatagatcaagggaggggcagatatcacttagattagacatggagataagttttgagcaagtacaggtatgtctaacttgcaacaactggcaggaaacttagcaaatatcttcttcaaaaagccgtgtctacaaatggaaatggaaaaaagatataggtaagtttttgtatctgaaatgtgcttcctaatggaatattagaggaattcagaatatttgaggatcttgctgtagaggatagaggatgaagtcaaggacagctctatcctttcatcagtgatcttttagtggacataaatactgagtgagtttttgtgaccatgggaaacattatttccctgaggctgagttccatcatctgtgttatgggaataataatagcattacctcatacggtcgttgtgagaataaagtgaatcagaacatgtggaggaagggtttcacaaatgttagctactatcattatcattatcatcattattacttattatagaaatgagccttcttcagaacacttctttatagactaactgagcatcatatgcctatttgcctgatttcagtaatgatgggtaaattggagaccagaagaataaaaggttctctctgaaataataaatcctgaaaactccatcttctctattaattattacaaactcttagagaaatctcaaggctagcaatttcaacacaatgcatacgttactgaccattcttttgaaaataggttttgcattgtctgttttggataagagaaaatttatcagaacatttcagtatgctgtcttccatcacttcttaagattggctgcttaatagctgtaaaatgtttgacatttatgaactaccaattaaatcagctgtacagaatttctgcattgcaggccaagttgcactcccttgacataactgcaacaatctttcttttttattctgctttgtagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactaggtaatttttttggggggtggatattgcagtatgaacttacttcctttattataaaactcataatgcatacttggttaaggattctgagttcagaaaggagagaagtcatctttctgttttttttttcatattcttggtacccacttgatctgatgacctttctacctttaagaacttatggaagaacagaatgctggaggagttaccagagactgctggtcagctctggatattagcaatggccaatccgtcaatggaatgggaggattttctctcttgcataaatacacagagacctgaagagcttcctcattaacacacaataaatgcctaatagatacttgctaatttattgattgattcagccatcttattcatcttggcaagtgatcagggaactgtcccagatttctctcatgggggcattctctgattagcaaagctttactggtaaaagtgcaaggctaccaggccactccacctccttcccagtgcagctttgttccttttccccaatagactgctgtagaaatcattgagctcacacagctctaatgccagataacacacacaggcattagaacgcacaatccttggcaacagactaattaagtataagagggcagcctgtgacggtgcaggggtgtgagtgaaatggggggcagaaacgtgttgaagccacaggtagagcccaacatgtaaatgacactaatgaatgtgtcctaagaatgagaggaaggcacctttcaccctcactcagaatggagactgggatagctgagcaaagctggctgggccacttctcacagcattctctcaacacctgagggaaatatttccagaatcagggtcatgaaacccagtaagtgctcagaaaaaaatgggaacttatcatatagacttagcccatgtcacatctcccttcgtgtgacagcaaaaccttgccttaacagccctatgtggaagtttgccctgtccctcagcaacatcaaaaacagagccctagactgtgtgcagtggcttacacctataatcccagaactttgggagggtgaggcaggaggatcacttaaggtcaagagtttgagaccagcctgggcaacaaagcaagacgctgtctctacaaaaaataaaaaattagctggacatggtgatgcatgcctgtagtgccagcttttcaagaggctgaggcagggggatcacttgaggccaggaggttgaggctgcagtgagccatgatcacaccattgcgctccagactgggtgacagagtaagacctcatataacaaacaaacaaacaaaacagagctcccctgtctatactgatcatgtcagatacactgaatttactaaaatgaaatccatcccagagtccattaagaagggggccattccagagagagaagttcgtctatagtctcctgtctttggatataaaactgctaacagtgggtatctcagaagctgggcaattggtaggtgggaacttttgacttttgactctacactccaccacgtggcttgaaatttttcaattcttatgtattgttttaaaaacaagacagaacaatgtcaggtgaggtggctaatgcttatagtcccagatctttgggtggctgaggtgggaggattgcttgaggccaggagtttgagaccagcctctataacatagcaagacgctgtctgtacaaaattttagaaaaacctatctcatcaattcgttgttttaatgaaaaggactaaatatgtggttatactgggtggtttattatttaaaaaaaaaacactccatataatgatattttcaataaggcctggtccaaatggctaggtagaaaaagttttcttttttatttgctgatctttacgtgcagcataataatgacgttcataataatatataatattatattattatatagtaataataataatggatgtttgtaatacttttaagtgcctcttgtcctttaaaatgtgcatacattttctctgtagagcctggaaattgcaaagctgatgaaacagcctctaaatacaaagggacctataagtggctattaaccaaccctacggagacagcccaaaccagatgcataaaaaatgaggatggaaatgccacaagattctggtatgtacaggccaagttctaattgctgattcagatatacaaagatctacctaattggggacatgtttctatgtcatttgtctgagcatgctcccttcctccacctctagtgccagtctttctttctattacctttcgtacctgtttaaacatacatgcaacataacaagaaaaattttcaaggagacaaaagataaaagttacccatcatcccagaagaaaattcaagaagacaaaagagaaaaaagtcacccataaccccactgcctgaacacagctgtttttaggttggcatatatttttttcatgtaacctttctctgtatgcctttaagttttatgtagcagtaatcactattcttgtatcaataatgtaatttaccatttcattcaatggtttatcaaacattttccatgttttacatttattatcttaatgttcatttcaaaataacgaccttggaaaccatctagttgatgggctatagtaatttactaaatcacttttctattgttgactttatcattttcctttttaaaataatcagccctcttttctcactctctgctgttcatggtttatgccattaacttaagtgggcaaaaccagaggggcagcaggttttgacagaggcttaaaagcactcttttagaaagcaacattaggggctttccttttcctccctgtgtctaatcagttggcaagtcctgcagctttgatggtcatagtcagagcccacatctagcctttcctttccaaccccactgccactaccctggtgcaagcccttattgcccactattagagcggtctccttgccatctaacttaacagtatcccttacccgcctccgccaactatattctacactgctgccagcatgattttcctgaagtatggctgctatcatgccactgtcgtgctccagctccacattgcctcaagaattaagtccaaacccctaaatatagtccagaccgtaggcttcctctcctgctgtctcactcagcattctccctccctttatcatacgctccagtcaaaatgaccatttgctgttctgggctcaatggacgcttcctggtgtctctttctctgcctgtgctgtttgctcttcttggggttgggggaagagatttttctctacctctgtcctttcagcacacagctcagctcaaatgctgaaagtaacgtctctttccttggtagtttgatagattcagttttgtttatacagcttttcatcttatatttgccctaagtttcgagtagttacacttagaattttaaaccccctaattacaagttccttgagggagggatgaagccccaccctgtttgtgtgtgctacctattaccattcctagaatggagtgggtgctcaataaatgtgttagctgacttgaaatgaactggcttgaattgggtgaggcacaggggagggtggatgatgagggccgatgggccatcgagggttctatattaattgtcttaagttaatatgctgagatagagaccacattcgaacaggaatttccccttaaaagaggagtaagaagggacagtgagaggaaagagtcatgtctagaggaccagaatctctgtcttgatgcttggtcagtaggacattgccatgccccattcccagctcccttacctgtttatccactccccttcccccttcccacatgttgaccctagattcacttgctccctaagagcaaaatttcttcatttcacaaagaagtactgggctcccacctttgctttctatgccaggaggcttggggcaggcgaggagaaggcatgctaaggctatatccaccatttgctttaagactatctttgcctcatcctctgatgagaaagctctttcctctctttttcagttcaatcagcatcaacacgggcaaatctcagtgggaaaagccaaagtttaaacaatgcaaattgcttcaagaacttcctgacaagattgtggatcttgctaatattaccataagtgatggtaagattgttttgtacatataagacaaattatggaacttcaattactttgcctacttgaccccaaaccagagagagtataggcaaaccccacttaggaaaatctaccttacgacaatccaatttcagaacaaaggtaattaatgttggtggaggtggtggtgggacatgagatgttaggactatcagtgtttcagtgatttttgtttgtttttgctacatatatatatttgagatggagtttcgctcttgttgcccaggctggagtgcaacggcgcaatcttggctcactgcaacctctgcctcctaggttcaagcaattctcctgcctcagcctcccgagtagctgggattacaggcgcccaccaccatgcccggatgattttttctacttttagcagaggcggggtttcaccatgttggccaggctggtctcaaactcctaacctcaagtgatccacctgcctcagcctcccaaagtactgggattacaggtgtgagccaccgcgcctggccttattttactttttcggctaattattgtttttatttttttttaatttttaaaaagttttaataggtaatacttcactgacttcaatactcaaaaaacaaaaagagtatgtgtaaaacatctccctcccactgctgacctcagccattcagttactatccacagagatattttatggatccataatgaaatgtgtatacatatttgtgtatgtgtatattgtatacacacatatacttgccctcactttttgtacacaaagtggagcatactatacacactattctttacgttgcttttttctcttaacaatatattgcagagattattatatcagcctataaagaattttctctttcttttttccccttctgcattgtattatatataccacaataaatgtgccacaatttatttaacctgtttcttatggatgagtatttaggttgtcagtaacatttttctttgaaaacaagactgtacaactatttttgtgtttttttcattgtagggaaaatactataacatatttttaaaaatactcacatgtttgatagtgtataagatgttttagagttggtattgtctaagcagctgatatagaaggttgcatttctttcaaaaatacatttgtagaccacattagcttttatttttgtttgtgacactgttagcataattcatattattaggcaaaagagattcaaaataaagagtatctcttttaaaaaaccactgcttcgatgaatattacatatatgtcagaattttgagaaagtaggggtatacctaaagcataaatccttgaatgtagaatttctgggtcaatcatacttttgatggtgtcaaaatgctctctgtaatagttacagcaatttagattcccacttgcaaattatgaaaagcacctttttcgcaactccttcatcaacacagcatgtttgttatcagacttctggatctttttgcgatgtgataagcagaaattgatatctcaatgtagtttacaaactttttaatggagatatttacatatcataaaattcgctcatttaatgtgtacaatttagtgggtttttaaaagcatattcactagattgtgcaaccatcatcactaattccagaatatttcatcaccccaaaaagaaaccctgtacccattagcagtctctccattcctcccccaccccagctcctggcaaccactaatctacttttttgtctctatgaattttgccaatttggggcatttcatgtttctgaggttcatccaatgttgtagcatgtatcattgcttcattcctttttatggatgcattatattccattatatagatataccacattttgcttattaattcatcatttgacagatatttcttttccatcttttggttattattaaaaatctagctgtgcacatttatgtacagattttatgtagacatatgttttcaattttctcgggtatacactgaagagtagaattgctaggtcatatagtaaccctatgattagctttttgaggaacttcaaaactgttttccacagcagttgtgccattctacatccctgccaactctgtatgaaggttccaatttcttcacatccttgtaaacacttattactattgtctgtcttttagattatggctggtagtaatgccccccaacacacctttattcctaattttagtaatttgtgtcttcacttttttttatctttgtcagtctagccaaaagtttttaaattttgttaatgtttatagactttattttttagagcagttttagattcacagcaaaattgagtggaaagtacagagcttcagcatgtgccctcccccaaccacctgcagacttccccaccatcaacatcccccaccagagtggtatgtttgttacaattgaatgtacactgacacatcgttatcaccaatagttcatagttttacattagcgttcactcttgctattgtacattctgtgggtttggacaaatgtataatgacacgaatccgccattacagtatcatatgggatattttcactgctctaaaagtcctctatgctccacttattcatccctccttcctctcaacccctggcaatcactgatctttttactatctctgtgtttttgctctttccagaaggccatatagttggaatcttacaatatgcagccttctcagattgtcttctttcacttagttatgtgcatttaaatttcttccatgtgtcttttcatggcttggcagctcatttctttttggcactggataatattccattgtctggatgtaccacagtttatttattcattcacctactgaaggacatcttggttgcttccaagctctaactacgaatacagctactataaacatctgtgtgcaggtttttgtatagatgttaagtgttcaactcatttgggtaaagaacaaaaggtgtggttgttggattgtgtgataagagtatgtttagttttgtaagaagctgacaaattgccttccaaagtggctgtaccattttgcattcctatcagcaatgagagttcctgttgtttcacattctttccagcatttagtgttgtcagtgttttagattttggctattctaataggtgtgtagtggtatctcattgttgttttaatttgcaattccttaatgacatatgatgatgaatagcttttcatatgcatattttccatatttatgtctcctttggtgaggtgtattctataggctgaatgtttgtgtgccccaaaaattcatacgttgaaattctaagcccagtgtgatggtatttggagatgaggcctttgggaggggattaggtcatgagggtggaaccttcatgaatgagattagcacccttataaaagaggcctcagagagcttctttgcccctttcaccatgtgaggttatagtgaaaaaatggcggtctatgagccaggaaatgagttctcaccagacattgaatctgttcttcatagacaacttgccagacatggttctactgcataaaatgggtccctcccatagtgaaatgtcagaaattgaggcacaggcattccagtgcctcgcagaagggccagggaattggccttgaagcagtgaacttctcagacctgttttccttgcagatgatgcaagtttgagatccttgctgaggactatctagaagaattaggaaagcaagcacagttctgattatttctagatcagaaaccaagagtgagggcaataggaaatgttacagcttgaagtgagtgggcggaaagttagagggtttgtgtttcacactgacctccgtccttctgagtgacacattttctttagacatgctaatagaattttctcttgtgcaagaaaaagttaataaacagtcataacaacaacaaaaacactgcactgggttgggatttttagaaaattgactgagaagtcattttatatatataaaaaatctaccgcggagtaaaggaacagttggatgatgattgtaatgtatataactgaaaagtaaactatcaagtttattatctttggaagaatccttctattctacttgtaaattaggggcttaatgaacaatgaatacaatataaaggaaagaaaaatgtattcacgttgaaacaatttattttcttttgctttcaatcttgctgacaagcattagatatcttggttgaagaaaaactcttctgctctctcacttaaatgctcctttttcttaactctttaatatcacagagttagaaaaggtacttttatttcaaagttctttgggttctcttctgtgctcaatgtttgttacctccatgatattaaagatgcatcaggctctagtgaagttgactagaacttttcagaaaactttttcctgtctgtatccattccaccatcagggcaggatagtgagtgcttaagagaaaacagtggtattcccaggaggtcaggtagaaagactgcaaagcacagctgttccaacccccaacacggtggagaaaacggccaaagtcacagatgctgtaaaaagtgatactgaagagctcaagctttggaattagcactgggttagaatatttcaatgttttaacttcttactctatataaaggagataatgtgagtacttttatgactaatacaaaggttattgtgatgaatagatgagaaaatgcacatataatgccttgctgttgtatctacctccaaaatgcccaccgactcattccctctttgtcaattgggaattgaatcagggctggcttgtgactgcttagcccagtagaattagggagaagcggctttgccaatgatgggactaatttttaagaggactggaagtttctgcatcctttctcttggtacactctcatttgagatgcttcctcagagccagacaccatgctgtaagaagcccaaacagtggtgtgctgaaaaatatttaaaaaccagctctacccaaagaaggtgctgatttgtagcttttgccagttttcatgatataataccctctcctccatggctgaatacaaattacaatgtaacgtatagtgactgaactataaacttggtaaaagatgcatgcacagatatattagatatgtaaataatcacaaaagcacagattagtaaaatgtagcaaaataattagaaagtgaagaggtttcagtatcattttaaaatataatttatgcaattgtaagtttatataatttaatttttaataatggccgtgtttaacaactcgttcacagaattcctgaaaatttaacaattggttctcaccagctggtaaaagttggctccagcacatcacaagccagacccagcacactactgagcccacaccactgggggagtccatgtgtagggagtacagccaacagcttcaactgaccagtcagcatcaattgcctgccatgtgagtgagccctcttggacatccagcccagattagccttctgatgtattcagcctcagctgctatctgacttgaagtgtatgagacaatccaagtgagaacactcaactgagcctagttaacacacagaaccatgaaggataataatacattgttgctttaagccagtaagttttagggtgatttgttatgcagcaatagataacctggaacactggctcatagaaattgctcagtaaatagcagatattattattttgaatgttgcaattactggcagattaactgtaacagtatttcaaggaatgaggatcaatttattctgcaacaaataaaggagaagtccctttattacttttgcttgaggaccaggaatttttacacgatgagtgtaatttagcttgaattttccttaaaaactatacaactccagagaaaaagtctataattactttccacaatatagtctcccattggcctgctgtttactttcattctgccacagcagggactacgtgaaagtgaaattgcaccactgaagcccaaagaatcatgactaggcagctcttgttattccattttaaacaaagtctgagcgatttaataagagcagtagaaaggtccgtgaatgagctcactatctttttctatcctgcctagtcttaatattttctcagcttcttttagttaccagaagatagatgttaactgggacaaaatgttaatcgagaaacaactacaaccttgtttaatctcctgtcctcctcccatctcctcagggagaactctgtctttgctagttcagttcctatgtgagccattgttggacaaattggggtaatggttggggaggaattgagaggatctcagttatggttgcttaatttacattgatgagaacagaaagttgtttgcaggaaaaaaaaagagaataaagaaagaaaacaaagaggaaaaggagaaagcaaaaagtagcctgtgtaggcttttgaaggtgttaagttgtggggagcttggggtaggagaaagatttgaggagatgctgataactagggaggtcattgaaagagaggtagtaagagaaatacagacagagagagaggggatgaattttatgctgaattattttgttttctgaaacagagttgactatttgtagtataacctgggttaagtgtgttatgagtgttagctctctctggaatttttcttaacaaatggtattttttattattttcctttatattttggttattggacttgaatgtgagtgctttaagctagcaagacaccacaagaaagctcagctttatatgtgttatattcaactaaaatagaatttgtgctgtattcgtttaacaaagctcttcactttaaaagtgagtcatgattcaaacaaaacaactatttagaagaagcatttatgagataagaacttttgggcactgacaggatatttgatgattttgaatattattgctaatttttaaatttaatttgttattgtggtcgtgacatgtaaaaatcatttattttagagatacatactaaagtatttatggataaaatgatatcatattcaggactcactttgaaataatatggggttggggaaaaggtgagtggaagtgtagagaaaatgcgattatccattcattgacacttgttgaagttgggttattcatgaggaacatggagattcattatacaattctttctacttttgtgtatgcttgcaaatttccataataaaaagtgaagaaaaaagtgggcgagttaatatccattgttcttactctctggaaaatctaaattaactgctttttattatgacgtagtccatatttgctttttttttcctgtggtttgatggttcttgacaggaaaatgtaaccatcacccttaattatgaaaacatagactgagtgtttgctgatatttgagtataaggtgggatctacttaacacaatccaatactcaaaagtctcaatttaattagaatcaaatttcaagataattcttcagggacaaaacgatttccctggtgcatttgaaaaaggatttaatgaatgaaaactttttatgaataaaaacttgacttatgttctactttctgggactacacctattgtagaaacaaagggccaatattttccttctgtaaacacattaccttggtaggtgttctcatctcaccctctttactctttaaagggaaagaagcacaccagaatggcagaagactaagtcatgcagcttttatgtctcaactttctttccccagagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgagtaagtactaatactttggtgaaagacattatttttaaaaaatttaaaatgcagacggccctctgtatctgtgcattctgcatttgtcaattcaaacaaccatagattgaaaatatccttaaaaaaatcttgcgtcgatactgaacaagtacagaattttttctcattattcctaaacaatacagcataacaaggatttacatagcatttacattgtattaggcattataagtaatctagagatgatttaaaatatacattgatgttcataggctatacaaaaatacgaccctattttatatcaggaacttgagcatccgtggatttttgtattcatgggagtcctggaacaagatccctcaaggatacgaacggacgactgtatatattatcaatttcttggcatatagacatcataaattttaaaagtcaggtagttacacattgaaagctcagttagtacaatgcaatggggtcactttactagaatgttcattgtgaaaggatgtattcaaattcgaattgaatcttagtgatagcaagctttcaagtacacagttaccccaaaccaaacccccagtctattcccccaacttttgtgttccctcagtgttcttaatgtctataaaatgtatccaaccagtgctaaagtggaaaactcgagaacagtactagttaactccttctaactcacagccaattaataactaactcttgtatgcggcactgtacatccatttttaaaatcccttaaatattttggtggaattcttttacttctctccatctccaccactaccatcctattcctagccccatttctctcaccagactgtctacaataacctcctaaatggtctctctgcctccgttcttgaccctctatgggtcatcttctacatagcacccggagtaatcttttaatgtatatatcaggtcatgtccttactttgcttttaaaaccactcagtggctttccattacacgtagaataaaatccaaatgtcttataaagtcctacgaggccctgcagggtctggcttacatgtaacaatttcattaattttcacgacaatctttagagatgagtgtaatattacttttgactttcaggtgaggaaactgaagctaagtgagattactttatttgcccacacagttagaaattagagaagctaagatttaggtgtcaacttgtctgattccaaagccagtgctcttatttaataattcctaaatgatataaagatagtgattaaaactcaaagaaaagtcttgcaataaggaaatcttgcaaggaggatgggttttacttttaaaaggtaggatgctcttctccatctgtggtttcttgcagaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgaggtgagtgcagctcagggaactgagagccaatcagccaagcactgtttcaggtcttcattcatttactccttgggagagagagggcactccgttatggttttaaggggaccttatggaaatacagacatcccagggaagattcgtatataatctttagtaggctaacgtcttggttggaatggtgtctgggaattgtgcaatgataccacctttggccctgtgaccccaaattatctcaaatgtcagtttattattggccaccatttaaggaacacattatatgttggacattgtgctactgcctcctttgtacagataaggaaacagagaagtaatttgcccaagaacacatagcctaatgactaagccaggattgaaacctatgtctgtctggctttaaagcctgggccctttccaccatatcataccaccttagcctttggcatgttataggctgccaaccctactcaaaacaatttcagaggttagattttttttacaattaaaaagtaataaaatgtacatataagaaaatgcacaaatcctaagtatacaccctctgaattttgacaaatgcatacatctatgtaatccaaacccctattaagatatagaatgttggccaggtgcagtgccacacctgtaatcccagcactttgggaggtcaaggtgggaggatcacttgaactcaggagtttgagaccagcctgggcaatatagtgaaaccccatctccacaaaaaaattaaaaaattagccaggcatggtagtgtgtgcctgtggtccagctacatgagaggcttaggcgggaggattgcttgagaccagaagatcaaggatgcagtgagccctgactgcaccactgcattccagcctaggcaacagagcaagattctgtatttttaaaaagatatagaatattactatcacctctgaaagcccccttgtgccctttccaagtgaagctctgaaactactacctgcagtggcaatcactgttcttatatttttctgcgatagtttttcctgttctacaacattatataaatgaaatcttataatatgtactgttttatataaggcttctttcatgtagcataatttttttttttagtcatccttttgtttcagtagtttgttcctcctttttattgctgaataatattccaacgactgggtacacaacagattccttgtctgttctcctcttgatggacatttggattgtttccagtttggctattatgaataatcctgctatgaacctttgtgtataagtctttatgtgatcatattatttctatgtcttggataaatacctaggaatggaattgctggctcataggtacatgtttattatttatttatttattatttattttttgagatggagtctcactctgctgcccaggctggagtgcagtggcactatatctccccaccgcaacctctgcctcccagattcaagcgattctcctgcctcagcctcccatatagctgggattacagccactcaccaccatatccagctaatttttgtatttttagtagagacggggtttagccatgttggccaggccggtctcaaactcttggcctcaagttatccacccacctcggccttccaaaatgctgggattacaggtgtgagctacctcacccggcctgtaggtatatgtttaaatgtattagaaactgtcatagtgttttctagagtggtaaatgatgtggagtaatttttcatgttcatatttgttatttgtatgtctttggtgaaatatctgttaaaatcttttgcccatttttaaatggggtagttttctttctttattgcaatagtttttgggatacatgtggtttggggttacatggataatttgtttagtagtgatttctgagattttagtgtactcgtcacctgagcagtatacactctgtccccaatatgtagtcttttatccttcaccccccccaccactctttcccttgagtccccaaagtccattacatcattcttatgcctttgtgtccccatagtctagctcctacttataagtgagaatatatgatatttggttttccattcctgagttacttcacttagaataacagcctctagttccatccaagttactgcaaaagacatgatttcattcctttttatggctgagtagtattccatggtgtatatataccacattttctttatctacttgtttggttgatggacacttaggttggttccatatctttgcaactgtgaattgtgctgctttaaacatgtgtgtgcatgtgcctttttcatataatgacttcttttcctttgaatagatacccagtagtgggattgctagatggaatggtagttctcagtttagttctttaagggatctccatactgttttccacagtggttgtattaatttacattcccaccagctgtataaaagtgtttccttttcaccacatccatgccaacatctattgttttttgactttttaattatggccattcttgcaggagtaaggtggtatctcatggtggttttaatttgcatttccctgatggttagtgatattgagcattttttcatatgtttgttgggtgtttgtatatcttcttttgagaattgtctacgcatgtcctttgcccactttttgataggatcctttgattttttcttgctgatttgtttgaattccttgtagattctggatgctagtcctttgttggatgcatagtttgcaaatgttttctcccactctttggattgcctgttgactctgctgattatttcttttgttgtgcagaagctttttagtttaatttgatcccatttatttgtttctgtttgtgcatttgcttttggggtcttagtcatgaattctttgcctaggccaatgttcagaagagttttttccaatgttatcttctagaatttttatggtttcaggtcttatatctaagactcttacatttaagactttgatccatcttgcgttaatttttgtataatgcgagggatggggatccagtttcatttttctccgtgtggcttaccaattatcccagcaccatttgtggaacagggtgtcccttctccactttatgttttcacttgctttgtcaaagatagttggctgtaagtatttggctttatttctgggttttctattctgttctattggtctacatacctatttttataccaataccatgctgttttggtaactatagccttgcagtataatttgaagttgggtaatatgatgcctccagatttgttctttttgctttgaattgctttggctatgtggacttttttgattccatatgaattttagaatttttttctagttctgtaagaatgatgatattttggtgggaattgcattatctatagattgcttttggcagtatggccattttcacagtattgattctttccatcatgagcaagggatgtgtttccatttgtttgtgtcatctatgatttctttcaacagtgtttcgtagttttccttgtagagatctttcacctccttgattaagtatattcctgggtattgtattgtattgtattgtattgtattgtattgtattgtattgtattgtattgtattgtattgtattgtattttgcagctgttgtaaaaagattgagttttttatttgattcacagcttggtcgctgttggtgtatagcagtgctgctgatttgtgtacattgattttgtaacctgagactttactgaattcgtttatcagatgtaggagctttttgaatgagtcgttatggttttctaggtatacgttcacatcattggtgaacagcaacagcttgacttcctgtttccaatttggatgccctttatttcttactcatgtctgattgctatgactaggacttccagtactatgttgaacagaaatggtaaaagtgggcatcccttttattattgagttgtaagtgttctttacacattctggatacaaacaatttatcagatgtatgttttgaaaatgttttccgtatgacttgcctatctattttctcaataatgtctttcaatgagcagtttttcactttcttgttttctttccttttttttttttttttttttttttgttgttgttgttgttgtttgagagtgggtctcgctctttcacccagactgaaatgctgtggcttgaacacagatcactgcagccttgacctcctgggctcaagcaatcctcctgcctcaacctcacatgtagctgtggccacaggcacgcaccaccatgcctgactgattttttaattttttgtagagatggggctctcactttgttgcccagactgatctcgaactcctgggctcaggcaatcctcccaccttggcctaccaaagtgctgggattacaggcgtgtgccattgtgctcaccaaaagttttaaattttcgtgaagtctaatttatagttctgttttcttttatgaataaccatatatgacttgtctatgatacctttgtctatcaggaagccatgaagacattctcttatgcttttctttaaaagctttatgattttagcttttatgtttagaactcaattaattgatttatgtattgcatgaggtaggagttgaggatcattttgttttacgtggatatccagtatttccagcatcatttgttgaaaagacttttccttccccattggcttgctttggtacctttgacaaaaagtcaaattttgtataaatgtaaggctatttctggactttcctatactgtttttttttttttttaaactcgtatgttattaccaggtcgtcttggttcctgaagtgttgaagtcaggtaatatgaatacttcaacattgttgcttttcaagattgctttggttattctaagccttttgcatgtccatataaattttcaaatctgctgatcaatttgtataaaaaacttgctgagattacgatttggattgagttgaagttattggtcaattttgggagaatttatttcttagtaatattgagtcttctaatctaggaacatttatttagttctatttacatttctctgagcaatgttttgtagtttaggtggggagatattgcatgtcttttgataaatttattcctaagtattttgatttttgatactgttgaaaatggaatagttttaaaactagatattccaattatttgctgctagtatatgaaatgcaattgattatatatgaaatattatttatattatatgctatatatatacacattttgtttcttatgcacttgctaaattcacttattgcttctagtaattgttttagagattccttagaactttccatgtaagccaacatcatgtgacaatagagagttttatgtattctttactgatctttattccttttatttctttttgggggcctattctgatgtttaatacttccaataaaatgttgaatagaagtggttgaagtgggcatccttgtcttatttttaatattaggagaaaagtattcactgtttttccattactgtgatgttacccatttttgttttgtttttttaaaagatgttctttatttgattgaggtagttaccttctattcttggtttcctgaaaagatttatcacaaattgttgttgaattttgtcaaaacctttttctgtatctctcgaagtaatcttttggctttcctctttatcctcttaatatggtaaattatattgattttaaaatattaagccaatcttgaattcctagaaaaaaccctactggtcatcatgcatcatcatgtttatgtattgctattttctaagtgcttatgttttgtgaagtatttttgcccttacattcatgaagagtattggtctgaaattttcttttttttgtgatttctttgtcaggctttagaaagattttggcaacattctaaaagtgagttgggaaacggtccctcttctactttcagaaagagtttgtgtaacattgctgtcatttcattaaatgcttgatagggttcactaggaaaccctctgggtctgaaatttctttgtgggaagttttttgatatcaaactagatttatttagtggatagagagccattcagattttctgattcatcttgtgtcagtttttggatagttgtatttttctaagagtttatttcatctaacttgtcaagcttattggcaataatttataatattttcctatttttttaacatctgtaggatttatagcaggagtcagcaaagtttctgtaaagggcagataataaatattttaggctttgcaacccacaggtggtctctgtctgctgaatgttcttatatgtttgtttttgttctgctctccgttcctcttgccccctgccctctcctccccttctttctcttctctcttctccttccctcctttctcctgtcttctccttccctctcttctcctctcctctccctccctctcttctcctctcctttccagccctctctattcttctcctcttcttcccttgctgtcctctgttttcctttcctctcttattctctcctctccctctgcttctttctttgtgcaaccgtttaaaaatgaaatgtatgttgtgcaactctcaccaccatatgtctgcagaacgttgttcatcttcccaaagctactggggaggtcagcctcctcagtagctgacccgttgaataacaagtccccattcgtccctttcctagcccttgacaaccacaattcttccgatccctgtgattttgactactctaggtacctcatgtaaatggaataataccatatttgtcctttgtgactggcttttttcactttgcaaaatgtcttcagggttcatctatgttgtagcatgttagaatttgctaattttttagggctgaataatgttccattgtatgtatttaccacactttgttcatccattcatacaggggttctttttgaagtgatggaaatgttctaaaattgattgtagtgatagttgcacaactctgaatgtggtgaaagctaatgaactgtatactttaaatgggtgaagtatatggtatgtgagtaaagtctcaataaagctgttaccaaaaaaaaaaaaaaaagccacgaaacctaaaagtgacatgtaaaatctattcttagctcagggcaacataaaaacaagccttaggaaggatttggcttgctgattcatttgtcaacctctgatttatagtaataaatcctctttcatttctgatattggtaatttctttttttgctcctttatttttgatagtatagggatttttccattttgttgatccttttaaacaacctttggccttgttaattttccctattacttgttttctactttttgatatctgattttatgtttattacttcctttcttgtacttattttggttttagttttatcttctttacatagctgctgctgctgctgctgcctcctcctcctcctcttcttcttcttcttcttcttcctcttcttcttcctcctcctcctcctcctcctcctcctcttcttcttcttcttcttcttcttcttcttcttcttcttcttcttcctcctcctcctcctcctcttcctcctcctcctcctccttcttcttctccttctccttcttcttctttttcttcttcttttaagatgaggtctctctgtcacccaggctggagtgcagtggtgtgaccgtagctcacagcagcttcgaactcctggactcaagcaatcctcccacctcagcctccccagtagctgggactacaggcacgtaccaccacacctggctaatttttagattttttatttttgtaaagacagggtctttctttgttgcccacagtggtctcgaactcctagcttcaagcaatcctcctgcctcagcctcccaaagtgctggggttacaggtgtaagctactacccctggcctgtctagcttcttaatgtggatctatatatcattcattttagacctttcttcttttctaacataatcctaaaaagctgtaaatatctttctaagcactgctttagctgtagtccacaaatttttatatgttgtattttattatgtcagttcaaaatattttatattttttttagtccgtgaattatttaggagtgtattgtttaaattacaagtatttgggggctatctaagatatcgtattattattttttcagacagggtctcactctgtcacctaggctgaagtgcagtggcacaatcacgactcactgtagcctcagcctcctgggctcagatgatcctcccacctcagcctcccgagtagctgggaccacaggtgcatgtcaccacacctcgctactttttaaaacattgtttgtaaagatgagatctctccatgctgcccaggctggtctcaaactcagcctctcaaagtgttgggattgcaggcatgagccaccccaccaagcctgagatatcttattgttattgatttcttgtttatttcattttggtcacagaatatacttagtataatttcaatccatttacatttgttgaaatttattgtattagtcagagttctctagagggacagaactagtaggatatatatgtatgtatatatatatgtatataaatacacacacacacacatatatatgagagtttattaagtattaacttacatgatcacaaggtcccacaataggctgtctgcaagcttgaggagcaaggagagccagtccgagtctcaaaattgaagaatttggagtctgatgttctaaggcaggaagcatctagcacaggagaaagatgcaggctgggaggctaagccagtctctccttttcatgtttttctgcctgctttatatttgctggaagctgattagatagatggtgtccattccaattaagggtgggtctgcctttcccagcccactgactcaaatgttaatctcctttggcaacacccccacagacacacccaggatcaatactctgtattcttcaatccaatcaagttgacactcagtattaaccatcacaagtccatcccttttcaagttgaacccatacacatttcctgagatcatacataatcttcaaataaagacaacaataaggtcataattatgcctaacataatacaactatcctttgtacaactggaaatgcacaaatccccaacacaaatactattacataaaattaacaatacttaaatgctgatatgaagtcagtaaatcctatgtcacacgataaaagaaaaaaaaataaaatgaagatttttcttagtacaagtgtatacatgcacaaacatgtttttaacaaaagaaggaggaaatattcatgacaattacagtctccgtttttgtagctggtcatgtggtcgtagctggtattgatgactacattcttctgctacccattctctattccctttgccttcagcaagcacctctgcaggtcgtggtttttttcctggtggagtgacccaagccttcatttttgaagggtctgggccatttgtagtcctgcctggattgggctgttgtagtttcccattgaccttaatcacagggcatggtaattctaagagatgccctagtggatctcctgtattccatgcataccttacctccgttgtagagtagtagactgatttcatcttgatagtccggatcaatcaccccagccaacactgtaactcccttcttagcctattgacttaaaggtaggaggaacccaaagtgtccaggtggcaatcttaacttccagtttaaggagatcgatgttgtgtctcttggtggcagcgttcctccctctggaactaagacctctaggccagcagaatgtaatgtcgtgggaacaggaagcaaaagttttgctagtggatcattaggggtgatggtgagtggtgccacttccacttccaactcttgattcctggaactgtgaatcctggctatgggaaaaaaagtaccatatattggacgctgatttagagcacttattttatatcccaatgtgtgatttattttggtgaatgtttcacatggacttcaaaaaaaatgtgcattctacagttgttggatataaatagcaattaggtcaaggtgccagcagtgttgttccaatcatctttgttctatcctagttgttctctaattgagaagggtgttaaaatctctaactttgtgcaactgtctatttctccatttagtcctttcaaattttgctttgtttattttggggctcttttattaagcacatatacatttgtgttggtttgtctttctaatactaatcctacccctaaacatatttatcattattaaatacccctctttatctctgtcttgaagttattttatctggtttgaatataaaaaaccaagtcatccaagccttcttatggttactctaaaaggtatgtatgtatattttatattcatttgcttcctagctgtctttatatttaaagtgtacctcttgtagatagcatatagtttgtgttttattttttacccatcctgataatatctgacttttaattggagcgtgtagtttttttaacatttaatgtaattatttatgtggttggatttgagctaccattttattttaatttctgtctatccctctggcttttgttcctctgttccttctttcctgttgtctcttgctttattttaatatttattatagttgctttttaattgtttactgactctttaattatatatatttgcctttctttctttctttctttctttctttctttctttctttctttctttctttctttctttcttctttcttcctttcctttcctttcctttcctttctttttggagtctccctctgtcaccgaggttggagtgcagtggcacaatctgggctcagtgcaacctctgcctctcgggttcaagcgattctcgtgcctcagcctccagagtagtggggactaaaggcatgtgccaccacgcatgggctgttgtttttttatttatttatttttttatttttagtagagacagggtttcaccatgttggtcaggctggtttcaaactcctgacctgaagtgatccaccagccttgacctcccaaagtgctgggattacaggtgtgagccaccatgcctggcctgcattgttttcttaatggttgctctagagattataatatacacttgtatatttttttacagtctacttagagttaatattgtactgcttcatgtaaaatgtagaaactttaaaccagacgtgtcaatttataccccctgttttttatgctataattgtcacacacatattttacacaagaagattataaacttcacaagacaatgttatagtcattactttaaaaagtcctatgttacttaaaaaattgagagaaaaaatggttttttacatttacctagatatgtattatttttggtgctcttcactccttcctgaaggtcagagttctatttggtatcacttcccttcagcttaaaaaaattcacttaggatttattgtagtgcaggtctgataatgataaattttctgagtttttaatttatctgaaaatgtctttattttatctttatgcttgaaggatatttttgtttgtaataggattcaggattggcaagtccttcccccagcccccagcattttaaagatgtcatttcactctcttctggcctttatgttttctgaagagaaatcagtaatcatttgagttcttgtttctctgtatataatgtgtaatttttctctggctttttaaaatattttctttgatattctgcagtttgactattatatgcctgggcattttttttttctttgtacttatcctgctaagggtttgctgagcttcttgaatatgtaaatttataccttttactgaatttggggaaattttcactgttattccttcaaatactgtttcctcaccattttctctttcctctccttttgagactccaattacttgtatgtaagatcttttgatactcccccacatatccctgagactgttcatgtttttaatcatttcactatctattcttccaaaaggatcatttatattgatctacctttaaatttgcagacatctgttgttttcatgttactattggacccatcctgtgcaattttttaaattgtacagtttttagaattcatgctaaatgaatagattttagctactcttgccacaaaaacaacaaaaaaagaggtaactatgtgagaccatggatatgttaatttgcttcactatagtaacctttttactctctatatgtatcccgtaatattatgttatataccttaaatacacacaataaaatttactttttaaaaattccaattatactcaaagtttagaatttctgttttgtttgtttctgtttctttttaaccattatttcctctctccattaattgcaaacatattatcttttaaatacctcagcatagttatactagctgctttaaaatccttgtctgctaattctaatatctggaaaatctcaaggtttaactccattgattatcttttaaaaatgggtcacattttttcttcacgtattgagtaattttggactatgtcctgggttttataaatgttatatatatgaacactctagattctactctattcttttgtagattatagatttttgtcataacaggcaattaacttggttggactatactgtagacaccaactcttgattggcagttcaaatctcagttaattcctttattcttagtggaagtatgtcctgtacatatgtggtccagaggtcaggcatatatttgggcagaatttatactcagaattttggatcccgctttccattccagatgtccaccacaacccccatcacctcccagtggctatggttgccctggcttttgtttctggttcttcattccacaaagactgcaattaaaaaaaaaatcaaagttttagatgtccttcacagcattagtttcagcctgccatcaggctacaagatgtaaaaacgggtaccccaccttgtgatgttacctttttccaagtgtttactcttctccagaaactgtctgcttttggtaattttccagtgccttcaagtcgttgttactttgtattgttgttatatgcaggagagttgagtttattaggagctacttagccatattgaaacagatgttgaattcccagtgtattttgtttacaatggggttttctatcatgaatcttggtggagagacaaaccaaacaacaccagttgtattcttggtgccaaactgcttacatattgaagctaaatcatgacctctccatggtacttgattgccctagcagagttcatttctgcttagcaaagagccatatgggttttgagactacaagtcatttttagaaatattattcacttttaacccccactatacacccagctagataatagcaacttgagaggcagcatagataattttaaaaagtgggccaaaattgcatatatctttgttcacccacatcccagttgtgtgatcctaagcaattcacttaatctttctacgccatttcctgttgccataatacaacgtacctctcagagttgatagagagattaaatgggagaatgcaggtaagtgtgtccacatattctgttttgtatgggagaatccagatttatggctgtggacttagtgtaattattaacaaagcccttttgactctcaaaaatgttccagtacttgtcaaatactattaccaatcaactcagcaaatacttctgatagtggatgtcttgttccattttgtgctgctataacagaataccacagaatggataatttctgatgaacagaaatttattggttcacagttctggtggctgggaagttgaagatcaaggggccgcctgcggtgagagccttcttgctgtgtcatccaatggcagatgtgcaaagagagggagagagagaacaaaagattgaactcacagcctcaagcccttttataattggcattaatccattcaacagggtggagccttcatgacctaaacatatcccattgtgccccagcccccattattatcacattggggattaagtttctagtacatgctttttgggggacatattcaaaccatagctgtgagcatgcagcagaattgctaagcgctaatgcctcacttccctgcttcactttttaaccaaaacattgctccataaactatgaggaaagtgcctaatatcattgtattgtgttttttattgttactttgttttttccttttaacatatggaggaaggtagcctgagttccaagactggtctttatttctgataatcagggcaaatgacctaatttgtcatttccctctcatctctattattacccaggtgaaaggagatcaaagggagagaacctcaggaataggcttagaaaggaaaagatgatgtgtgtttgtgtctatgtctgtgtgtaccaggatcatgtcttggcctgtgactgtgtgtgtgtgtgtgtgaaaagtgtatcatcgcttatggagctagttcccacctttcagtcctttgggtgatattctgaggctgagctggggtgggaggtgggcaggacttcactatgatgaatgaagactccaattttcattttttggcttttcttggcagattttcctaggcaatgtccctgtgggagggattttggcttccatatatttgcctaaatcactgacggagagaattcctcttagcaacttacaaacgatcttgtttaatttctttggccaaacttcactctttaaggtaaattcttgcctgtggtaactgtgatgaactggcatatggtgactcattgtaattatgaactcttgctattttcatgatgttctgcttattttagaatatgctgattgattccacaagtcttccaacacaacccctgccccttaacatgaatcaacgtctactttaatgatgttctacagtttttagttttcacaatatctcagctttggaaggaaacttaaggattatctggtggctaaacagaggcctcaagatgtttcaaagccaaaaaagaacagcgagttctcctgatgaaatgatgtttcggcttatcagtgctttcctcccaaatctcccctggctcctcaaagccaacatgtccactattcttggccaattcctttgaagttgggtggtatccagaaggacatttgcctgcaggcatttgttgctacttcccacagcccccacagaactttctctgaaggctgcagtcctcacccactagaaaacagaggcagcatgatgtgatgctgaagagtgtggactcaggggcaggctggttgaattaaaagctggcaatgccatattctgcctgtgtgtcctcaagcaagttactcaaccttcatgtgccttaatttccttctctgtagtatagggtaataagaattccttatagagctattgaaggattaaaggaattggtgtatttaaagtgcttacaataccgcttggcacataagtaccatgttaagtgtttgctctactattattagtatcctgtcttaggtctctgcctaacaaaagcctcattcgtttagaccactctgtctcatctagctattgggaagacagtaatcagagtttgcatgaatttgaagataatgaacactattaattgttaatatttacatttattatttcatctacttctcatgagaagctgatactcaaaaaggttaagtaatttttcccaaggccacatacctaaaaagtggcatagctaggaatcaaacccaggctatctgacttcaaagttcatgtatttaaagtcaatacaataattttcccagatgtgtttgtatttctaaagaggttatccaaagtaatgaatttctaatggtcaaatatccacatttcttttgtgggaggttgcactgggccagctcaaaatatagcacatacccataccacacgccacctcaaatataccatgtcacctccagctatgtctgtaagactttctgttcccctggagttctctagccactcctttctctctctaaattctatgtgttcctgtgggcttagctcaaatcccacccagggtggctgcctggagtaagtgagtctctgctctccttcctgcctcctgggcaaaatatttagtgggcaaaacattttaataaaaattaaaaatatgctccacaacactttgacccttttggtaggcttacaatttctctttgtcacttgagatgccattattttggtcttaatttctctcctttcttcagagggctgtgcttgtctcgtagaataagagataaacttgttttgcatagatttcacacttaataagtcatttttattcactaacactttctactggaagagattaaagatctttgccaaaattaaactgcaaacatcatagtaccagatgaagaaggattagaactagcctgcttcaaattcagagttgaaagggccctcctaactcatatcatcccatctattcattttaccattggtaaaagtaaaatggatattgaggacctcgagtctcagagaggggaaggaatctgctgaaggtgtcacaatttattcattcattcactcaatcatttattcattcagcaaatatttatttaattcctactgtgtgtcttgtacggtgctgaatgctgaggatgcaatgctgagcaagatacatagtgcctgctctcatggaacttccagtctgctggaggggaaaacagacctaaatgttctaacattaaaggggtgaccctaggctgggatctgtgccactggttattggggaaagagtacttacaaaaatgctgctctttaattctatttttcttgaatccccgagtatcacagccttgctttcgcactactttctctaatattttttgatcaaaatcttaagtcattatgacacataaccttagaaatttgtttgtttgtttgtttgtgtcttttaaagacaggatctcgctctgccacccaggctggagtgtagtggtgcaatcacagctcactgcaacctctaactcctgggttcaagagatcctcctggctcagcctcccaagtagctgggaatataggtgctcaccactgtgcctggttaattttcatatttttttgtagagatggggtctcactttgttgcccaagctggtctcaaactcctggtctcaagccatcctcctgtctctgcctcccaaagcgttaggtttacaggcatgagccaccgtgcctggtccatagaaattgttgataaggcaccactcttggataatatgtgtctcctcctccacacctcctctagctgtgattctcagggagagggacaggcactaggcggttacaatatggcacaggggctctgggtgcatagaagagggaatctaccactcatctggaagatcaggaaagtgcagtgagagaaaggtctcagcggagccctgaagttgagtaggagctcaaagatgaaatagggcaaagagaaggagagaagagagtttcagagagagggaatagcttgtctaaaagttcagaggtgtaacagataaaacttgagcctacagtgcaaagggtggaaggatgaggaagtttctattcctttcctggcatggctaccgttttgtagtaagggaaatgaaaccagagaaaaggctaattaagttttggatcatagtgtgtgtctcctcctttggccttttcactacagaaaactgcgtcacttagactaagttgggaggatcattaaataacatctagtctgccatctttcctagtgtcaccaatagaccaggaaggggtaatagggcttaggaggaacaagagagctagggttagcccttagccttttgagtgtcagcagggcccttcccattatatcttgctgttggccatctctaaatcaggttgccccaggctggttttgaatgaacagaacaggtcagaaacaggaagtaagtagagtcctagtggagccccaggctgaatttgcaactacccaggctgcagggctcaggtgtgtagggtaggtagtagggactgcacactgtttcttcagaaatatgaagccttggcatcttctaaaagtggcccagcaggatctccaaggaatgtcatctgcgttcacgtcctctaggcttttgtggggaagtcctcagagatttttcttcctctccctcttgtctggtatcaccagccctacctgtggcctcttcacatgtgcctgtgccccagaacaggcagcatctcagctgacttgcatcctggagccttggcctggggtactttggcactgttagttagcaagccccacttctcaagagatacattctagtttgttgcctttaaaccaacatttattaagcattcctgccctgtcacccactagctgagtgatctttatccatttaggcactgagccactcaagcctcagtttatctgaaaaatgcttatatggcttcaatgaggactgcaaatggcatgtgcatgaaaagcacataataagtggctcactgtgggcacaagacacctgctgtgtcctaggatatgtgaggaacaccaggctatacaatgcctgggctctggcctcagagctcacagtcccctaagaaggcgatgactgtcctctgaaatttgtttcaaactgggtgttgatcaacctgcttccatctctgtcagaatagaacaagaagtggtttataacttacaaatgatagatttaggtttcttatagaggagctccctaaaagtaagcaaggatggttgagagttagaactgggataagttgtgaaatgtcaaggtccagaaagttaccaaaatagagaatagtttcattttgttgctagtgcagtactgagtagcaggtgcaaaacaaatgcgtgctaaatacacatttggttggatggatggatggattaatgaattgttctagcttggtataatggagaccttatgtgaagacaggagatgagctgaataacctttgaccttagcttgcaattttattttccacatttctgtacctaacattgtgtgtagcacttcaaaattccagattgattattaatatgtaagtaattagaaatttaggtcctgaactcctcttttgtttcatctgcagaccaaaaatgtcactaaagcattaaccacctatgttgtgagtgccagcatttcagatgatatgttcattcaaaacttagctgacccagtggttatcactctgcagcatattggaggaaaccaggtaatatatctattttcagctcagaatcaaatggcctcaggaactcttcacgacttttctgttaaaagtaatttgttaattaacagatgtgattctaacacttaatgaggaatgtcctattccaggtagcaaatgtgtgttataattggaaccttccagaaataatgccttatcctaaagtgatagggaatgatgggcattctagcactgtgacagattggtggggcagtgactggatcttttggatgtcccatcacactaaatgacatgtgattccatttatttttgagcgagacaagcaacttcactcaaaataattgaatatttgtattacttgaatttccagaaataacattaaaacgtgtatgaattatcaccaaagaactaaaagcatagtcatatggcataacataagctatatattactaaataatcaactttagcctaagtacaagtatgaatgactattccattatttgacgttagtgtatggccagtgtgacgtctcaatagatttctcagttcccagtctaaaagaccatatagttcagcatacttttcactggtcttgattctagaagggaagaagagaaggaagagagggagaggaaatttaaagaaacaaataccaaatgaaacgtgttagataggtaagatctctcaatttggtctgggctacagcacttcaattatccccggtaactaattgctccttgcctgcagtttcctggagactacaggagctggtgaagtcttaggaatgttctgtaggcctaatgatggggcagatcaaatttctgtccataaggcttgatctcagcggtgagccccgaattccaaagctccagaaggaacacatcagccctgcattgactatccatagccttgtaccagaagggcatggcaatttttaatactaccaaatattttaaaggacatatcagatcaccagccggtgacatgctgttttctcacttgtaaatccagagttagatggtggagttagtctaaaagccaattcacaaatggcccaaatgtgtatgtgtatgtgtgtgtgcatgtcagtgtgtgcatgtttaccatgggaaaaaatattgggaagaaaacacttatgtgtatatgttactatatggtaaatatcacaaggcaagatgtttacctctgatttctttttttccagaattatggtcaagttcactgtgccttttgggattttgagaataatagtaagtatttttgttagcaactttgactttgccccagaccattttcccacttggcagttaaatgggagggggttgtgctgaaactactgtcttatcagaccctacagagcattctgaatgaccaagatacaggatatgatttttatatcaaattagggcatgggaattaagacaactttcctttttgataggtaagatctctcaattggtgctggggctacagtgctccaatcatgcccaataactaattgctccttacctgcagtttcctgaagattataggagcttattacaagtatcttaggccccaaaaataattatttggaaaatcagaaaaattacacaactcgagggtaagcaaagttggaagaaagaaatttggaaggcccagcgcagagtagccttgaactgtttgaagaaagttgaggaaggaatacctggttctttatctgtgctctcccacagggttttgcaagatctatgatctccttccctttttttttcctcacctcttttagactgactgtgtgaccttgggtagacaatttaccccctctgagccccagtctttttatcttttcattgaggagatgaaacttcttggttggtctctaaggaccctacttgcttgaataagcatgagtctttggagacagacagtagaagactgggaatggtcattgctgactgggttgctcttagcattgccatcttcactggaaatatccagggttatcaccaaatctcagagaatttccacacagaataaatttccctaagaacgccaggagtggctaagtgaggagtccttctgcctgtggaaactctgcctggaacctttccctttttcactatccttggaattctgggacaaaatggaaattctcttcccattcggctccctagagtataagaatactacttctttctgacaaacaaaaataacactgccctttcctgatcccctccaagtctctcaggataaaactctataaagcgatgagctttgtcccctacaacctcaatatgttgatctctatgttcattaacgcaaattgctggggtactcccaggtcaccctttgcccctgcacctctgccccgtggatctagaacctctggaatctatggcattatcccagatggacaaatgttgaccaaacttagctgcctgcccggggataacccctttggtctagtgccacttgggaagttctagtctcaaatctgatctagtacctgagatctacaggttgtggaggtatgagtgttagttctaaacctgagtgtgctcagaagaaactagccagatgtctagtagagcagaggctctaattggccctgcagagctccagaccatgatctgactttgattgaaagcacttgagaccctttgaattgcgggttcagctgggtgttcagatgtctattccagtccctctgagtaagctcaagtaccagcttatattccatacgtccatgtccttaaaaatattctagatctgcttgcttcctatttattggctacttaaaaaaaagttcatggttagagtctgtcctaatttgtagaggtatggtacaagaacaggaaaagggagagccgaagaagttgtgccatttacgaagtccccaaaaagtcaatttagtctgttagacttaatttaatttcagtgttcaattatacccctaatcttgctatctcagcaaataatattaattataacacacgtttggatagtgaatataatgaaaagttaaacatttctgagaaaaacaaaattgctttgaaatttccttctgtctcctacagatgggctgggtggatggaattcgtcaggctgtaaagtaaaggaaacaaatgtaaattacacaatctgtcagtgtgaccacctcacccattttggagtcttaatggtgagttgtctcttagtcactcctcgatggaagtttgacaatttttattagaccagtaatatatgtgtgaactgttattaaaaaatggtatgcatttggaaaaaaatcccccttccaatttgttcatccaaagtagatcagattgagacaaatatttatttatttattctccttataaaattaatgcttgcttctcaaatttcaaacagtacagaaaaggtccctttaacctccctcccaagtgatcaccacctttaacaggctaacatgtatattcatttaggttcttttcctgtgtatataggaatgtacatttttgttttataaacatggtatcaaattattcatactgtttttaccgattgcttttctcatttaacaatatatattgcacaactttcaggcaaatgtgtatgtatctattatacttcaatttttaaaatacctttatagtataccattgcttgggtttaacacaataaatttaactaatccctgactagtggacattatagctgttgctgtttttctcattataaatattgctgtaatacacattcttactcatgtatcttcaaacattggtgtaagtatttttgcaggataagttgacagaagtagaattgctggattaaagggtctggtcattaaaatatttaaatttaagaaggatcataagtatttgctgagtttttcttccaaatgactctcaaatgtattcctttttctctacccgcatcagaatactttcctggatttcttaggtaactttattacatactgttatctgaatgtgtcatatgttacttattcctacaaagaatggttagctttttgagggctgtgggtctgttttatatttatttattttacatatatatatatatatatatgtatgtatatatatatattttttttttgagatggagtcttgctctgtcacccaggctggagtgcagtggttctatcttggctcactgcaagctccgcctccctggcagaggtgggaagaatcacctgagtccagggaggttgaggctgcagtaggccgtggtcaggccactgcactccagcctgggcaaaagagtgagaacctgtcccaaaaaaaaaaaaaaaaagagagagagagagagagaccagggttcttgttccagctctgtctgtaactaactatgtgatcttggtaaggttgtttccctcttttggatcttagattttcttctgaaatgtgaatgactggaatacaccagggtttctcaatcttggcactatagatattctggccaaatagttctgtctttttttttttttttcttaacggagtcttgctctgtcaccaggctggagtgcagtggtgcaatctcgggtcactgcaacttctacctcctggtttcaagtgatactcctgcctcagcctccccagtagctgggattacaggtgcccaccaccacacccagctaacttttgtattttttaagtagggacggggtttcaccattttggccaggatggtctcaatctcctgacctcgtgatctgtccacctcagcctcccaaggtgctgagattacaggcatgagccaccccgcccggccccaaataattctttgtcgtgggggattgttctgtgcattgtgagaagtttagcagcatccttggtctttccccactagatgccagtagcactctccccagttgtgacaaccaaaaatgtctccagatactgccaaatgtccctgggagaggggtaacatcactcctggttgagaactaccaaagtaaacactgcttcttaacctttgatgagtcatgaatctctaatcatctgatgaaagctatggactttgttcttagaccagtgcacacatatattcaaataattttacatgtcatttcagatctttaatagtaattaataaatcactgaactttgtgatctctaaggtccattttgtttgttaattttgtgaaggctatttaaggactaaggaaaaggacttttttttttttttttttttttttgctgttctgtgtagtgttttgagatgctcagttcagataattattcactttgcatcccaaattcacatctctcagcttggttatattttaaatgtagaacatgttaatgatgatgaagccaaggaccaaatgttcttccaatgctattgatggctccccatgccctgtacacagtcagttggactaggcatactcagcaaacaatatttggtcttaccatacatccattcacataatctggttttagaagagctatggcagaaatgttatacatcctgggaacttcctgttagtgaacactggaagcattttgccataaacttgctctggtgtatgtgtaaaacacaacacattgtgttccttaggatttatccaggtctacagtggattcagtgaatgaacagatattagcgcttataacatacaccggatgtggaatctcctccatttttctgggagttgcagtggtgacatacatagcttttcagtaagttgatacagccttgctctgagcacatttaatttggtttgatggatgctattaccattgtaactttgttaatttcatgaacacatcacaataggaagaagtcagatccattagcttatgaagtggacaggttaaaaacaaaacatcaaggcttctctaaaaatattttaattggatttttgtaaaacaagggagttgggataggaaaagatttctctataggatataagagcaccaaccctaaaagaaaatttgataaagtggactttattaagaacttctttaatcaaaagacacaattcagatagtgaaaggcaaaccttacatagagagaagatattcacaatgcatatatcagataaaagacttgtatgcagaatgtataaataactccacaaatcaaaaagcaaaagacaataaagtttataaatggacaaaagacttgaacaggcacctcacaaaagagaatatccatgcctaagcctaacccttaccaaatggccaataagcatatgacaaagttctttacatcattactcatcagagaaatcctaattacaaccacagttatgtacttctctgcacccaccagaatggctaaaattaaaaataatgacaatagcaagtgtcaacaagcatgtggaacaactggaactcatacatttgctagtgggaatgtaaaatggttcagacactttggaaaattattcggcaatacctgttaaatataaatatacatctcgctgttggcccaggaatttcactcttagatatatactcaagacaaatgagcacatatgtccactgaaagatatgtacaataatatttatagcagcttcagtcacagtagcttcaaattagaaacaaccccaatttacattaacagttgattagatgaataaattgtgatatatttgtaaaatggaatgctacacagcagtaaaaaatgaattacttctatgcaatgcaacataatatttaaatctcatagacatagaattgagcaaaggaagccagaaaaataagacaacgtactgtgtggttccatttacaaaaagttccaaacacaggtgaaatctatggggatagaagtgagagtattggttacctctggtgggtgatattgaatgggagaagcatgaaggagccttctgggatgttgaaactattctacctcttgatctgtgtcgaagttccacaggtatatacatatgtaaagatccatcaagttatattgttaacacttgtgcactttaatatttatctcagaaaaaaattcacacaaaatgaaaacagcaaaatttaaatcaataaatatttaataacagcgtaaaataatcaaagggggtaatactttttttattttgaaaaatactgggtgagtttctgcaaagtaaagttgcaatcacttaataaaacttaagaccatatttccatgaggccatatatcgggatctttagaactatccaagtagctctacttggaatggtttccacagtcatcctgctatttggtaatatgtagctccagcctgctgaagcagtggtgatagactcatagtacccaggaaactccttccttctttctaaaagataaaaagaaaaataatagcctctctcaactgcgtagttgagagagactattattatttctgttagttaaggtcactatatttattatgcttcgactttacctggaaagagaatgagggacttcaaagtataagcaaagatgagtaattcttttattctttcacttattatgtagataagatgtggcgatgtttaattaaaaaaaaaaaaacagactttacctaacaacattgtactttctcttttagcaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggtaagtatatctgccattgtttttgatatttatgtcttaagtctgtctttctaattctagctctgttagattctgttaatatcataggtaaaaaattaaggatcgccttgctggtgtttgggcatgcatcttttttttctgcctgtattgctctataaattcaatttttaacctttatggtgaggagctggtgcacaaatatttattgagcacttattgtgtattgtgctaagtgctggctctatagtagtgaacagattttatcccttcctttacagaagttacagtcacaacaaatactgataaaacagctaacacttaggtagcacttacatgtgccagatgctattctaagtgctttatatatgcatttaatcctcataatatctccacgggatagattccatcattattcccatttaatagatgaggagactgaggcacacagaaagatgaggtaatttgccaaaactcacacagctagtaggcaagagagctgggatttgagccaggaagtttgtctccatagtttggacttctaacctctatggtcttgccatattgtttaaagaacaggaaaagacttgaaatgggtgaaagagtgctgggtcagccagaacctgattctcatcacacctcatgactgtgatgatcactgctggccttggaagaagccaggaatggttctcagcatagatctttctgaatacaaatgtcatttcattggcttgctttcctgtatttctaactgacatggtcagctcggctcctttcctctctctcccttgtgtattcaaggcagattttgggttcagaaaatgtgttagatgtgtaggagatgtatattaagtagcataccttgggtacataggaacacagattttatcttccactgcctttgtgaagacaatactctcctgattagctactcatccctttaatgagttcattaacatagtacatgctttcactggatacacagtcagtgctattatctatgttaatatggggagcagagacaggcaaatactgaacagatcataatctaaaagcttgttttagtacacttcggaatccatcggaagcacagagacaaaagcagtcgatacactccccttagtgccttgtgtccctcatcttgattcaatcagaggattgaaaaatgtggaagaggcttcatgaataatccaaaaagcagataacccacacatggccaattgtgaaagggctgtaaatatcacttcatcctggctttccttctccctcatcatcactcattcccagcttcttttttaaacccttcctccaggactcacttcttatctctttgatcttctaatttcatacacatttcttgggttacaaggagaggcaggaaaggctaaagcttggtacttggaagcaggaaaactttagttacacacagaagctgagaagtctgactggctcaatcagtaaagaaagatacaataagccactcttatgttcagtttattacttacataaactgtgaaaggaagagtacctaaaagtgccatctttcacattcttgtcccccacactaaaaagaacgaccccaaaacaaagggaatggatgaccgccacgtgagttgtaggattcccagtggctgaggagctagttttgaatggaagtgatactgtttcctattctgcagccctattctaagggggcagggtacaaaggcccacacctctgcagaaccctgggagatgatgagaagctgtctcctgacagcctcctggaggagatagggaggtgagtaggagatggccccggagcacctcctcacaggcctcccaccttctcaaatttgtggaggcctgcacaccgcccaaattcagataagcctttacctgtgtggtctatgtggatacatgcacggtcaccagggagccacagctgagctgtcccactacagggagttttggagcatttcaatattagacaaaagcaatcaactgtaaggaaaataggtattaatatctgtttatgtttgatgctctgccttatgaatgccaaagcaacctgttggaaaggtttattacttttaatgacaaaaaccacaattacttttgcaccaacttaatgaacccctgtccaagacagtagatttgtttatatttttaaaataacaacagaagggatcttttttttttattttcaatatgtaaacacagcttgaagactgccgcacaacttccatcctaaatatgaggccttcccctgtctctcccttccagccttctattttaaaaaacatctgcagcattctaggtgctgtgcttggggtgggctatacagatttgaagtgaccatcctgtttatcacagaatgggacagtggaggatttttcaagatacttggcattctgggctttggaacagctttggaaagcatttaacaaaacccctaaaatgtatgtaggtgcatgcgcttagtctaggagaaatacaattgagagataaagaaatcatttttttttttgcaaatgtacaagaaattggatttttaaaccctgtgtctacactctcctcacgtttgaccattttgactgaactgattgctttattatagtctgactgaattgagtggttgttaaccggtcgatctagtcaaaatgtcaaactagtaacgagtgtggaaacagtttccctgtcaaaaaagcactgaaggctgcagctgattgcctgtgcccttctcctaaggtgacctagacaaaaagctattgggaacaaaggggcgatgtgaaagggagtaaaaattaggggctcatgatctaagaagaaatgcttgatgcgaacttgcattccactcaactagatacttcttttgccaagttgattttctggcacttgagctatttttaataactagtgggcgttgtattggagccattggcatgctgtctagtttagcagattggagaactccttgaaatgcttaacttggaagaattcacaaacattttgcaaacaatagtattttgatgcccgcacatctgtggcttatttaaacagtgtcttaatgtatcatcacccacagtcattgattaggttgcctccctgctacctgatgaaatgcctttgacttgctttcccactgcaggaatcccggctatcatggtggcaatcacagtcagtgtgaaaaaagatctgtatggaactctgagcccaacaactccgttgtaagtaccagcatctctgtttctctggtggtggggctctggcccagcagggtatagtaaaatgttcttggcctgggattggtcttgacccttggcttcaggaagaaatcaacctaagtccttttgccctaaacataggccacatttatgtgatggttagttgcccgggtcctctatgaccttgggcaagttaccttacctttcagttcaatttcctcttctggaaaatggggataataatgttttctcttaatgtcctgtgcaaattaaaatgatatgatgtatgaaatgtgctcagcatattgcctgttctatgctgtgtaactggcaggtattatgattacaaagctcacacatcaggtcattgcaaagagttagtggcccctacaaggaaattctgagatgatttggaaaacattttttacctttcaacaacaaaggtcttccctgaagaacgctgaacagctttcctttgtaaacggcctcggctttattgtcctcttgtttcttttcatttttttccttttctcccatttgatgtataagttcatctctttagttctctcaaccacaatcacgcgagagtagcaattcacttcaccccacctctccagaaccttcttttacaggcatgtagatagttgccctgtggtcctttaggctgcacaatctcattttacacttctgattgttccattctttttatcattgcctctcaagttctcttccactatagatttcctctcccactggactggaattaaatgtagaaggtcctgctctaagactcccccatctttcatactgagatgacagtttccatggggtcaaaattattttgccctttgcagcagatgctttctaattaaaattccttgttatgttttctttctcttccattttctcttcccttccttctcatctccccctccatcctccccctttgcccgttttgtgacttaaaaagtccccagtgtctacctaatggtgacccttcttgaaccatcaaaagcaagagcaaaagcaaaatcagaacaaaatcaactccactttttcccaaaagagatttttcagatgtgacttggttagtaagaggccgactgctctaatagttttttttcaaattatattttgaagaagtaattcatgcacatggaacaaaatccaaacgtacaacagggtagaggatgaaaagtaagccccgcttccaacccctagctacccagtttccctcctgaggtaactcttattaccaatttattaccaacgatcaaatttgtatggatattctcttgcacactttgttacccaagtggtagatatacaccatttagcaccttggtctttccacttaacaatatatcttggaggtgattctctacccaaacatataacactatctcattttaacagttttctgtggcgtcttttaaggatgctgatgacattcagggaactctaggtgtcagaatctattaggaaaattaaatgtttttttaacatgtttgcaacacacacacacacaaactcacacatatgtgtaagtatccacgccaacataaacgacatgaccaaaagagattttcctggttttagaaaagagagctcagctaagttgacacacagttaaattagtcaagcttctctgtgttcaaaaatcagggaaaatgcctccagtaattgcaaatgttattaaatggactatctgttcatatgaatcactgcatattttttctttaataaaaaccgtagagttgttaatcaatccagtaaccagtgttgcctttgtcatccaaatacatcatattttaaagcagtacacctagagttctctttttgtagcattttcattaactttcataatttcaccattgtttgatgtagctttcagaaaatccattcattgctcacatcctttcactgtgatatttatcatgtaaagtagaattaatcctgcaaataagagcttaggtgtaaggtggtggcgggggggcagggcgtgcgggggcggtgtggggagcacggcgacagagagccactttgggggaaaatgtatcattcgtttttctgctgttaacgaagagaaccatttcctagggaattggactgacaggtttctgcatatgtagggcagaaacatcctctaggatttctgacttagtgttggaaagaaccctgaactggggctcaggagattgaggtttttgtcccagctctgcctccagttggtatgagtgaactctgtccagttcatttctctagggcagatgcccttagggtgaaataaaattgactagatgatcttcagtctctgagaaataggactttatgtttccctatctcatgatagtcttctttgtttcttacagttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggtaactggtgcttttttgccttttctgtggccagctacacatgcagcaaagcttttgttgctttggaaaataatcacctgttggaaacattaactagatgttagtcttcattaaatgcacccacagcccactctctcttgctcagtggtatagggagaagcccagataggtaacccaactttaggtaattggaaatgtctatatcaaacactgattggcaatacttcttatagtgttcattgtatcaacacattgtgctagaaaatgtacagattcacactcacgttgactttttgaggtacacaatccagctaaacatagcaattaactggaaagcaaaaacattaaagttttgaccccataggctctatctgcatctgatatcctaatattttgggaaagagccaggctagactatcatagaatcatacaggaatgaaggttaaaatcaaagggctgtgggaaaggccaaggttgtagccttgagtttgctgtaaaacaacctttaaaaagttacaataattggttgaattagatgatcctaagctaaaggccctagagctcttttaattattttcctttattccgatgaaatgaacaaataatcaatgaagtgatgaaatggtagacaaaagatggcatgagaagtaaaagctaggggccgggtgtgatggctcgtgcctggaatcccagcacttttggaggccgaggcaggcagatcacttgaggtcaggagtttgaaaccagcctggccaacatggtgaaaccccgtctctactaaaaaatataaaaattatctgggcatggtggtgtgtgcctgtagtcccagctacttgggaggctgaggcaggagaattgctcaaactctgggaggcagaggttgcagtgagctatgatcgtgccactgcactccagcctgggcaacaaagagagactctgtcaaaaaaaaaaaaaaaagctagagtctggttcatatagctctgaataattgctgacgttcatcttaacttgattttgcctattaaaaatattggggggaagaggcatgcaaaatgattttgtgtgagtctctaattctaccccatacttttatcctcaagtgtcgtccagtccatttgggctactgggacaggctgagagtcaagttggcatttcattgagttagagtctcccttcgtgctctccactatttttttttcattcaataaacccttattttccatactgaagcccactgatggtaccatgggatgctcccacaaggaaaaagttctatggtcaaataactttgggaaatgtggcaaattacattccccctttcttggaatagcactgtatacattagcatggtaaaagctctattatgaaaaaaaaaaaacctttaaaaagttgttttaatgtagtgtcttaaaaacctctgaaccttttattgtggtcattgttaatccttgaggaaccttgagaaaaataaattgacatgcagttattatatgacaggcacttgcaaagtgctgcggagttgagggggtgggaagcaatgtagcagaaggcatggtttttgcatttatgttttaggactcaagaaactatcttattttagagcaatgaggtggatcaacggaaactttttgtcccaccagatcctgccaaccatatacatccatgttctaattggaatgtaagaagtcacaaaatatgttgttcttccttcacatgccatttttattgcctctggtagtaggaatggaatttttagaaactctcaataccatcctcgcttggttccctttgaggctactggcacttggttgaattctagtgtagaactgaaggttgtattctagtgtaggactgaggccctggtgatggttctacactttttctctggatagaactgtctggcccacactacagtattctaacccgatgctctaacctcaagaactaaccagtcatggtatagaatgtccacggaaacggtttagaacccaggtgcctgtgaagacttcatccacagtggtaactccaggcttctctttggctcagtgattctgaggagaaatgtactcactctgtggaaagaggggttaaaggaaagctggcaaaagatcaagaaagctaggcaatttcgagcttataaaggaggggcaggggtgttttcaaaaccactcttatggtggaaagtagcatctaaggaaggagcctgcatggatagaagcagaatttaataggatatttcttttcttttcaacatttatttcagattcagggggtagatgtgcaggtttgttagctgggtatatcatgtcatgttgaggcttggggtatgaatgatcccatcatctaggtagtaagcatagtacccaatagttagctttttaacccttactttttccctcttctccccctaatagtccccagttgtctactgttgccatctttatgtccatgtgtaccccatgtttagctttcacttttaagtgagaacatgcagtacttggttttctgttccttcattaattcacttagcgtaatagctcctagctgcatccatgctgctgcaaatgacatgatctcattctttttttatagctgtgtagtattccatggtggctatgtagacagtttctttatccaatccacctttaatgggcacctagtttgattccatgtctttgctattgtgaatattgttgcaatgaacataagggtacatgtgtctttttggcagagtgatctgttttcttctggatatatacccaataatgagattgctgagtcaaatagtagctctgttttaatttctttgagaaatcttcaaactgctttccacagtggcagaactaatttacattcccaccaacagtatataagtgttctaattgggtatttcttgaaaactaaaatcaaagtcccatagatccagcaccaaaagagccaagctgtctctgtctgtcagatatgccttatgcccatcaagcacaaagtcttgccagtcctgcctaaaatgactgcaagatagcatgtgccatcttgtagcaagggagttttcagagctcagagtttcaaattcaagacacacacacacacacacacacacacacacacacacacacaacccgaataacctccaaaacaaacagtggaacaagtgaacaaagtagtcgtttaaaagacaaatgacaagcttgcaatgctggctgaaggggatgggggcgacctgtggtcaagtgggaaaaaattatgctcatgatgagctatttgtgaaggaggaatgcacaaataaaaatgcaggtgacaaaaacctgacatcttccctcatgcctgtgttttcctagtgagtaagcagatcaatctgttatgggaaaggaaaaggaaagctgtcaggcagagggggagagttggcaggcagttcattggaattcacagaataaccttttaagtcggaaaactaaactccatgcaagaaatcagagtagtaataggtgcttgatgtcactgtcaccccttgtacatgctgaagttggaggagttttgcctgctctgagactgtggtttgctctcctcggggtgctgcaccgccttccaggtggctgctgctcagaaaaacagtgaacactgctgaattcatccccgcagttgtttggttacacatggagataaaacccttgggagagttagcgagacatgccattccgtttagcctccagattgctgcctcccacctggaatccgagtctcagggctggggctagggagccaagatcttcccaatcaaacttcccattgagtgacaggaagtcacttgcctctgcctgaaactttccagggactaagagctcaccattctgtaaagcaaagcatttaacttcttatcagctctgatgtggtaccagttttccttacctgaggctagtatagtacagtagttaagcccttgtgttctatagtcagactgcctgcattcagaactggtgctgctagctccatgttagccctgtgacctgggtcaagtttactagacttcttggactccaagttccctcaactataaaaatgagactaatagtacaatgcctgccatatactaattgctaaataaacactagctgtgatttgttagtacatggttgctctgaaactttcttccattgctcctggttctaaccgggcaactgtacagatacaagcctagtttgtccttttcatgacagccctttcagatctgtggctaagtaagcatctcttctcaccctatgttttccactccaagtttttttttaatctagatacaatatcccaactctttcagctttttttcactatccttcttcaccgtattcttgaatacttctgtttgtcatcttcctctcctcccaaactgaacatggtgctggtgggaggtatggtcaaacaaggacagaatatggcaggagactgtcactcgcctcagtcaagattctttacttccagtagtgctgtagctgaaatttgctttgggacatttacaatagactggtgctcagtttacaatgggttaagacctctttgatactaatcatttaccttcaggacaaccagccaatttagaggcaagctgaacctgtatagagaataaaggtttccaaactgcacttggatcaaaataaatattttgaggctcaagcagttatcactatgttgtagatggatgtgcgagtttgtgtatcaagtgtcttggagttcaaatcaacatacatttattgagcggccgcacttagtgtatcaaagacaaagggcaaaatgacataaatatgaaaaggaaacatatctcggccctcaaagactcaacagctaggtggagaaatgggaaatagacgaataattgtatggctacatatagcaaataatacaagaaacaaaatgttatgagagttcagaagtgggaaaaatgagtttcagtttgaggcatctggaaagattttgtggataaagactttttgtaatggaacataaatataagtcaggctattgacaggagttatttctgccaatcctacccccaactgcaggaaatctaattggtcctccagggaatttgcaatcaagataattttttttttaagacagagtcttgctctatcacccaggctggagtgtagtggcttgattctgactcactgcaacctccgcctcctgggttcaagtgattctcagcctcccaagtagacgggattacagacatgtgccaccacacccagctaatttttgtatttttaatagagatggggtttctctgtgttgaccaagttggtcttgaactactgacttcaagtgatccacctgcctctgcctcccaaaatgctgggattacaggcgtgagacatcacgcctggccaagataatcttaagtcatatttttatcttccaaggacatattttagagggtgggaatgagaaatggccagcactgctggcaaagactttcagcccttccctcccccttgcaggacaaaatcagggctggcattagaagttgagggtcaaatccatggtttccacatggtgtcattatgccaaaaagcatgtgtaatagttatttattgctatataacacattaacaatttttaccagcctaaaacaacaaaaatttattatttcacacagtgtctgaggatcaggaattcaggggcagcttagctgggtgtttctgactcagggactgtcgtgaagttgtagtcaagctgtcatctgggcctgcagtgatctgaaaacttgactggggctggggaatgtgcttccaggaaggctcatccacatggttgtggactggaagcctcagttcctcaccatgtgggcctctccacagggatgccaggatgtcctcaggacaaaatacttggcttccttcagagtgatgagagagggctcgctcttttataacctaaccttggaagtgacatgccatcccttctgctatattctattggtacaatgtggaagtaaactacacaaggatgtcaatgccaggatgtggggatcattgagagcaatctcagagaggggctaccttacctctcacactctaggatgaacagcagtccaggggcaaaacagtggttgacatgaagtcttgatatagacatttttgcctttgggagggagtctacaaagacaagatcagaaagccagtaatggccctggggttccttgaaagtagtatctctcatgacagaagcaggcctgagtcagggcattggtgacagctggtgaaagaaaccaaaaaagactgaccttcttcttctggcttaggattcttcatttttgtgtttcactgtgtgatgaaggagagtgtgcgggagcagtggcagatacacctctgctgtgggtggttgcgattggataactcttctggtaagatgtcagtttggatgaagttttgaatattacatgttttacaaaactgatcagattaatttgtctcctaacttgagtacttacagcatatcagcatcaaaacacaggctgtttccatgtcataaaaatgatttgtgcttttgagctgagatgagtgaagtcaagtgaagaatgtgacttgggccatattttaaactagggatgcttttgttttggcccagattccctggattgcttaccttcactgtcacatcagtctcaattcaattaaaagaacactgaatgcgtgcctactgtgttccaggcactgggtctcaggggcttctggctggtagccaacagtgggttgagtggatgtaggaagcaaggagtggtggtggagatggagagaacttataaacattcctaagatgcctggccagtgggctgtacaggtgtactgatggcccacgaactgggggatgtagtgaactcagatgttgcctcttagcactggtgcttcccttgagaatgtttccactgcaggcaaactgctgttctatgtatcaaaaggatcttccattcaattcaggcagcttctctcagtctcaatacaaagcctaatccattttctttagtgaaggcagcacttgaactctaagattctacaagtagcactgagattccccccattccccactttattttattttttttcttccagtattttattttatttatttattttttttattatactttaagttttagggtacatgtgcacattgtgcaggttagttacatatgtatacatgtgccatgctggtgtgctgcacccactaactcgtcatctagcattaggtatatctcccgatgctatccctcccccctccccgcaccccacaacagtccccagagtgtgatattccccttcctgtgtccacgtgatctcattgttcaattcccacctatgagtgagaatatgaggtgtttggttttttgttcttgcgatagtttactgagaatgatgatttccaatttcatccatgtccctacaaaggacatgaactcatcattttttatggctgcatagtattccatggtgtatatgtgccacattttcttaatccagccagaatctacaatgaactcaaacaaatttacgagaaaaaaacaaacaaccccattccccactttatgctggccatatcagcaacctgctggtccttgtgctctgggaaaagcaggcatccttggtatgtgaattgtctcttcctataccacacattacagtacaaacctacttcttacaacttcatagaaaagctgactccttcaggtacccggaatgaacactgtgcatcaagctttgtttttttgtttttgtttttgtttttgtttttttttttgagacagagtctcgctcttgttgcccaggctggagtgcaatggtgccatctcggctcaccgcaacttccgcctcccgggttcaagtgattctcctgcctcagcctccagagtagctgggattacaggcatgcgccaccccgcccggctaattttgtattttttagtagagaccgggtttctccatgttggtcaggctggtcttgaactcccgacctcaggtgatccgcccgcctcggcctcccaaagtgctggaattacaggcgtgagccactgcgcctggcctaaactttgtatttttaaaccaggttattgaagtgtaatttatataccatacaattcactactttaagtatagaatttcatgagttttatatttttaacttttcttggtatcatttcagatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatggtaagaaaaaaaggctgtgttgtctacatttatattccagagatattgaattaatgtgagaccacatactgggtcttggatgatacttcctcttcaaaactaaatgcacatgtgcatgtgtatacctcgactcattcttggctgagaaagtgtgtatagaagcatagaaatgtgtacagaagtgtgtataggtgtttctgtgcctagtaaatttagtaagtatgaatgtgttattagactaatagaggaaagaagagatgagaggttagaaaattcatgagtaattaaaaacaattgtcacagaccattaaaaccagaaggaaccttagacattgtctagtccaatccgttcattttacagttgaggaacctcaatcagagaaaaggaaaatgccttattgacagtcactgagcccatctttaccatccagtagaactggggccagtcactcagccctcagccatccagcagaactggggccagaattcaggtcttctggctctcagggctagtcctatcaagaaaacagagatacacatcactcttagatgctgagcttcttccataggaagccatatttctaagctgagacagatgttcagttgggaatggggtgttgtacctaattatgtaaaaagagaaagtgtaggaaaaggattggcctacaggcttaaagtaaagagaaaggcaaagtgagcaagaacttaagaacttcaggatgatactgtgatgagtctgcattgtgtgcttctagttagatgatagtgcagtggtctttggttgcctttctttaagaccaaagtatactccagttcacacacactttggtggcctggctgtagtcattctcctgccttctcagtgctggaggtaggactgcctcattcgctagtatttttctttatgttggctccaaaaaccagttctatgtccaagggctgaaggcaatctggaagcagcatggtgggttaaaaaagcatcaaacttggagttggaaggctttggttcaggttccagctctgtcagtcactctgtgaccttgagcacatcacttctctgcttggagctacattctttctacctttcatatgaggggactagaatggataatctcttaagtgcctgccagtttcaggaccgtgtatggggcaacgctattttccagtttgggctggttgactagtgtatagcatctcagtctcccatctttgtgtgggaaagttagtgatgcacatgagaaaaacctttccctggccacaagcatttatcaaactctggccaagtaacctgtggatatgtcttggtgctcatataaagtcactggggtgccatgacatagacaaggcatgggttgtgggagctccttagtagataatagttggggctggttggaaaataacatttttcaagagggttatttagcattggatttcttgatgtccctggggactatttaattagcaaatatacagcccaatgtgtacatattttgcttcagaggatcagtagcaaataccatatccaggatattgatgttgtcttaccaagcaatcgacctggaaaaccaacattaaagtgctcatcagttgagaggaactgagccagtggggcaggtagacctgccacaggttctaaaactgaaatctgggtccttccattgtactagtgacagccagaagcttgattctattagcagagagtgaaaaatcatgccctctgtaccaccaggcattctcaagcttgagaaatagccaaactttcagtgcaagaatatcaaatatgtaaggggtataaatgtgtatgttcacattttatgtcatcttctcttgaaggcctccgagtttgtacataaatatcctctcctaggttaaggttaaggtcaataatgctgcctcttattcacaatgtaggaagaacatatgcactggttgtccaaacagtgctgtcaggatgaattaattcaccccggattttatataaaacagtccaaagaaagcaccatatccttcccttctcttctaattgctttattttttccttcatttgataaaattttcttatgcttctactatgtgcaaagtccctgatgccgcagctgaaaattttctttttttctttactgcagatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcctatttgtcgttatacttatttcttttttggataagatttcaggttattgttatgatatattagaggagaaatttctacagcattggaaattttgttttaaaagctttaagtatacacatccttaaaaaaataaaaatcaagaccaggatccttacttccctgccatgggagccaaacaatttcaggtggtcaaagtttcaggatgcccagttggcctgaaacccacagaggaagtagataggaagagccacaaggtcatacattttggaaaaatactctgccctgttggcctgtcatgacaaagcacctgagatccccattattcaactcacacttttgattgaagctcttattaaaatgtaaacatgttttgtggaaagggtgggtcatcaatccacagacacccataaattccttagtaaggatgaatttttcagccaatacagcccttcaaggaatagcaagcagggtcctgaggaataaaacagaacagaaactgttcaaagctggtggttctctctaggaaggaaaggccaggttggggtgagcagaacagtagagggatggagtgcaaaaagggccacccaaaggcaacagagtgatcaatgaagacgaattttgccagctttgccttctgtggcttcccagtcaggtgtgctgctcacatttgtccttggatagaaataagtaaaggaggaacattctggaaggatacacaagcaactggtatcagtggttgccttcaggaagggtaacagggtgtctgggggcagaggaggaagagacatttacttttcaccctatacctctttgtatcttttgaatcttgtattgagagaatatattactgcttggagcaataaataaatgaatacataaataaataaggataaccagacccttccagtgagaaagataaacacctacatttcaataccaaaaatcaagttccccaggacccttgtgaatatatatgatgcagtgggctgtggagacagcagaattgggttcaaatcccagctctgtcactttctagatgtgcgacctcgtgatgtaataatgatcatgcatgcatcctaaaattgaagtgaaactgaaataagatgaggtctgaaaatgttctagcacagtgtaacacagtatatcttcactcctttctctttcaaaccccaatcagcttaccactcatcccctcatggccccaacctaccatgtctaccccattaaaggtatcacattgatcttctaagcaaaatttaatgctgactaccaaacagactacagcactggtgccagtcactggtataaaactcctaggtctccattgttccccctaacacctcacataatataaaaattaggttggcccttaggcccccgaatatctgccatcagagtcaaatccattgttccccatgtggctccatgtgtacttttttggtagggaaaggtgagtgagtgtgtgtgtgtgtgtgtgtgtgtgtccgtgtgtgtgaagggactaacatgaataatgatcaaagtgtcttgaatgttacatgtctttgaaccgaaatattaagtcactttcactcaaaaatagatttaaggacaagacttggttgcaattagcacttttacaaataaatgcattttgcaagtgatttgatttgggggatcattttggctgttaaaatgcccatgattgtatttattttcaacaagtaataaaaccttgattgttctgctgctgctggagtgataaatgtacagcctatctctaatgacctgacagactgtcgagaacagaaacgttatttgatagaaaagttcatgattcctatcatgacaccccttgctaattaggaaaacacaggctttctgcaatttcaaaggcagtttgaaattgcagggaaaacactgattaaatatcttactggcatcctttggcttgcttttcctgggcgcacaaaatgactgatacttgtgtgaaggtggacccaagtaattatggaaaaaagaccctagaaactttggactgctttcaatcaacaatcaactcccaagtattcacagagtcctgacatggagggaaagatatagacacatcatacttaggccactacctccagcagtttactgtatacttggggagaccagatgcatacactggaatagtgaatgattagagcaaggatatgatagaagaaagtgctttacaggtaggaagtcacagaggatttagtcaggctgagagtagggtattccaggtggggccaatggtggcgggggtggacatttgaataagacaggactctatttctcaataccacaggcaaattgtctttattaagcattgatcagcaaatttacaaagccccctggaacctcagggcatggacttttcattctctgctgcaccctgggtaccctgtgggcaagtggcaaacactgaatggtactaaactctctctgaggcatgtctgaggaagctcctgcgcagaatcctaatccttatcattttgtccaaagtcccaaagatgacagtgaccatctgtgatggcccacttcccctgtacccaggaatatgggaaggttggggagggggcagaaagctaagaggaggtaaggcttgtatctctaatagctcaagcctatgatgtgtttctggtcctgaccttcaagcatttagggtacacaaggagcttggagcaacgaaggaaggacctaattatacctgtcttgattaggcaaaaccagtggaatggattaaatttatacttataatgtctggtaactcatagacactccataaatatttgtcacatgcctgagtgcataaatggtctaaaatacatgagcataggaaagcaatggctgacttttcctaatctagggtttgttatcttagtgctgagtagacctacgctttccattattatataaactccattagggcaagaaccttgtttgtattttttaccattgtactctcagtacctagcacaatgttttactctaggttctttggttgccagccacataaaccaaatgtctttgagctgacattattgtcagttctgactaaccaaggggacttgttgaaagtgttttgggaattcaaaacatttatgggaaagttaaagaagaggtctagacattgtggaagacagtgtgaagattcctcaaagacctaaagacagagctaccatttgacccagcaagccaaatggtatatacccaaagaaatataaatcattctattataaagacccatgcatgcatatgttcattgcagcactcttcacaaagagaggaatcaacccaaatgcccatcagtgatagactggataaagaaaatgtggtacatagacaccgtggaatactacgcagccacaaaaaagaaggagatcatgtcctctgcagggacatgggtgaagctggaggacattatccttagcaaactaatgcaggaacagaaaaccaaatactgcatgttctcacttataagtgagagctaaatgatgagaacacatggacacatagagaagaacaatacacaccggggccttgcagagggtggagggtggggggagggagaggatcaggaaaaacaattaatgggtactaggcttaatacctaggtgatgaaataatctgtacaacaaacccccatgacacaaggttacctgtgtaacaagtctgcacttgtaccactgaacttaaacgttttaaaaaaagaaagaagaaaaaagaacagggcttgaaaaaggacaggagtctacaaagcaggaaccatagtgattgtctcctaacagggaagtagactcatgcgggcgccattactgggaagaataaacagtaatttctatgctcatactactagcttaagactcaaaatcctgtgagcctgtatctaatcagctgagcttaaattttgtgctatactgagcagtgagaggaaggatgtggcagaaaaaatcttcaggagcactttggttttgatagtggtagaagtatgaatttaccatcccaccaagaatatccacaatggggaagaagtcattctacaaaaagaaagtagggtgttaggaatgaatgagtaggtaggaaaaaaccccacatgttcacctcacacaatatagaagtggatatactttggttgaatgataactaattcagtagcatccttcttcagtgagggtgggatagtgctaagaagaatagatctctcccctaccctgaggcctcattcaggtgagaggtgaagccagctggacttcctgggtcgagtgaggacttggagaacttttctgtctagttaaaggtttgtaaacacaccaatcagcactctgtaaaaacgcaccaatcagtgctctgtgtctagctaaaggtttgtaaacacaccaatcagtactctgtaaaaacacaccaatcagcgctctgtgtctagctaaaggtttgtaaatgcaccaatcagcactctgtaaaaacggaccaatcagtactctgtaaaatggaccaatcagcactctgtaaaatagaccaatcagtaggatgtgggcggggccaaataagggaataaaagctgtccacccgagccggcagtggcaatccactcgggttcccttccacgctgtgggagttttgttctttgctcttagcaatgaatcttactgctgctcagtttttgggtccgcactacctttaagagctgtaacactcactgcgaacgtctgcagcttccctcctgaagccagtgagaccacgaagcccccgggaggaacaaacaactcctgaagcgccatctttaagagctgtaacactcagggggaaggtctgcggctccactcttgaagtcagcgagaccacgaacccaccagaaggatgaaactccagacacagctgaacatctgaatgaacaaactccggacacaccatctttaagaactgtaacactcactgggagggtcgccggcttcattctggaagtcagtgagaccaagaacgcagcagaaggaaccaattccagacacataggtattcactagttacgttttaagactaaagtgaatcaggatgtgctgagagagctgaagtgttaaagataagcgtcccagaatgatagataagagtgctgttagaaaaggtgatctttagagatactgggtacagaagttggcctcactctaaggaaagccaatgtattaaaatgagctttattgtttgtctacgttgtcaccttgccatgtctctccagacaagcacctcttcagccccaatactaggaaatattccccaaacctccattctgcaccctaattacttaagcccaataaagacccggatcatgcaggctgggaaagtgtgattcattataaagtatacctttatgtctttgcacttgaaagggcatttttttaattacactttttgaaggtgcttcaccataaagctttttatgagttcccttaaatatttgaaaatatattttgatcccaacttccaggacctttcagctctgattaaggagtgctctgttgtctgagaaggaaagctaggaggagtgttacttccattctccacctcaccaggctaatggcattatgttcacaaagtgagattcctaaaaagggagaggcagaagaaatcaatattaagtagtaacttcaaatactgaaaaaatttcatctcatctaaatgcgtaagaaaagtacagatgtttccttaatatatgcagtcctatgcaaatgattatgtaaattaaacaaaaagttgggactggcagattcccaagtttgctaagacttacttatgttaacctagaattcatcatagaaacaagggtaaggattgttgtttacatctccttcacttagatgtgaggggaggcaagattgaaggatatgctaccttaataaagtgaagacactcaaatccggggacatgctagatagatggttagatgagtagatagacagttttcaccttcaaaatgttagccaactcattcatcatgctcagttggttgtgggcagcaatgggactagaaatggaaatgaatctgagttggagtgaattttgatgaaggcctagttcatgcaagaaagatttttttcttttttacatcctcagctcacaaattccaagaggaatggagaattttagagacagttacaggggaagaataaagacctagtgtaacgggctatatcaaatcttcatgcactggccctttcagaaggagagacataaagatatactttatcatggatcgctctttcctaccctgcatgatctgggtctttagtggacctgagaaatcaggtttcttaggtttctaactatagatagatagtaactaactatagatagacagttaggtttctaattacagatagatagatgaatgagctggctaacatttttaagttgaaaactatctatctatagttaaaaacctaagaaactggggctggtgacagtgcagatagtgagggatagaagagaatttttctcttctctctgcctcctttagacctgagtctagaaatatgagcaggtaaaggtttcagagaggcttggcagtctttgaatctggtagctctctaagtccagcatgctagtcattatgggcacttcctctgtgcccatttctatgctaagctccgtagaggatacaatgaagtaaaggccacagtcctacacacataaaaatgggctgtccttcgtgtaataaaacatccatacctacaacagtttgtccacagtaacatatgttaattcttaaaattgtgtggtagagaccttgaagcataacaaatagtaactacttaattactagtccaattccacaaatatttattgagaatccactatacttgatgtactgaacaagacagttcctaaacttgtctggggagacaagtgtgcagtaacaatacactatttgatactttcatatgctaggaagtttcaatttatacaactggcagaagggcaaacaggtatagcctgtttggaaaactgttctgtagtttctaagaaagttaaacacaccctatgacccagcaattctcctgggcatatacaccctagagaaatgcaaacgtgtcaaccaaatatttgcacacaaatgttcatagccacattattcataacagccaacatggtggaaacaaccaaaacgtccatcagcaggtgaatggataaacaaattgtgggacattcatccaatggaatactatataacagtaaaaaatgaactatgcacacacacgacaacatggataaatataaaacatgttgagtcaaagaaaccagacacaaatgagtctggcttctttgacggtacaatttcatttatatgagcagacaaaaacaatcgatgattatagaaattggaatagtggtgatctctcagggagaagtctgtactgggaaggtttaaagatagccttctggccaggcgtggtggctcacgcctgtaatcccagcactctgggaggctgaggtgggcagatcacgaggtcaggggtttgagaccagcctggccaacgtagtgaagctccatctccactaaaaatacaaaaaattagccggccatggtggtgggtgcctgtaatccctgctactcaggaggctgaggcaggagaatcgcttgaacccaggaggcggaggttgcaatgagccgagatcacgccattgcacaccagcccaggcaacagtgcgagactccatctcaaaaaaaaaaaaaaaaacaaaaaaaaacaaaaacaaaacacaaaaaaagccggggggagccttctgggaggccggaaatggtgctttcatagctaagtacacatataaaagttcattcagttgcacacttaaaataatgtactttatgcatcttattgtagtatgctgtctctcagttgaaaagtagagggaaaaccccattcaagctattgagcacactttagcaatgtctatccaaacttcagtgtatataaacttagctcagaaattccacttatagcattctatcctagctcaacaattcaaaaatttatgggcaaggttattcagtgcaaccctgaaatagtgaaaactggaaataagctaaagcttttcaatatcagaagggttaaataaatgtgggctatatatagtatggaataatatgcagctaagaagaagctataccaatttgattaataatacaaatatatccacaatatatttttctgccataaagaaatttgcatgacagtacatgtagcatgataaagtatgtgtaaaaacaaaactttgtgtgtgcatgcatgtccatagttatacagaaaaaagtaaggacacactcctcattgttgatagtggtttacctctggggagaagtattgatgaggctttcactttgtattttacatacttctgtatatgttgaatttttatagagtatctataacttttgtagtttaaaagtttagtaataataggaatatatgcagtgtgatgaatttccctgagatgtaacagtgaaaatgatcaaagggtttttgttgacaaagatgataaattcagtcttggacatctggttttgagatgcctgtgggacattcaggtggagatgtctagaagggagttggatatgtaagtctggaggagagaagagtggttagggatggaaatggagattttggcaatatcaatggtaattgaagccaccttaggagtgaatgcgattcccaagggggagtacacggaggaagaatggaagcaagtaggcccagaaatgaggagcactgagggccaggcataggcggatcatcctgcaagggacatcctgaaggaatggttggagaggtaggaaggaaaccagaaatatgaggtcccatgtaagccaaggaaactttagtgagatccaagaggttgagcagtgaggaaggagaagagggcaatgtagctctttgaataaacgtagccactaagttgcaaaagttggtggaggggtggaggtcactggaggagactgaggttgagaaagttttttaaaatgtagtattaagataagagagagatgaacacatttacatggttaagggaagtacctagcagaaatatagaggttgaaatattgaggggggacataatttagccagtagaacaaggaaggaagggatgggatccatggcacagatggaaggattcctcttagaaggtgaggcactccactgtaacaggaaggaaggtggcaagggtgggtgtggacgcaggcaaatatatagatttggtaatcggaatttaagggagctctcatctgatagcttctattttctctgtgaagtaggaggtgaggcaacctgctgagagtgagaagagactgataagatggagaaggtttaaaatagctgctatagagaacaggaggaagagctaagtagcaaaacagaaaaatttgtaggtctccttaaagatccacttgaggtgagagactatagtctgcataatttggggggattgtgtgggatcatcccctgggagagagggcagaggtggagcatttacacagtgtcaaaatccctcatcaaatgggttaactgattcaaataactagtcaattcagtgaagaaaacatagtggcacaattacttgacacaagagcccaacttctgattactgccccagctgaagcatttggatttaattccattacccaaggttctgcagcatgctggagaaaaggaaaccctaacagtagcatttcatcattctagtcacagctcagaggcagctccctattcgcaccctcacctacaattctttttaaaatggaatgcttctcattgcagcaatatttatggtgacagagagttgaaggcaatccggcatccatcaccaagagagtggagaggcaaatgtggtggatacacgttctcaagtagtttgcagcaattggaaataagagattagttgtacatagagaaacatgtatagatttttaaaacacagtgctgggtaaaaaaaaaaaaaaagaatagcaagaagcagaataatatatatataacacaataccacaatacacagtttacagaaatttcaaaagacattctttcaaactgataatacacattttgtaacaacacatgcaaacaaaaatatcttaagcagaagacaatagttgctaatgagggaggaaggagaatttgagtgaagtgtggggatgacagggagtaaataaatcaagcaagttaccaatgatgataaatgtgccatgagctgagtttgattaactcaaccctctgcacctaaggcactaactaaatacagaaataaatgagttgaaatgcttttctaacctcttgtacattttgtttcaagcaacatctttatcttcaacccataacaattggcccacataggatcagtgttggaggacagtgtgcaggttatctagggctgcccctcacctcatcatttgtgggttttctttgcagctttattgagggataattgataaatcaaaattgtatatattcaaggtatgcaatgtgatgtttcaatatatgtatacattgtaaaatgatctccacaatcaagctaattaacatacccatcatcttacacagttaacttttttgtgtggcaagatagttaagatctactcttaaagtctactcttttatcaaatttcaagtatacaatatggtattcttacctatagtcaccatgctgtacaacagatccccagaacttatttatcttataactgaaaatgtgtatcctttaaccaacatctccccatttctccaacccagtctatccctagattacccccaggtagcaaacccttttactcgttagatcctacatataagtgatatcatgcaatatttgtctttctgtgtctggcttatttcacttaccataatgtctccaggttcgtccatgctgtcacaaatggcagagttttttctttttaaggcctaataatatccccctgtgtatatacactacgttttctttatccatttatctgttgatgaatgcttaggttgatcccacatcttagctattgtaaataatgctgcaatgaacatgggaatgcaggtatctcttcaacatactgatttcatttctagtggatatataccaagcagtggtattgctggatcacatgccagttctattttttgtttttaccccaccacttattttatgaatgaggaaactgaggccctgagaaggaaaatgacctggctaaagtcacacatttagttgcaaaacctggatgtctcctggcgtctactactctttcccctgtgtaccatgcatactcattcagggagattctcactggctttgtggttgtgttgttgttgttgtttgcttcttaaatgaattaaactccattctgtggtttctgcttcattcataattttttaaatttagaaataaaagcaggaaaaaggtgtgtcgtcctgcctggcctacatggcggaagggtggttaaagtcagtaaagcttacctgatgccaagggtgctcaacaattttttaaacctattacattggccaggcctggtggctcatgcctgtaatcccagcattttgggaggctgaggtgggttgatcacttgaggtcgggagttcgagaccagcctggccaacatggtgaaaccccgtctctactaaaaatacagaaaaaaatttagccggacatggtggcacatgcctgtaaccccagctactcgggaggccaaggcaggagaattacttgaaccctggtggcggaggttgtggtgagctgagatggcaccactgcattccagcctgggtggcagagtgagactccatctcaaaacaaaacaaaaaacaaacaaaaataaacctatgacacaatgttgagtactagactttttgttagtacacttcaacagattttaaaaatctaataaacaagtcagtcataataataataataatgttatctctattgtactctaacaatgcctcacaggacctggcaaaaaattgctgtttatcaatatgcctcagccttgtgtcatacttcaaatagaacagttgcctgccctaaccatgctcacttatacgcccaggaggcaagagaacaggcagtctttctgcatacctgtgtgatagtgttctgtgacatttgattttttaagattaaaaaacccaccaatttaacagctttattgaggtataattgatacacaaataactgcacatatttaaggtgtataatgtgatgaattggaacatatgcacacacctatttgaccatcaccacagtcaaggtaatagacatatccaatacctcccaagctttttgtgttctttctttttgtggtaagaacacatatcgtaagatctacccacttaagatgttttgaagtgcacaataccgtattggtaactataggcactatgtcatacagcagatctctagaacatattcatctagcataactgacacgttatacccattgaacaacaaatccccagtccacctccctgctcctgcccctggacacttctttgatgttgctgcacacctcttcccccttacatcgagttgaacttcactgtatattgtattgagtgacatgttcaactcaatattgtctctgagagtcatcataatactttgtatgcttggctgtagcaagaatatattgcttccttggcttccaagaagggatcagagcacccctgctgagaaccactgctccatgatgccataggatgaagttgtcaagggtattggcgttggtatcagagaggctggagtttgaacaccagacctgtcactgtgtaagcagtctttggtaagatacttaagtcttctaattcaatcccacaaacacgtattggatgtactctatgctaagtactgttccaggagcttaggcagtatagtagtggacgaatagatagaaatccctgcctttatgatgcttatgttctaagagggggagataaatgacaaacaattaaataagtatactatgatgtgctaggaggtggtaagtgtcacggattaaagaaaaggtcaagcagggtcttcagacatgggaatgctggggagagggtacaggctgcagtatcaaacagggaggtcaggctatgccttgctgagaaggtgacatctgagcacagaataaaagggaactagccacatgactatctgtgataggtcgaagcagtactgatgagatcaagcaatggggaggtagcagaggatgtggtgaagaatggttgacttgtcaatttttgaaggtggatccatcctaatttcatgatagattgggtatggtgaatgaaaaagaaagatatcaagaatatctacaaggattaagatactacctacatccgagaaagggtataatttggagcaggctttcctttgttcttacccttttaaaaaaattgtaaattggcaaattatacttgttacatttatggggcacaaagtgatattatgatatatgcataaaatactttcttacattttcattgtggggaaagatcaggagcagtgttttggacatatcaagatgccgatttgaaatccttgtggaggccaaatgtggtggctcacacctgtaaccccagcactttgggaggccaagggaggcagatcacttgaggtcaggagttcgagaccagcatggccaacatggcaaaatcccgtctctactaaaaatacaaaaaataaccaggcatggtggcacacacctgtaatctcagctagtctggaggctgagacatgagaatctctaggacccaggaggtggaggttgcagtgagctgagattatgccactgcactccagcctatgtgacagagtaaagactctgtctcaaaaaataaaataaaataaagaaattaaagtggagatgatattgagtaggaagttggatacagaagtctgaagttcaagggaaaagtccaagctggagatataaatttgggagtcataggtatagagatggcctacaaagtcatgagctcagatgagaccacctgggaagtaatagagatagagaagaaatccaatgactgagtcccaaggccccacaatattaagaggtcagagaagaggcacaactggcaaaggagactaaggagtgtttggtgaagttagaggaaaatcaagagattatgatgtcctggaaactaagtgaagaaagcgtattaaggaggagggagtaatccactgtcttaaatgctgcttctgggtcaaggaagattattatccccaagcacttagaacaacacctggcatatagcagccctcataaatgtttgttggattgaattaaaatatttaagtatcttgccaaaagttaggtacatagtgacaggtctggcattcaaactccagtctctctcataccaaagcccatgcccttgatgactccatcatctggcagcatggagcagtggttctcagcaggggttccctgagcccttcttggaagccaacttacagattgagaaggaggaggttattggtgacttaaccggagcagtttttgtggactagtacaggaaagagcctaactagagtgggtctaaggaagaattggagacagagtagagacaatgctttagcgatgtttgctgtgaataataacaaagaaatggggtaataactggtggatgaagcctcagttgtgctcatctcttaggattactgaaagaattaagaagagagtcaataaaaagtttttgaatactgtgctaatacatgtatcatatctatcacatagtaggcactcaatatatggtagccattattttaataatgtttatgctagaattaaaagcatattctgataccatttaaaaccatatagattttcatgtctcagacaaagagatgagtcattgtgtgggggagcaaaacaaatcacaaaatgagttttgctgtagtgcacatcaaaccacttctcacacgatgacctccaaagaacacatctgctgagctttcttcacatttgtgttccctaggatgcagtaattacatgtaactaccagaggcctaggaaaaaaacttctttcaaaaacacaatcttctctcaaaatgagagaagcatctccatgaacaagcatatctcttgaatgtgacagggccataaagtttccttttctgtttcttgtaaacacattattcttttctctctcattcccctaattgccaagttaaatgtcatagaagtaaactgacatgcgagaattttctcctgcccaaaccaatgctccttaaatcttttatagatggtgaacaaacaatattacataaactacaagttatgaaaactgagcaaacttaaggagagtttagttgtgaaacaaagcaaaacttaaaatgaagttattctgacaagtatatattgatatgcataattgttagggtgccatatgttaattaggcgtaagtggtaagaggctggcatgagagattggaattattcttttacacaactgagcctgattgtgtccctcctctttgttaattattcaagtgctaatatttctattgacaaagatgttttccaaacaacacattctttaaaaatttttttttatttcaatagcttttggggtacaaatggttttggttacatggataaattgtacagtggtgaagtctgagattttagtgcatctctcacccgagtagtgtacattgtacccaatatatagttttttatccctcatcctcctctcacccttcccccttctgagtctccagagtccattataccattctgtatgcctttgggtacccatagcttagctcccacttgcaagtgagaacatacagtatttggttttccattcctgtgttacttcacttagaataatggcctccagctccatctaagttgctgcaaaagacattatttcattctttttatggctgagtagtattctatggtgtgtgtgtgtgtgtgtgtgtgtgtgtgtgtatacatatatatatatatcacattttctttatctagtcgtcagtcaagagcacttgtgttggttccatatctttgcatcgtgaattgtgctgctataaacatacatgtgcatgtgtctttttcatgtaatggcctattttcctttgggtagatacccagtagtggggtttgctgggtcaaatactagatctacttttagatcttcaagaaatccccatactgttttccatagaggttgtactaatttacattcctaccagcagtgtataagcattcccttttccccaaatccacactaacatctttgggttttgactttttagtaatggccgttcttgtgggagtaaggtggtatctcacgagtgtggttgtaatttgcatttccctgatgattagtgatgttgagcatttttcatatgtttgtcggccatttgtatatccacttttgagaaatgtctattcgtatcatttgttaactttttcatgagatatttttcttgctgatttgtttgagaaaaacaacaccttctattctgtttgtttctttgcttatttgttaattccttcctgtttcaaaggaaaaggtgtccttcctttctaagacacatccttacctcacctccccagggacctacctccattaatgtcatttttttctcccatcacccaaatctgtcctgctctggtcagcatgcccaagcttctggcatactaaaagtccttcctgagaatctgtctcctcctcaagacatcaactcatttttgtttcttccatcaccaaacccctcgtagtcttcagtgtttcattttgcagccattctttattctcctaaaaccagatctttcctcccctgtgccactgaaactgctctggtgaagataaccaaggacctagtaactgactaatctgctgatttcctttcagcccttatcctctgcaacctcttgtagcatcccaaactcttggcaacccactccatcctgaactctgtcctttctcagcttccttgataccactctatcctggctcttgttggcctttcccagggtcctctcctcagtcttctcctctcctttctctatgttctccctgagagatgtaattcacttctgtggctttcattataataagctgataatttctacatctatatctccagcccaaacccctccactaaactccagccctatatttccaactcctgttgaacatcagcacctacattattcataagcacctccaactcaacatgttcatattcaaactaatgatcttcatctcctcagtcccagccagtgcccaaactagagatctgggaatcattctcaattctccccagtctctggccacccatgtttaatttgttcctcaattctgaaatacctctgaaatccttcctttcctcttctccacattccataggcttggttcaggacctctgcatcttttacatgaaatctcccctccccttctcggcccctaccacctgtactgactttaaccacactgagctccttagtcttctctgaatgcccaataacttttttacactaaagaacagagtctaacctacttttctgaaatgtatttcttatattgcagaaaatgtcatctgcattcaacttacagtatatgcagactccaagccagttatgtgctataactgaatattcagtgcatggaggctctggggcagatgggttacaatgtactttgttgcactaacagggcccagatgagtcccttcaggtctctggctcacctgcttgtgaccccctccctctgcccctctctggaagtattatgcagattatataagagggagactaatgactggatttcattcggggaactcttgtcttgttctgtgcaatggaaatttgtaaaaagaaaatgtccattctcttgcccaaagcaaaatggaaccccacggtgagctggagaaagcaggcttaattccctggcagcagcctttcccggtgccctccactcaccctatttggagagaatagatctgattgcaggctctctcagctcattgttaagaattatttagatttaacaaaagtgtattttttaaagtctctgtctcattgttacatttttctttcagaaaagaaaccctagcacagtacactatttcttacctctttctctcatttctccagccagagcacaactgtagatcttaaccacataattcctgggagattataaggtcttttcacctcccatggtagtctgtgggactcctctttccaaacccattcattcactttttttttttccattcagtctgtcagttcatcagtgagttagcaagcattaacagctgtgcattggccactgtggtagtccctgagacaggcgaaggggagggagatataaatgaaactagaccccctttaaaaggtccacaattcactgagggagataggcacctctgcctggagagacactcttgtcctctgtgtgggcaattccttatctttcgacacttaactcaaatatcacaggcagagttgtttgctgctactctgtgctcccccaggtgttttgtgtacatcttcattggggtgcttgctgcattggattgaatgttctctgttatctctagacagtgacttccttgagaacagggactgtgacatactgaactttagatgtgtagggtttagtacatcagagacggctcaaaccatctctgttgaatcaagtaatgtaagaacagtaaaaggtagccgagctcagtggctcacgtctgtaatctcagcactttgggaggccgatgtggggggatattgcttgaggtcaggagttcaagaccagcctggccaacatggtgaaactctgtctctaccaaaaaatacaaaaattagccgggcatggtggcacgcacctgtagtcccagctactcgggaggctgaggcaggagaatcgcttgaacctgggaggcagaggtagtgagcccagattccaccactgcactccagcctgggcgacagagcgagaccttgtctcaaaaaaaaaaaaaaaaaagaagaaagaaagaaaaaagaaaacagaaaagcaaaaggtaatgttagactgtagactgagttccaatcatattgccgttggagggcaggggctcacctgtgctctaagtgccctcttctccagccaggcaaacctgcttgccattccacagctaatcagggattcacattgctccaactcccagagatcctgctcttagcttatctctccgttggagcccagggcttctcaaatcacgtgggggatcttattataacacagattctgagtcagtaggtttggaagtggggcctgggattctgtgtatctaacgtgctcctgggtaaaagccgatgctactagtccaagaaccacacttcgggtagcaaagactccagctagcttttcctagtcttgggtcttctagtcacctaagtcaggaccaccatgtatggttatgtagaaatgctttgtgccaaagcacccagccaaggagatcagtgctggttgaaatctaaaccatgctcaccccagccctgcactctggtactggccacatccaaagggtggaaggggcacacttccccatttttttccagttcccacaagggttctataagctacttccaccctcaggactatatccattagaagtaagcaccttttctaattgatacaaaggtgccatatggtccagcagccttggccatgggtgacaccccaacccacctcaccatttatcctttgctcctttctgactgatccctcaggaggatggttttatatgtgatttgactcagctccgtctcttttatgtgcacgcctgcatttgctgatatgtgaaaagtaacaggatgtaaaagagcactgtactcttcatcaaaagccttcctttttttaactaacttcatgactacaggcaaagtacataaaccctctgagccttgctttcctcatttatcaaatgagtactggtaagatctactttactggcttctctaggttattgtaaggatcaaaatcagcaacctaagggaaagccctttgtaaattgtaaggttctgtatgaagttaaggattattacaaagggactagatggtatatctttaaatccctttgcaattctccccagctccagagctcagtgccctgcatgtggtggcttcagagcccactactggttga

SEQ ID NO: 5101 - DNA, 115925 bp, human
agtttcttaatccagtctatcactgatggacatttgggttggttccaagtctttgctattgtgaataatgctgcaataaacatatgtgtgcatgtgtctttatagcagcatgatttataatcctttgggtatatacccagtaatggggtggctgggtcaaatggtatttctagttctagatccttgaggaattgccacactgtcttccacaatggtttaaccagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgaacattttttcatgtgtcttttggctgcataaatgtcttcttttgagaagtgtctgttcatgtccttcacccactttttgatggggttgtttgtttttttcttgcaaatttgttggagttctttgtagattctggatattagccctttgtcagatgggtagattgtaaaaattttctctcattctgtaagttgcctgtttactctgatggtagtttcttttgctgtgcagaagccctttaatttaattagatcccatttgtcaattttggcttttgttgccattgctgttttagacatgaagtccttacccatgcctatgtcctgaatggtattgcctaggttttcttctagggtttttatggttttaggtctaacatttaagtctttaatccatcttgaattgatttttgtataaggtgtaaggaagggatcccgtttcagctttctccatatggctagccagttttcccagcaccgtttattaaatagggaatcctttccccattgcttgtttttctcaggtttgtcaaagatcagatagttgcagatatgtggcattatttctgagggccctgttctgttccattggtgtatatctctgttttggtaccagcaccatgctgttttagttactgtatccttgtagtatagtttgaagtcaggtagcatgatgcctccagctttgttcttttggcttaggattgacttggcaatgtgggctcttttttggttccatgtgaactttaaagtagtttttttccaattctgtgaagaaagtcattggtggctttatgtggatggcattaaatctataaattaccttgggcagtatggccattttcacaatattgattcttcctacccatgagcatggaatgttcttccatttgtttgtgtcctcttttatttcactgagcaatggtttgtggttctccttgaagaggtccttcacattccttgtaagttgtattcctaggtattttattctctgtgaagtgattgtgaatgggagttcactcataatttggcctgaagtctccttaagctgataagcaacttcagcaaagtctcaggatacaaaatcaatgtgcaaaaatcacaagcattcttatacaccaataacagacaaacagagagccaaatcataagtgaacgcctagagccttttctacctcccccagctgcaacattaaatgcagaatctttgcttactgggctcatatctattaatgtgacctgttccaactttaaaacagaaactttttgaggggagatagagttatctgttttgtttgctgctgaatccttagcatctcagggtgttgcctgtacacggtgggcactcaaatgattgcggactatatgaatactgttatgcttgaaaaataagttgcagaagaacaggtaataatagctaatacttaataaagcatttattacgtaccaggtagtgttttaagtgctttacatgtattatctcattgattttatacaaataatagaggtggataccatcatcaccattaactcatgatcatcatcatcatcatttccatgttgcagatgaggaagctgaggcagtgagacattaggaaaaccatgtagtatggcttcagagtctgttttattagctactatggtgtactgtctctcttgtggtatggccccttttatagtatgtttaaaagcatgagcctggtgcagtggctcacagctgttattctggcactttgggaggccaaggtgagacggttgcttgaggccaggaatctgaaaccatatgggcaatatagcaagattctatctctacaaaaaatacaaaaattagcaaggtgtggtggtggatgcctgtggtcccagctactctggaggctgaggtgggaggattgcttgaggcaggaatttgagaccatatgggcaatatagcaagatgctatctctacaaaaactacaaaaattagccaggcgtggtggtggatgcctgtggtcacagctactctggaggctgaggtgggaggattgcttgagcctgggaggtggaggctgcagtgaaccttgattgcgccaatgtattccagaatgggcaacagccagactctgtctcaaaggaaagacagacagacagacagacagacagaaagaaagaaaggagggagggaggcaaatttatgtgatgtttaaaaacatgtagtatcattatgcaaaataatactacacactgttaagaaatgcccacatatgtagtgaaagtataaaggaatgcatgggaatgacaatgagcaggcaatcattggtagttgggtggtagtttttaagttggcaatcaaatgtaagtaaaattgtccttcaaaatctcttaaggagttgtcagcatagatgattttttcctccagcattggacccttttgctgtttctatggttgagccccaaattcaatagctggcttgctattccccaccaattggcctggtgggatgctcacaccaggaaagggagagggaatgaagatggcttggaccttcaacagattaagggtcttttctagtgttagaaacagggacagagttgcaacaagtcaatcagctcagccctctctgtgggaggacaagtaaatcagcagagccatatggctatctaggcctttgagtttccaggcatggatggctcataacatcccgtgatagccttttctggtgcttatcaattcctattgtcaataatgacttatttatatctatctcacatctcagactgcaatttcagccaatttcctacttctctgtagatatggagagcagatggtcaacattctcctcataaccttccagggaatggaagatacccgttgaagccctcccaggtgacaattgttttcctgacaaaagagttccaatttctttttttggtacaaatttaattttctagtcaattatttcatttgtgctatgttggatttttaacaaaacatagtgtttttctttgaaaaaaaagaacacatgcaaatgattacaattcttaccgtacaaaagcatgttcagtgaaaactgaggtttcctcccacccaaaacccctcagtttccatctctagaagcaactattcttaccagggtccttttccagagatatttgatgacatatctaagtatatataaataattctcctctaaattcttttcttcatttcagcaaacattaattaagcacctactatgtgtcaggcactgtgctaactcctggggcagggcacagaaagaacaggatgtgtttccctgtcctcaggaagcttacactctagtaggggagaaaggcatagtttatgaagtattgattgagcgccctctatgtgccaggcagcatgcgaaccactggagaacatagagttcctgccctaccagagcttagtgttgtgagggagacagaccaatgagcaggcatggtgtgaaatataaacacatgccagggaagtgtcaatatgtttcttggtaatggctccacatcttcttgtaggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgaggtgagttccatggtcagcattttacaaatgaggacactgggggctccagagaagttagggaactagccacaagtcacacaggtgggactcaaactcaagcctgtctttccacaaagcctaggttcttattcactactctgataacagtttgtgggttttggggtgaatcatggattattccaatacacctcctccttctccattcccctgtgaagaatcctggccttaagctgggtcgactcagcctcctattagactgaattttctgttgaagatatgagatgaagaggaaaatgcactggtttggtagtcaggacaccttggttctagctcctgctttacctttcacaagctctatgactttggatgagtcattctacccttgggaccccaggggcctcacctgtaaagttcagaggctgacagggatcatctctgaatcctccacgggattttggtggtatttctgtcacccctaaggggctgtaatgacaccttctgggacaaaaacaacatccccttcttgagacgaacataaagccagttcaataaatctatttactttcaaggcgacttgaagaataaatgtccagtgagggtaaatagctggcttcaccttacagatggagtaagatgtgaatatgttcatgcctctttggcctttgctttctgctcatagttctgaacactacacctcctcctccccactttcttagtaaagtgaaatgagccttagtcaagtaaacaagtacccttttaatatatccaatttaattaaagcaataatcaactaggaactgaaaataatccttagtgaaaactgggaaagagccctcaaattaatgggttattgcagggttgtaataatctgagaactttgcccatgctgattttatgctcaggagagcagccccatgacgtgctacaagccgcaaaaagaggatctacccggatcaataagccccataaagctaagagcagagaggctggtttgatgcagaaaagaaggtgactgaggcatggacagcagaaaatgagtctcctgtttagtacttctttcatttcacatcaaacataggaatttagagacaagatctggtcatttgagggtgggaagttaaaagagtccagttctcaggtaagtgtttctcttcctcccttcctccttccctccctctttcctttccttccttctttccctctttccccctctctccttctttcccttaaatttttctgaaccacaaaattaagaaatacgcatcatgaaataaccaaattgcttgaaattgtgtgaggtataaaattcaagtctttaatcctcaccctttctttctcttttcctctttctttacttttcctccttccttccttttatgttttttcaaaattatgaaagtaatgtatgctcattgtaaaagcaaacagtacagaatcacaggaagtataaaggaaacatttaattcccatttttccttcctatctctttcctccccttcctatcttccttaccttcctctctctctccctttcttcctttctcctttcctttgatttttaaaagtatgtaactaatttataatctttgtaaaataaccagacagtacagaacagtatggaaaattcctcatgccccatcccctttcctcaacccaccttttcatgccttatatatagacttaccttattcctttttttttttttttttggagacagaatctcgctctgtcgccctggctggagtgcagtggcatgaacacagcttactgcattgtctgtctcccagattcaagtgattctcatacctcagcctctcaagtagctagaattataggcatgcgccaccatgcccggctaattttgtatttttagtagagacagggtttcaccatgttgcctaggctggtttcgagctcctggcctcaagtgacccagctgcctcagcctctgaaagtgctgtgattacaggcatgagccaccatgcccagcctttattccttttaatggttgcatagtattctgttgtgtaaatgtcccatgatttatttattgggcaccaggtaagtttctgaaacataccttgaagttgttataaaagtttaggggaaatggaagaaaaatataaattggattacttgctgctgaaaatcccattttatagatagcaatcatatccatttctatagcactttatgctttgaaaattgccttcgaaatatcatctcatttgatcctcttcaagagcagctctgagaaatatgcagattattatctccatttttacagataaggaaactgagtcccagggaaattaaggaacaaaaatatgtatggcctcacagccagttactgattctcagcctagtcctcttatagcactataaatttaagctgcatttcattttgcaagtcatgaaagatttagacacccccttacttctaagctcatagtttagaaaatccatccaactcatacaaattcccttattattctaatgagaatggtggtagaatccttggtaaatatgaagagcctgattaatggctggcattcatagcaagctcaagattcatttgacttcctaattggcttctgttacattaaatgtaaagtgggtctattcattccaaatcccacttggaggtagaaagaaatacaatacgttgcattatcctatagaaaaagaaatgtttaaatcagtagtaaatcattcagaagtatatttcatttaaaatcagaaatgcccatcagcaccctactgccaattttctgtaacatgtttcagtaggatttgcagttttaacaccattttgtttggagaaaagagggttttaagtgcattttccacataagacactatagttacaattaattaaggagagaagctgggtgaacataatgaaatggtgattagatttctctaaacagatctgttttaaaaatacaaatgatttgatgagttacttttgtcaacaaggtcttcttgcataacattccttcaagaaatttaggatcattataactacaagtagttgaattgaagtttgtgcattagggttgaatatatcacattttggttttttgtttgtttgtttttgagacagagttttcacttgttgcccaggttggagcgcagtggcgcaatctcggctcactgcaacctccgcctcccaggtccaaggaattctcctgcctcagcctcccaagtagctgggattacaggtgcccgccagcatgcccagataattttttttttggtatttttagtagagatggggtttcaccatgttggccaggctggttgcaaactcctgacttcaggtgatccacccgcttcggcctcccaaagtgctgggattacaggcatgagctacagctcctggcctcacattttgtaattatgcatttaatgtctgtcctccccacagggctaactgtcctatgatggcagagatgtgtgtcttgtcttctcagcactgtattcccagggagcaacacagtgtccagcacatagaagggattcaataaaatttattgagctagtatatagataaatccatcagtgaggtttcagccaggctgggtatctctggtaaatgcctatcatgtggttggctgacatgactttaagcaataggaaaaaacccttaggtggtatgcaaaggagaagtgtggtcacatacgcttagaaattgtattttctgaatatctgagctgggcatatttttgactttttaaacacagacttagacaatgaaagaacacatcatatatcagaagctttatggattgattctcatgtcgagttttatctttctctcaggtaagaaaatgtattcttattatctctttcaatgtctcatgtatagtaggttatagaaataaaccatttgaaaaatactaccaatggagatttgctgggctgcctcttaatggtcaccttttggtcaatatggctacagaagaagctgaagcatcagtaagtgaattaattcattcatcattctgtactactgatagagagctggcctcaagaaggcagtagcttggactactacctttgacatttcttaaagcaactctgaaatgccatttggcggctaatgcacacctaacagaagatttgggttttcttttggactgtttcctctcctccgtaatgctttatttaaagctgtctgaagcattgtgatatcatctttctgtctccattatatgtatatggcaagaatcatagaatacagatggggaaactgaggcatgcaaacagctggtaacagattcataaagcaatgggcatatattctggaagcacccagaccttccctagactctatgacaggaatgaaaataatttgtctctattttacagtagataattaagacaattcactgaagtagctggtaatttggagacttcaggagaaggtcttggtaaactgcaatcttgtccacattaagtaaattcagtttgtagcattgcttatttagcacataagtacttagctaaaaggtcataaatgccagtgagtgacaacgcctgatgaaattgacctgtgtttaatttgaacggtcctcaagcgtaagagctaatctgcaaaaataccaaatcatcattgccatcaagagcaaacactggcttcttgctgcatgcagagcctgataggaaaccatgtttcttataatagagattgaaatggggcctacggggtacagtggcaactttgtcacctggcctggcctacctgctaaaaagttgatttatttttcctctacctgtttcctcaagggcaagaaactgtattttcccaatttctttatccaaagcatccaacacaggccttgacacacagtttaggcacttggttcatatgtgctgatttaatgaattcatgcaatttgaaatgatgaaaattttcaacatctgtatggtggtggggtatatgacacaaactccattggtttttgtgaagggctacagggcatggtatagagcaatctagaatagtggaatatgggaatctagtgtagtcatggaataaaaagtgaagagtgtgtggtactgaaaagtttgcatgggtttgcgaggaatgtcaccactcagtgaaaattattattattgttattattattattattttgagacagagtctcactctgttgcccaggctggagtgcagtgacgcaatcttggctcactgcaacttctgcctcccagattcaagcaattctcctgcctcagcctcctgagtagctgggattacaggcgtctgccaccatgcccggctaatttttataatggtcagtgaaaattatgatagatgtgcaggtcctcaacctgcagaggtcaatttaaagcagtcacaaggttttccagactgtttaagtctcaaattcatgagtcaaacaagttttttttgtaggttatcaaacattgaattataattgttctttgattgccgagaaattcattacttttttcttggaaaaaaaagaccctgtccttggaaacaacggcataactcaggttcagttcccttcaggctccagatgagtcaccagcctcccaactgtgagggtcattattggggagagattaaggccagattaagtggagggtgactcagagatgctctaactgggaggagccagagtgtggagcaaaactgtctccatagaagaatatcaagggttgagaaggagaagccaaatctgtattaaagtctatggggtgagagcagagccagaaagaagagatgaagactgaggtcaagagctgaatagttgcagaatggagcaggaggtaaaaaataaggcataaatgagagaagagggcctaggacttaggctgtatgtgggactcggtttcctagttctctgtcttagtctgctcaggatgccataacaaaatactatagattggatgatttaaaccatgggcatttatttctcatgtttctggaggctgagggttcaagatcaaggtgccagatgattcaattcttggtgagggccctcttcctggcttgtagacagctgccttctctctgtgtcctcgcaaggctgagagagagcaagagagctctgctttcttcctcttctataagggcactaatcccaccataggggctccaccttcatgccctcatgtaaacctaattactttccaaaggccacaccttcaaataccaacacattagaggttggggcttcagcataggattttaggggagggggaaacaaacattcagtccataacatgattttcctcttaatggtgctggctattggctgtgtaatggatatgggtaggtttgggttgaagacatagggctatagtagttgtcctaaggtcttgctcataccatgtacacacacacacacacacacacacacacacacacacgctcacaccccaagtggagtaggacaggctttgctggctgaaagagtgtaacgtgttctggagcattcttgaggcaggaggctggggttttgtgacattcttgaggtgggaggctgggtttttgaggcacctagcctctacagtcagtaacttttgctcctgtattggataggcaattagtcaatctgggccggaatcaactttcctgagaagttgtcacatatgcagagacgacctgactaggaattgttttgacacaggaaagccccagagccatgtcagaaaatcagtccttaggctgtagagacaaactaggccagggcagtcaggacacagtaggagtgtagaggtaaagaaattcttcttctgaaaggtgtttgtgtagccagggttcaggaaaagccctatcttttctttttttaaaaaattttattttttaaattgtaaatagacacaggatctcgctgtgttgcccggactggtcttgaactcctgagctcaagtggtcctcccacctcagcctcccaaagtgctgggattacaggcatgtcccaccctgcctggtctatcttttcttgagaaactaattccacgagaaaagagaagtggaggataaactttgagcagaaactaaatttctgtatgaattcaagagttgagctgtccaatatggtaattacttgcaacatgtggctaggttttaattaattaaaattaagttaaaaattcagttcttagtaatacaagccaggttttaagtgcttaatagctacaggtggctggttgctaccatattaggcattgcagatacagaacatttccatatcacagaaggttttattagacagcactgttctagaaggttgtagagactggcatttgagaaaagatatttgttttaaacagctttattgggctgggtgtggtggctcatgcctgtaatcccagcactttgggaagccaaggcaggtggatcacttgagctcaggagtttgagacagccttggcaatatggcaaaaccccgtctctactaaaaatacaaaaatgagctgggcatggtggtatgcacctgtaattccagctactcgggagactgaggcacaagaatagcttgaacccaggaagtggaggttgcagtgagttaagatcgcgtcattgcattccagcctgggcaaccggagtgaaaccctgtccctaaaataaaataaaataaaataaaataaacagctttactgaaatataatttacataccatacagttcacccatttaaagtatacaattcaatggttttcagtatatttagagtggtggaaccatcactactatctaattccagagcatttttataacccccaaaagaaataccatactctccgttcctcccccagcactccaggccttgacaatcagtaatctgttttctgcctctatgaatttgcctattctggacgtttcaggtaaatggaatcatacgatatgcagccttttgtgactggcttcttccactttacacaatgttttcaaggttcatccatgtgtagcatgcatcagcagttcatttatttttattgctgaacaatattcaatggtatggatatacctcatatttttttccattcaccagttgatggacatttaaattgtttctacattttgactattatgaataatgctgtatgaacatttgtgtacaagttttgtgtgggcatatgctttcatttcttttgtgaatatacctaggagtgcaatggcagagtcaaatgtaacttcatgattaacattttgaggagcacgcagaccattttccaaagaagctgcatcattttacatccccactagcagtgtatgaaggttctgatttctccacatcctcaccaacacttgttattgtctatctttttgatcatagccatcctattggaaatgaagtgatactccactgtggttttgatgtgcatttccctatgactattaagcattttttcatgtgtaaaaacagacattttgtctaacaatactcaaagcctttcacctgggaaattgtgcattctagactctgaagcataagttctttctttttaattttttcagatacatatttccttgagttggcacaggcatagcacatttgtctagcataggacagatgaaaaacgctcatatgatagcctgtttgagcttgagcatgtcacttaggagggtgactgaccaccatattctgtctcaggctagtaagttgtacaaatttccttcaacagtaaaaatattgacagggaattgcataggctgaaaagtaggtctgaaacagttttccccatgttgttcaccgcccggaggtggatgggcttctaggatccttggcctggatttttgttacctaggtgcttttgagttggtctatcaaggtagggcttatgggagctgttagcatcacaacatagagatcttagtagagggccctgtatttccactgccaggtaatgatcagtagtctttcctcttctggaaatggcttctctgcacacaccattatgcaaacttaggggctatctttcattcttccctttctctcactctccacatctaatccattgagtcttgttcatgccaccacaaaaatacatcctaaatctgaccgttttcttttcttttcttctctctctctctttttaaaccattttaactgcttccgccatgggctgagccaccatcattttctcttggctgacttcagtagcctcctaatgttctccctgctttcactcttgctctgctacagtctattctccacacagcagccagagtgatcctttaatatatcaagtcagatcataccactcttttactcaaaacttgccaataagttcctatcaaaattagaatataattcaaactctttaatgagacctaaaaagcactacatgatctgatctcccactgcctcttgggcttcacttactaccatgcatcctctttctccctctgctccagacacactggcttcctagtattccgtaaacacaccaagcacagtcccaccaaaaggcctttgcacgtactgttacccatgtctgggtcactcttattccacatctttgtaccctggctcttttttcatcccttgggactaagctaaaaatgactctttctcagagaggcctttcttaactatcctacataatgtagacatttcctttcccctcatctctgcttttcccattacctaactcatcaacctgtcaatttctttcagagtactgtatgtaatttgtgttttttcctttacttgtttattgactgcatctgtccctggaatgtaagctgatgagctcagggaccttgtgtgttatgtctcctctattactgcactctaacactgacacatagtcaatgctcagtgaccatcactgttgagtaaataattttttttcagggagcttctggctttatgagtaaggacatctatttttttgggtgagacatgggccttgaatccaagatttgaaggaaaaatcacatgacctatgtgaggataattcctctgtctcctatgccaagaactcttggcaggccacaaatggagtcagcagcctaggtactagaggaagggatgtgttggacaactctgtggctggtgattggtgacagaaatgaggatcagggttggacgcttctatatctggtaggcctggtttatctaaggattagcctggttacaagaccagtggaaagtgtgggcagtgggtggcagatagtgactctgattctctgtggttgtgcacactatggccatggtgatgtgggtaatggagctccccagtatcaggtacctattgattatatctactcagacagtcatggggctgctagaccagggcctggtctacaaagtttttcagtgctccagaacgttgaattccaaggatttgtgattctaagagccagaagactccctcctcaagtgagtatctgctcacctgcccttttatgagtgggtagtgacacttccaagataaggcagacatggagtagccttggtagaacgctcactctcagagtggccagattcttcaaagtataaacacaactgatgcctctggtgggcccttttcctcaaatctgctctgcagcctcaccttgctctcataggtattaccaggtgattagctgggttctgagccctacacagtgttgagtcaagttgtgtcttcccagcattcatatgttgaagtcctaaccctcagtacctcagaatatgatcttctttggaaatagagtcattgaaaatataattagttaagataaagtcatactgcagtagggtgggcccctaatccaatattattggtatctttataagaagaaaaagtgtggacacacacatgcacacagggagatcaccatctaaagatgaaggcagatatcggggtcatgtgcttataggccaaataacaccaaatattgccagaaaaccaccagaaactaggaaagaggcatagaacagattctctctcacagctctcaaaaggaaccaaccctgctgacaccttgaccttggacttctagcctccaaaactgtgagatgatacatttctgttgtttaaacaacccagtatgtggtatgttgttatggcagccctggcaaactaatgacacagacactgatgctctggcaggctcactgggttagaattaaaaagaggaaagcaggttacctcatggagaagagacagtgaccagatcatgcccagagtacctgaccatggaagaacctcatttgtcctttgccctgaacgtagtgcaggacagtggacctggaaccacagtcccccaaactttgaaacacttgaacattttaaggagaaactttgccttctaagaaagggtagaaaaacctgtataggatatgtctgatgttacttaatgctgtcataagcagaaaacaaagggattttgctgaaaaaaaaaaacaaaccattcagattgtctatctcttagagttttaaaccatttactctctgactttttattttatttgtttatctatttttgagacagagttttgctcttgtcgcccaggctggagtacagtggcgtgatcttggctcactgcaaccactgcctcccgggttcaagtgattctcctgcctcagcctcccgagtagctgggattaaaggcatctgccaccacgcctggctaatttttttatttttagtagagatggggtttcgccatgttggccaggctggtctcaaactcctgacctcaggtgatccgcccgtctcagcctcccaaagtgctgggattacaggcatgagctgccacacctggccttactcactgacttttaaaataaatgtatttattacttttggggtctgacagggacagagaattctcccttgatcttttgctaaaagttccctaaaacagaaggcagagcacgagttcagtatacagtccagaacttctcattctatgccagatgcttcattcctgatacctttgcacaagggacagcactccatctgcccacccattagcctccaactcagtgccctaatacaggatacaactatttattcagtaaacagctacaaaggacctactctgtgtccatgaacttggacttccccatctcaaactgtacatgaaaattaacttgaaatggatgaaagacttaaatgtaagaactaaaactgtaacattcttagaggaaagcataagggagaatcttcacgacctttggtttggcaatggattcttagaaatgacaccaaaagcggccgggcgtggtgtctcacacctgtaatcccagcactttgggaggccgaggcgggtggatcatgaggtcaggagatcgagaccatcctggctaacatggtgaaaccccgtctctactaaaaatacaaaaagttatctgggcatggtggtacatgcctgtattcccagctactcgggaggctgaggcaggagaattgcttgaacccaggaagcggaggttgcagtgagccaagattgcaccgctgcactccagcctgggtgacagagcaagactccatctcaaaaaaaaaaaaaaaaaaaagaaagaaagaaatgaaatgaaatgacaccaaaagcatgagcaataaaagaaaagaaaaattcgatacattgaatttcattaaaattaaaaacttttacacatcaaaagacactatcaagaaagtgaaaagacaatacagaattggagaaaatatttgcaggtcatctatctgataaggttctggtatccagaattaaaaatgggcaaaagacttgaatatgtatttctccaaagagtctatgcaaatggcaacaaacatatttaaaaaaatgctcaatgtcatcagccattagggaaatacaaatcgaaaccacaatgagataccactccataacctctaggatgacaataataatagtaaatggaaaacaacaagtgttggctaagatgtggagaaattggagccctcatacattgctggtaggaatataaaattgtacagctgctgtgaaaaacagtttggctgttactcaataagtgaaacatagagttactatatggcctagcaattctactcttacgtttataccccaaataaataaaaacatgtgttcaaacaaaacaaatgacatgcatgttcatagcagcactattcataatagccaaaagagagaaacaatccaaatgtctattaacgtgaatcaataaacagaatgtgatacatccatataatgaatcttattaagccatggaaaaggatgaagtactgacacatggtacaacatggatgaacattatgctaaatgaaagaagccgacaagaaaggacacatattgtctaactccctttatataaaatgtccagaacaggcaaatccagagacaaaaagcagattagtagttgccaggggctggaggggaggggcaaactgagagtgagtgcttaatgggtacagggtttcctttttggatgatgaaaatgttctggaattagataatggcgatagttgcacaacattatgaatatgctaaataccactgaatagtagactttaaaatggtttaaatggtaaattttatgttatatgaaatttcccagtacaaataaaatggtgcttggcactcctagggtagtaacagccatttaagtgagatttatgatgagtttttcctaacacggaaaacacttatgctatgagtgagaaaagcaggggacccaattttccttacaatatgatctcagcctcacaaaaacaagcaaagcctgtgcacagaaaaaaactgaggaaatataccaaaatgttaatggtgattatctctgagtggtgggactctctggctggctttgttttcatctttttacttgctaatacttttcagtttttctttaagaaaacatgtacagtatcacttttataatggaaaaaacaccttaaaaacagtaaggaagacaataaatgtcatttaaaataaaaggaaacagtggatagaggcgaagagacacagaggagccaaatcaagagagaacacgcttcaggggagcaatcatgcaatttggacttgaaaattgccagggaacagatggcagcatctaagcagacatctgcaatggatagcgaaatcatatgcaaagacacaagtggcctttgaagcaggcccttgagaggcgcggcagagaacgctacttgcctggccaaacataagggcaaagcccctctccaccttgtcacagtctggcctcctcagagccctgctggaggcccagaggctgcggtggggctcagctcagttgggcttccatgtgtgagggtgcaaaagaggctgtggaggaaggaagaggcttctgatagtgaccctggcaaacatggcagctgacatttacatggggttgcacagtttataaacattctcacacacataacctaaatgttagttatgattgcatcatcttttatcatggccctatgaggtaggcagttattatttccatcttactgtggaagaacgaggcatggagaagtgatatgagctatttatttaacttttatatagtgttctctatgtgccagacactgtgctgagagctttcacaggcatctgttgcctatgttcacacagctagtaagagacagaactgggactcaaatttggctttttagacttcactataccacatttctgcttatgtctaagcagaatttacctatatcttcagaatcttaagtaaggccacagtgattctatctatctatctatctatctatctatctatctatctatctatctatctatcatctatctattatctattatttatctgtctacctatccattcatccatacatctctccatccattcatctatctatccatccacccatccatctttatttttctgattataggtgtaatacatgattgtttaaaacatgcaaatatgctgaaataagtaacataggaagtaaaacatttccctaatctcacacctaaagataatcattcttaactgtttaatatgtgctcttccacacttttttctgtgggcatactacctgcatatttttcttttagtttttaataggataatactgcacctgcacttaatataactcctatttcacacaatagtaagccttgaaaaactctccatgactatagaggcctatcttgtttgtttccctattccattgtatagaggtagcaattttcctaaatagtcacttattgatagacatacaggttcgtcaattgttcttgattataaacaatgtggcaataaatatcattgtactctcatctttgtctatctgtatatttgtctaaaatgaattgatagaaatgaaattgctgggtcaaaggatacacacaattatatacaattaagattgccatagataatggcaaattgcccttcagaaaaataatacttaattggcactcccactagcagcgtgtaagagtgactcatttccccacaggcttgccaaagctggatattctgtcttctaaaattctatcaaccaagtaggcaaaaatggtgtctccttattgttttaatttgtgcttagaaatagtaaggtggcatctttctatagtattggcctttatatttctgcttttgtaaattgctttttcccatcttttggcaactggttttaaattagtatactgcaggctgggcatgatgtctcacacttgtaatcccagcactttgggagactgaggtgggaggattgcttgagcctaggagtctgagaccagaccagcctaggcaacatagtgagatatcatctctaaaaagaattaaaaaatttgccaggcatggtggcatgcgcctgtggttccagctaattggaaggctgaggtgggaggattgcttgagcccgggaggtcaaggctgcagtgaaccatgttcatgccactgcactccaacctgggcaagagagtgagaccccccctcttaaaacaaaaaatcaaaaactaaattagtatactgcagagaggagaggcccttgtagaccatatgagattatgatacattctcttttaaggtgcaactaggccctggagatttatgctcaccgtaaaaccagttcttaaatgtatctgacatcatttcagagggctgaacagaaaggcagttaaccaacaataattgagacttgggtttcatatcacttattgtcttgtgggattaactcttgatttattagccacacaaaagatgataaagtaatataatcacagaagccagggacagaagtaagcattttctcattcatcaatggatagttcagaaataactccccggcaggtggatagtatgagttcctgcacatgggagtgtgtgatgcaggtggaatgtatatgagtgtgtgtggggggcaggcatatacatgttattgtttgcttttggaaaatgtccactagaggaatggagggagagaatactatatggtcagagaatatctggaagctttcatttggcggcatctcccagaagcagggaagtatttacttcctgctagcctctgtagtgttctgttatggctgtcactgttttagagtggtggtcccaacgttacaactgtaattcagggagtggttacagttccaattctgccacagagctctttatcttctggcttaggctgtactggcactggaattaggttgataattaggtaatcctcagatatttacctagtagactgggggtgtaagatttgtagtggtgatagtatcatcactcatctgcagcttcttgtgaaacaaagggcatatccaatgtaaagtttcaaagatactgccgaactacttaccaaaagaccgcacccaatggacatgtccttcagcaatgtttaacaaggttttgcatacatcatctcacttaatcttcaaataatcttgtaaagtcatcagggagaggctattatctggcatagactataatgtgaatggtggcccttaaagttgaacgggcatacaatgctgtggccccaaatctccattttactgaagcaaacattgaggtatcaggagggtaagttacttgctcaaagttccacagctgatgagtgtcagggcatggatttcaacccaggctgtctgactccagagccaatggtaactggggtctatggccatcttgaaaccactgcagtgcccttggtgaggagacagaaggaggccatcaggatgcacccagggcagtgccatgtcttccattcctgagtacaaacaagtcccagagtttcagtatcgcccagctggtcattcttcaggcctctgtcagtgcctttcagtgagaagcagtccccagagacagaataaatcagatcatttggctcaggaaaaggcattggagaaacaaattgctgttgcaccatgaatgtaataaggcagttaggtgggcggaaatagttctcttttgattatatgagtgaggattatgtgtagcaaatttgaattccaagctgccttttccttggcctcttccctaccctttcactagccatacacttctaactgcctctccaagctgtccagctggtatgtgctctgggaacactaatctaacttttcatattagtccaggcaaaatataattaggaagaaactcttctgccaaaacaaaaatcacatgctaatgtcaaatagagatgattttttacatctactatttttgtttatttgcaccagtattgactcataattatattgtataacccagatttgactgtattgccaaatacaataaaacaatttttaacagaaatttcatttgttttctctttcccctcccccaaatttggacagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctgtgagtaacttaacaacttttttccttagcaagggtagtgttgacacagtacttctctgctagcagtggccccaggttgctagttttgtcatcactttttaatgaggagcacatactgttttcttttatctttattttgatatgatttcaaacttatagaaagattggaagaataggatagaagaacacacacacacacacacacacacacacacacacacaccacttatttgtttctaagtcatttgagagtaagttgcaggcataattctttgctacccctaaatatctcagtgtgtatttcctaagaatgaggaattctcttaaccaggctataatgatcaaaatcagaaaagttgatgttgatacaatactaacatctaattcacatttcacattcatatttagccaattatcctagtaatttcccttataactattttttgcttggcccaggatccaactcaggatcacacattacatttagttgtcatgtctctttagactaatttggaatagattctcagcctttctttgtctttcatgacctagacatttttagcatacagtccagttactttgtctctcaatttatgtttgtctaatatttcctcataattagattcaggctatgaatttttggtaagaataccacagaaatgatgttatattcttctcagttcatcacatcagtagacacacggtgacaatttgtctcattattcataataactttgatcacttgattttggtgatgtctgtcagatttctccaccataaagttattattttttcctttgtaattgttgagtaatttctggggagatatttggaggttatgtaactatccccttcttaccatactttcacccaataggttttacatctattcatgattcttgcctgattcactaatcactatgatgtttgcaaaataatgatgtttaaaattccatttttttacatttattagttggcattctattgtaagaaagagctttttcttcttccatatttatgtgtttatttatttaagacacagggtctcactctagccaaggctagagtgaagtggcatgatcatagctcactgtaacctctaacttctgggtgggctcaagtggttttcctgcctcatcctcccaaagtgctgggataacaggtgtaagccaccacacccaaccttatttatgtgtttatttatttgaacatgaactcatggattctcattttattcaatgggttacaatctgctactatcatttattttgatgttcaaattggcccagggttggtcagtgagagtttttcaatctggctcttgtgtccttttgacaagttccccatcattctttgagcattttcttactctctggcacaacaagatgttccaggctcttcttgtacgttttctgctcagcccaaggagcagtcattttactaaggcgtccctcttccttttagtggggaatgatatttataaaccaattcattttttcttctgagagcaattatgatatgggagaactctttggaatggagttcttgtaaggaacctggcttcttggaattacacctgtatttgtctcctctcgagtttggggaaggaaagatgagattgcttttctctgcataatcccactctgctctcaaatccagtcctctccactatcagcagcagcagtctttagcacaggtagtcagtgataatagcatcaagacaagatttttttgcatttcccaaaactttcacttattcttgaaggagtattattgactgttgttatgggttttttccttccaggaggaagctgttaggaaaggaataggggctagatccatgcctaaaagggctctctcagactaaggggatatgttttcaccaacagtctggatgctgtttgagttaactgcagaggaacattccaggggatttctgtttctttgagattagaccaatgcaaaggagcaggaaagctattcctttgtgctaccacccaaagatatttgttttttctcttttctggggccttaaaaacaaaagagaatattcctagctggctctgattacaaaactgagctacagactagtaggttaagcctgaacagctcacccaaagcagtttaaagtaactttatctttgatctaaggaaccggaagtatggccttatatccatgtgctcagcagtggtgttttaaaaccacatctggccagcgaatggccatgagttttcctaccactttgtgggtagatagctaaatctaactgctgtgttaaagtactagacaaccctgttttattttgctcttttgtacactttttttttttttttttgagatggagtctcgctgcgacacccaggctggagtgccatggtgccatctcatctcactgcaacttctgcttcccgggttcaagcgattctcctacctcagcctcccgagtagctgggactacaggcacatgccaccatgtctggctaatttttgtatttttagtagagacagggtttcaccatattggccaggctggtctcgaactcctgacctcaagtggtctgcctgcctcgccctcccagagtgttgggattacaggcgtgagccaatgcacccggcctctttcatacactttttaatggacgaccatcctctgggtctgactgaatcatggtgggcataatgcacaatctaacgtaacaaacaaggaaattatcacctcaaacaaacaaaaaaaggtagtaaatgttctctctactattcagatctcttcaagtgttctttccaaaccttggaccaagagttcctaatctaggggccagaatggccttgaaggagttgacaaagcccccgaaatcacaacaccctaaaaatacagggcagattttttttcagagggtgcagtctatagtttccatcacatgctaacatattatggtaattggtgccttttactaagttcttaccgtgtgccaggcattttatacaaaaggaaataggggctcagagaggttgagtaaattgcctaatgtcaccaatcaaataagtagtgtagctggggtttgaacagattggtctggttgcaaaacacatgttcttttcacctcccaccgtacaggactatctcaagtgagtctgtggcccccaaaatgttatgctatgttactatgtcttagaagcttcctttggaggtaatggctggtttgataattcacctggggaaattaggctactagctgtagtcattgcctgcctcaccactgaaggatctgtaaaataccatagaatttcacctatttcgattttggctgtatggtatctgggacaaagggggcaatatatgaataaatatgagtgattacaacatgtctagcttcagcttttgcctaataaattgatatttatggtccatagaaggattatgacctttaaaaaataaattttaatgagtacattgctaggttacaaatctcaataaatctatttacacataaattatatatatatttatatattcatgagaacaaggcttttggggaacactgcctgaaaaacatgaaccctacctgggtttaataaacaagtattcactatagttggaaatgtcttggaatattaaacaacatggtgacaaataataacagtgaaatttctagtcattagaaatttagttttcaagtagttttaagcatcttctacttatttttaaaaattacaaatgtaatacatgtgtttgtgaataaaatatatttaaacaatacaaaatcatatgaaatatcaagtaaaacctacccttcactatcctcttcacagaggtgtctgttaaaaaattttttccatgggtttgtaataagtgtgtgcatgtatgtgcatgagtgtgtacagtttttaaaaagggatggcactgggagatatacctagtgttagatgacgggttgatgggtgtagcacaccaacatggcccatgtatgcatgtgtaacagacctgcaagttgtgcacatgtaccctggaacttaaagtataataaaataacataaaataaaataaaataaaaaggacagagtgggaaataaaataataataataataataataataatatatacatacatgtggttctgcaacttgatttattttaacttaatactatcatggacagacacataggtatatttagatctgtttttagggctacatatattccatgcaacataatttacatgtaacataatttatttaactagcccatcattgatggccatttaagttgctttcaattttttgcaattacaaataatgctacagtaaatttcctcatacatatatcttggtacgtttaggttttcaattttgtaagacacgttcctaagggtagaatttctcagtaaaagcctataagctgttacaatttaaatagatttatcatttttactagttattttattaatgtaactattcattgaaaattaattgacctctaaaagtaaaattactagatatatatggtaaaagatttaaaaatacataaaagtataaatctaaagtctcctttcacttcaatcttttactctatgtgtctatccccaaaagcaatgattgttaataatttcttatatatccttgcggaaaaaatgtaaaacttgaatttacatgtaaatatattttttttctttttcacagttgggttcatcattatatgcatccttttctgcatcttttaaaaatttaataatatttttggaggcattttcatatcagaaaatatagagctatctgattcttttggggggaggctgctgaatagtatgaaagaaaaagggtatggtataatttattcaacaagctctgtttgaaggactttgaagttgtttctagtttctagctatgacaaaagtctacagggcttttaaaagtaatgggtggtgacagaaatatcttgaagcaaccgtaaagaaattatcacaagctaaagttcctctcaagatatggccagcataatttcctaatctcaactcagacacatgatcaaacaaaggaattttttttgacctgtgaatgtatgaagaaaaagagtcttccaaagacatgcagattaaattccttttagatctgcatttaagaaatcctttctattgaaaagaatgaaataacctgaactgagttcatcatgggaaatctacactgtatcaaagcatagcatccctatatctgcggggtcattgatttgctgaggttcgttaattggtctaatgctccagcttctttgaattagtttatgaattgactattcttaaaatatgcagagatggattatatggtctatgtcctttataaaggcctttgtttggctcactattaattcctctatccaattatcagctctgataggaaaagttccatggtgatgggctctactagctaaaagacaatttggtcttgccctcatacatcaattctctgtgctaccctccttcctcatcacgaaaagtaagcatgagctgtttgtagttcactcaaagccttcttatttgtattctccttcacaggatgacattctcctatagactcagagatagaagctctagcctgtctgtctattgcagcattcgtttttcatgcttttgcctggaaactgaatgcagacaccactttgaaaaaaaaaagtttccttttcaccttaaagatactcatttcatatttttctaccccacaggcagatctgtctgtggcagtttctggtcaccattatctctcacaaatctaatcaacatgctgaattatatttatagaggtcctgactgaaagaaaaaccagatgtgacatgtgggctagaacgacacatagatttaatatgaggtgatatacccaaatcacaaccagaatttggtaccttagaaaatgttctacttaacattctgttggcaggtacatctgcaacaaaatgcctcataaatattcagctactctatacctctgttctccagctcccaatgattacaataatacaattttgtgtagagtgaaagagcaaatggcaattaagcccacagacccctgtgaattagtatggattatctccactttaaaatacagagacagcaaggcttatgcaaattatttgtgcaagtgatcacttgttcacaaacaggaacaaagtgaatatggcaaatcatgtttgtgagccctccaaggatggaggcctgacctcatggcttctgtccaatgtgaatagatggatattcagtcattgctcaagcacagtactggcttttgcatttgattttttttttttttttgagataaggtctcactctgtcgcccaggatgtagtgcagtggtgcaatcagagctcctcactgcagccttgacctcctgggctcaaaccatccccctgcttcagccaccccaccccgagtagctaggactacagatgtgtaccaccacacctggctaattttaatttattttttattattttattttattttattttttggtagagacggggtcttgctatgttgcctaggctggtcatttactttttattaactgaattttttattgagagataattgtagattcacatgcagttggaaattcttgtacactttgtctagtttcctctaatggtgacattttgcaaagctatagtataacaaacagaacattgacattgatacaacccaccaatcttactcaggtttctctagtttttattatattcatttatgtctgtgtattaagttctatacaattttatcacctgggcaaacttgtgtatctaccagcatactgatgctgaacagttctaatactagtaggatccctcatgttgaccttttataaccacaccaacttccttcccaccctttccccctacgctgcttcatacctaacccctgacaacactaatctgttccccatttctaaaattgtgtcatttcaacaatattatataaatggaatcacacattatgtaaacttttaggattaccttttttttttttttaactcagcataattctctgaagagccatccgggttgttgagtgtctcaatagtttactcatttccattgctgagtagtattccatggtatggatatgttacagtttattcaattattcacctgttgaaagacatttgggctgatttcaattttttgctgttataaaaaaaatccctgctatggacatctgtgtacaggttttttttgtgaacataagtttttatttctctgggaaaaatgccttggcttggctgtatggaagttgcatgtttagtttttttcttaatttaaaaaataattaaatttctgtgggtacatattaggtgtacatatttgtgtagtatatgagatgttttgatacaggcatggaatgtgaaataatcatatcatggtacccatcccctcaagtatttatcctttgtgttataaacaatccaattatactcatttagttatttttaaatgaacaattaagttattattgagtatagtcaccctgctgtgcaatctaatagtaggtcttaatagtaggtcttattctttctaacttttttttgttcacattaatcccctccttcccctcccccaagtccccctctacccttcccagcctctggtaaccatccttctactctttatatccatgagttcaattgttttgatttttgtagcccacaaacaaatgagaacatgcgatgtttgtttttctgtgcttagcttatttcacttaacataatgactccccgttccatccatgttgttgcaaatgactggatctcatttttttgtggctgaatagtactccgttgtgtatatgtaccacatattctttatctgttcatctgttgatggacacttaggttgcttccaaatcttagctattgtgaacagtgctgcaataaatatgtgagtgcagatatctctttgaaatacttattccctctcttttgggtatacacccagcaatgggattgctggatcatatggtagctctatttttagttttttaggaacctccaaactgtttgcacatttagctttataagaaactgtcagactgtttacaaactgtcagactgttttacaaaactgtttttcagttttacaaagtagctctatcactttatattccaccagcaatgtataagggatctagtttctcagcatctttgccagcatttggtgttgccactatttttcattgtagtcattcttgtaaatttgtagtgatattttattgtgctttcaatttgcattaccctgatgcttcatgatgttgaacatcttttcctgtgcttatgtgccgtcttcctgtgttcatcagtgaaatgtctgttcatgtgttttgcccttttttaaaaactgggttgtttgttcattttattgttgagttttgaaagtaaaaaaatatattctaattttttttttttttttgaggcggagtccggctctgtcacccaggctggaatgcagtggtgcgatctcggctcactgcaagctccgcctcccggggtcacaccattctcctgcctcagcctcccaagtagctgggactacaggcgcccaccaacacgcccgactaattttttgtatttttttttaatttttattttttttattatactttaagttttagggtacatgtgcacattgtgcaggttagttacatatgtatacatgtgccatgctgatgcgctgcacacactaactcgtcatctagcattaggtatatctcccgatgctatccctcccccctcccaccaccccacaacagtccccagagtgtgatattccccttcctgtgtccatgtgatctcattgttcagttcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggagtcgccacactgacttccacaatggttgcactagtttacagtcccaccaacagtgtaaaagtgttcctatttgtccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagcccttttcagatgagtaggttgcaaaaattttctcccattttgtaggttgcctgttcactctgatggtagtttcttttgctgtgcggaagctctttagtttaattagatcccatttgtcaattttgtcttttgttgccattgcttttggtgttttagacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaatcctagaagaaaacctaggcattaccattcaggacataggcatgggcaaggacttcatgtatttttttttagtagagacggggtttcaccgtgttagccagtatggtctcgatttcctgaccttgtgatccacccacctcggcctcacaaagtgctgggattacaggcatgagccaccgcacccagccctaatatattctaattttttgttgggtatatcttttgcaaatatttccttctagtctgtagattttttaaaattctttttgtatttatttgtttatttatttatttatttatttgagactgagtcttgctctgttgcccaggctggagtgcactggcacgatctcagctcactgcaacttccacctcctggattcaagtgattcatgtgcctcagcctcctgagtagctgggactacaggcacatgccaccatgcctggctaatttttgtatttttagtagagatgaggtctcaccatgctggccaggctggtctcgaactcttgacctcaaattctccacctgccttggcctaccaaagtgctaggattacagcatgagccaccacacttggcctaaaaattctttttatatgggctttcacagaacaaaagcttttaattttgttaaagtctagtttattatttaatttttttaatgagtcatgctttcgatgttcaagtttaagaactctttgcttagccctagatcccaaagattttctcctatattttttctaaatattccatagctttgtactttacatttaagtctgtggtccattttgagtcaatttttgcataagatgtgtgaggtgtaggttgaggttctctctctttctttctttctttctttctttctttctttctttctttctttctttctttctttctttctttttctttttctttcttttttttggtctattgatgtccagttgcttcagtattaattgttgaaaaggttatacttgctttattgagttgattttgtacctttgtcaaaaatcagttgagcaaatttttatgtgtctatttctgaattttccatcttttccaatcatctatgtatctatccctctgccaataccacactattttgattgctgtaactttacataaagccttaatattgggtagagagattcctctaaccttattcttcttttcaaaaattggttcagttattctaggacttgtgcatttccataaaaattttagactatgcttgtctgtttgcatataaccttgatggaatattgataggaattggattatatctgtatatcaatttgaagagagctgacgtctttactatgttgaatcttccaatccgtgaacacagtgtgcttctccattttttaaggttttctttgatttgtttcattagcattttgtgatacacatgctttgttaagtgtatacctaagtatttcattttcattggagcaattgtaaatagcattgtgcttttgatttcagtttctgcgtgttcatttttaggacatagaaatgtgattgctttttgtgtgttgattttgtattctgaactcatttataagttctggtagatttttttcttgaagattccttgaggttttctatctggactactgcataatctgcaatgccttaaaaaatttttttttgcctttttggggtgcctctaacttccagtaccacgttgaatcatactggtgagagtggacatccttgccttgttcctgatcttagctggaaaacattcaatctttcaccattacagttgatgttagctgtaggtttcttgatgatgccacttaccatgttgctaaaaatcccctctattcttaacttgcccagagattgtatcgtgaagggatatgaatttttgtcaaatgccttttttggatcagttgatataatttttcttctttatcttgttgatattgtgggttatactgatagattttcaaaggtttagccagctttgcatatttggaatagatcccacttggtcatggtatataattatttttatatattgtttcatttagtttgctcatatattgttgaggatttttgtatttaatttcaggagagatattggtctgtaatttctttctttttttttttttactgtctctgatttcagtatcaggatgacactggccttataaaatgtgtaggaaagtgttcctcttttctggaagagattctataaaattggtgttaattcttccttggcagcaaactccagtgaaatcatgtgggcctggagattattttgtgaaggcttttaaattagtagttcaatttctttaatagctatagggctattcagattgtctatttcctcttgatggagctttggtaaattatgggttttgaggagttgtctatttcttctaacttgttgaatttgtgaacataaagttattcataatattctcttattgtctttttaattgctgcagaataagtagtgatattctctgtttcatttatgatattgatgactgacttgtgcttttctctttttacttttatcagtcttgctataggtttatcaattttattgacttaaaaaatcatatttgctccattgatttttctctattgtcttcttatttttaatttcattgagttcttttatgatcttgcttatttttttattctgcctgctttggatttatcttggggttttttttaggctcttgaggtgggagctgagattattgttttgagatatttcctctttttaaatgtatgcatttagtgctataatctttcttctcagcactgttttagttgtatctcccaaatttttaaaattaaatttaatttgattaaaatagttttatttaattcaatgttttaaattttttttgttaaaatgtcttctttgattcatgggttatgcggaagtgtgttgtttagaacttttctatggtctttctgtaattgatttctagtttgatttcataataatcagagaaaaccatcttataaattcagttcctttaaatgaggtttgttttatggcccagtgtatggtctatgttggtgaatattccatgggtgcttcaaaaatatatatattctgctattgttgagtggagtgctctatatcaactaaagtctgttgattgtgttgttcagaacttctatatacctgctgattttctgtttagtagctttatcacttgttgagacaggggtgttaaaattcccaactataattatggatttactatttttcctttcagctccatcagttttgcttcatgtattttgaggctctgttgtttgatatgtatgcatttaggatcaccatgtcttcctggtgaagcaatgcatttattattatgtagtgtcctttcttgagtccagtaattttccttgctctgtactctagtgaatattattatagccatttttactttccttaaacttactgcttgcatggtataatttttccattcttctactttcaacctacctatatgatgatattcaaagtacattcttttgtgaacagcaacatatgggttacttgagcgtactttaatattccatcttgatttatttatggggttttgagtttctctttgcatggttttcctagtggttggacttggtattacaatatgaaaatgtgactactgttgtcagcattttatcagtttgagtgaggtatggaaacctcacttccattttggtcctttgactttcctcaccttttagattttttttgaagggatcttgttctgtcatccagactgcagagcagtggagtgcagtggtatgatcatagctcacagcaacctcaaactcctgggctcaagtaatcctcctgtctcggtttcccaagtagctgggactataggtgtgcaccaccacgcccagttatttttaaaaaaattttttgatagagatagggtctcactttgctgcccaggctggtcttgaactcctggcttcaagcaatcttcctgctttgacctcccaaatttctaggattacagacatgagctgccatatccagccacttttaaattttgttgttttaaatatcagatgatgttgcaatttttgtctcaatcatcaaatatgatttataaagctcatgaggaaaaggatcatctattttatgtacccatatttttgttctttcctttgctcgttttttctttctcattctccaagattctttaaaaaaattatttctgtttgaagtaattcctttagctaatcttttaaagataggtctgccagtgacaaggtatcttaattttccttcatcagagaatgttttcatttccattttattcctgtaagatagctttgctggatatagaattcatggttaacaattcttttctgtcagcttttgaaaaatattatgacagcttcttctggcctccttagttctggatgagaaatctgtcatttaagttgttgctcttctataagcaatgtttgtttctttctgtctactttcaaaattttttgtcttttagttttcaaaagttcaattatgatgtgccttgccacagatttctttggcttttatccttcctggaatttgtttagctttttgaatctctaggtttgtgtcttttgtcaaatttgggaagcttttagcctttatttatttattttttaatatacattcagccccactgtctttctcctctcttttaaggctatggtaatatgaatgttggatattttgttattgtcccacaggtcctagtggctgtcttcatttttcttttcaatgcattttctctattgtttagattgggtgaattctattattttatcattatgtttacctgttctatcttctgtcatctctactctactattaagtccatccagctcgtcttaaaaatttggttttgtattctttcattctataatttccacttggttcctttttttttttttcaatacagagtctcgttctgtcgcccaggctggagtacagtggcgcgatcttggctcacagcaacctccgtctcccgggttcaagggattctcatacctcagcctcctgagtatctggcactcaacaccatgtctggctaatttttgtatttttagtagaaacggggtttcatcatgttggccaggctggtctcaaactcctggattcagatgatccgtcttcctttcctcccaaagtgctgggattacaggcatgagccaccaagcctggccccattttttttccaaataatttcaaaaattttaagttcaggatttgcagatttgttacctaggtaaatgtgtgccatggtggtttgctgcacctatgaacccatcaccttgattctttcttaacaatgtttatttcttttctgagattctattttttgcatttcaagataatttgtaattgcttgcaggattatttatatgatgattgctttaatatcattgtcagataattccagtgtctaattcatctcagttttagcatcagttgattatcttttcttactcaagttgtgattttgttgcttctaaatatgacaggtaatttaaaaaattgtatcctggacattttgtcaattaggagattctgggtcttttttaaatcttttattttagcagtcagtcattctgtttaggcttagcacacaggtcttggtccatttttgtgggctgtgcttccaaatacaacttaatttttatagtctttgtgatgttatttcatcttgcttggtttatctggtacccctgaggcttccacctgtctctgctggtgcttcttgggtggggagcagaaggcatctccttaggccaggcctccagctgtctctcagagggggatggatgtgggggcatcaccctaccaatgcctcttgacttccgctagtctctggacaggaaaggaaaatcttgggctagttttcgtagacttggccacctgctgctggagagtccctttttcttgtttcccctgcctaccttggtgtctctgggtgagggaagagaatctcagtactgcagggacaaaaagacttcctggatcaggccacttgctattactggctccctttttcctcttatgcctgcctgccttggtttttctgaatgggcgaggaaaaccttgggttggcaaaaacaatagtcttcccagactgggttatgttcaaccagtgttttttggtggagaggggagattcaggcctgttagggaaggagagtgcttctcttggttgcttattgttagcaaggtgcccagtcagtcccccttgctggagtatccaacttgcctgaagttgtcagagggactcccatttgatccagaaggggaatgagcctacttggactgacttctgtttctaggttggggattaggaagcatagggcctgggccgcatttttatgctgggtttggtgagggggagaagataactgccactatgttgttcctttactcttggggtcccaaaccagtttgttttattcttagcacctttcatagttctcctttggttgtctcttacaccatttccaggatttatagttgtaccttttggggaggagcagggaaaagtggctctatgccatcttgttcagttgagaagtctgcatttgcttttaacatcagttcttgggcagtaaaagctcttgagtgtgtatgcgtagacagatagggtgcaacaaaatgacagagataatatcactggcattgtaactaccttactcacttacaacattttcttttctgagaaggacaggcattaaattcaatggagataagtgtgccatttaggataaaaaaaatccctaccacatatagggaaaagagaaagattgatgaagcagaagtaaagtgaacctcactcattagaaatgataggtgcacagaaagtctgaattactgaatttaagaaaaacaaaagtatgtacagattaagacaataaggtcaccaataaacaaattaagttataaaagaaatttatattcagtatcagcctacattatacaaaatgatcttgaatgttcaagatcattttcaatgccaacccattgcaattaatttctagacttaaggtttataggaatctttaattccaatggatcctgattctaaaaagctactgattgtttgattgaattgtctttatctaggatatgaatgattattcaaggcatatatcatatcagggaatgtccataatttgggatccccactgagttttgattcctgggccagcaaagtcgccttgatgttttagtttagcattgcaatgctgtcctctaaagtttgtttcactgttttggatgattgctgtttcttgcagtgttcagcacttgcagaacttggcatttagtatctaactttgtttctccttggtaccttcagaaagagtctctttctttctttgtttctcctcagattggggtgtttccatataaattgagggcatacatttatgaggaatttgagggcatacattatgagaaattgaggcatttctacatactgtctaatttcttctctaaatctttcatctgtggaaatctcatttcaacactgcacttctctgggcctcatctgtaaatgaaaggattgaatataatctccaagtcctggctctaaaattctgggattttaatgaatgaagactttagtctttattaatacagactttagaggaaaaatttgatacagcagtccctctggaagaaaccttgcatctgaaagatttaatggaaggtttgctgaaatatacaaacccaggctttaggttaaaacggagcaatgtaacatgcattatttctcgagatctctggtacttaaaatgccacctgcttggcaatttagctcaactcatttgtttttatctttctaaatcttatattccttcttgagatgcttactggaagtgttaataacaattgctacatctatggctcagccctctctgataaaaataccatgtctaactcccattccccgtcttctaaaagagttttccactacttatggattactccaatagtgctctttgaatgctgcatcaaagaagataacttagacttttatggtatttagtgttttattgttttcctaaaaagtgaatgcagttcaatcattaatcttttgtaaaggagagggaattgtgaactcttctctcaacaattagtgcattcatagagtgatttcaggctctaggatgccacactcctcaaatgtgctagaagtgacactttcacggaggtttgctaagccagttggctggtgtaaacccacctacaaaattggaaatgaagatcctgacaattctcctttcacgtggagttatggacaaatttgaaagcataaagcttaaaatactcacttggctgctgaaatataccagtttcttgataaggcctaacataatgtgcatctgtggtaattggaaaaatgtcataaaattaagtgaaaaagtactttttatatagctttgtcttttccccttaaaaatgtgtgtacttttatcaactcatctatacagtcaattggaagattgtcattcattctacttgctaatgaccacaaaatcctgaagaacatcctacacacacctcaaaatttctggatatgcaaattataagtaattttaatgctcaagacagtgaaacaaatcagtagattgtctactaccacaattattcctacatcataggtaatatgcttctcagatggataaattcaaaatactaatttccctaaggtaaatatggatgtttgggtgatttcaattggagaaagatcatgactcagtcttgaattttactatgtaccattttcacttggatattcactatcatcctaaattccacttatccacgtctgaactgggtgtttttcttctgagtgaggctgccttcccaatttttctgtttttatgaatattatcactattctccgagttgcccagaagcaaactttgagttctctgagatttctgtcttctttatctcttaaatctctttgttatcatacactgtcaattcttactttccagtagatatagggataggaatcttcacactgctctcacatcattccaagccttattcagttattctattagcttacaaatagatactaaacatctaccatgtgccaggcactgggatagacactaaagatacaatggtgggcaacaaaagatgaggactctgtccatgtggtctagcgaggaagacagacattaaaaatcacatgcaaacaaaggtaaatctccaattatgacgcattaaatgaagaagaggtatgaggcgtcataagagtctaaaatagattggtgtgagctagtcatggaagtcagggaaggtaggtttccctgaagaggtgatgcatgagctgagaactgaagaattggcagaagttaatcagatgaggaaggatgggaagtacattctaagtagaggttacagcaaatgcaatggtcttgtagtgggaaagagcatgccaagtattagagaactaaaaagaggaagactaaaaaaaaacagaggggacttagcacaaattgagactgaagagctagagagggaccaaatcatgcatagctttatatgctttattaagaaaaaattttctttttatcctatgagcaatagaaagcaactaaagagagctcagtgtgtgtgtgtgtgtgtgtgtgtgtgtgtgtgtgtgtgtgtgagagagagagaggaaggggatcagattggcacttaaaaagatcattttggttgtattatggaacagattagagggggtccaagagtagtggcagactagttcagttgggaggctactgcagtagtccaagtgaaagatgatggtgactggttagggtggtaagtgatggagatagagataaactggggtgagccaagagatatttaggagctacgatcaataggacaagattatggattggctatggcaggtgagagagagaatgaaggagacagagggagagacagagagttggagcttgcataatttaatgtatgatagtgtagggccagtcactaaaggaataccagaagaggacccagtttggagagaagctaatgagttcaagttggagaatgttgagcttgaggtgttaatgagatatccaagaaacgatatcaagtaaacaattggttatataaatgtggagctcaaaatagagcaaaatagagatctggtcaagagatataactttgagatttgtctgggtataggtgtaaattgaaatcctaggtgtagagaaactatacagccaaatgtgaagaggtcctgggacaaagcgttggtcaggtaaaataggatgagtctaaaaatgagtggacagagaagtaggagaaaacgcaggagtgtgatgtgtaatggaaagcaatgaaaagagtattttaaactcattacttctactaaataaatgttaatttgggagttccagattaaaacattttcaatctggtgtttaaatgactgatagaagtttgaccaagtgaaagccaactgttttttgagcacttactctgtataagaagctatgctaagtgttttatgcacattaactcaatctcataacgattttataggataggtgttattataatcctcatattatagaggaggaaactgaagcacggagaggttaagcaactagtccaaggttatgtaatgggtgtgaaagtgatggagccagcatttaaaactaatccatttgaatctaaggttgattttttctttttggaatattttaaactacacaattcaatttctttaatagatataggactattcaagttatctgtttcttcttaactgagttcttatagctgtatttttcaaggaattggatcctttcccaaagctaatcttcttaatcaatgcactactgtggcatgcatccctctttcaggaatgtttatatattttatgaagatactacgaaatggatatcttcctaccagttacttaaccagagtgttatgagtaccatatagaggtcttagagagtagaaaattatcttaaggaaaatcaagtgatcaagtgatttgattatatctatgatactttcttacaaaatgaaaagaaattatagagctctttctagttgtctctaatttccaaagctgaatccaaaataacacattctttctgatttttttagttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacaggtactgctccataatgcatgtggtgtagccccaacagaattcatgcactatgggtcatgtgttctccaaagtggcccgttcttggaaggcagaaaagaatgaagaagggtgcaggtgtttcttgtctccttcagacagtgggtacagtgagtaccttgtccaaatacaaaattctctagccatctttcttgtctttgccttattgaaatataatgtaaatgtatgttttcactcagcatgacaatttctaagcctactttccacctgttttgttcttgactgtctgactctgattctgccaatgtgcacatggactaggaacctcatcccttcccagtaagagaatcatacggccttaggtctgagcatgctgaccacacaccagaaaacaccagaaaaaaacaccagaatatatcttatcttgccttttggattccttttatgcaggtctcagccttctccaatccctacctgcagctgactaggagtgcttgtccaaggccagggaatatttggcttccatattgttcaaatttggaatattcctgcaacttttaacattctacaatagaaatttgataggatacacaagagcaaaagggaaaaaaggagagaaaaacccaaagcagaaaacaaggcacaggaagaaaaaaacagttactttctcagagaaaatgatcttctgagataatgttcagtttggccattgagtggactgaaagtctgttggccaatgagagtggagaattggtgggatttgtggagtgtctgtcaactagaaatcaaggaagtgcccaaataaagcaaaactgggatggtaacgtcctgttctgctttttgatatggagccgaaagtgttggttcttgaccttggagttaaattaagctaagtttaggcatgagacgttattatttggtttactttaaaacagagaacacttttcaccaaatttacagaagtcaaatttcttgaactaaatgaataaaattaacctccttatttttaattacagtttccttctacaatgttgaaatgagcttctctgtctttgttgaagagccaaggatccctattaccagtgttataaatgaatttacggaaaattcggtaaaataatcttttgcatatttatggcatatataaatatatgtgaatatatacatttatatatatgacagaatatattaaaactaggctttacttttttctaccaataataaatttcacagctaagtagtttttttttttttgctgcaaatctgtctactctgtaagcaacatcatgagaatgtatgcaatctctctttcatagtgccaatgttgaaagcttttatggaacgttattattttcatttgttgagatctgtacatttccctttagagacacaaattctgagtctttgccaaattttcctatttgggaaaagtgggagagcagtgataacaaaatgtatacttaaatacaatggtatttaagtattattgttttctgcattttatttctttttccaacacaatgaatgttttacttatccttaattttttcttgatatgactaatacatactctctgtaacaaaatcagacattgacatcaaaaacccagaaagtaaatgtcctctctctaatactgctctgtgcattaactcctcttaatagtttaaggtacattcttttagatattttttctgtgcatattataacattgatgcatgtgtgttcttttacaaaataattgtagttgtactagttatgctatttttcaacttgctccccctcctctgcacttaaccatgtatctttgcacatattcatgctggtaaatataaatcatacactttaacagatgcatagggtttcactacatggttgtagtatagttttttttttaaatcctttggtggacatttaagttgtttctatcttcttctctatttagaaacaatgctgggctgggcactgtggctcatgcctgtaatcctagcactttgagaggttgaggcaaaaggattgcgtgagccaaggagtttgagactagcctgggcaacatggcgagatcttgttttctttaaaaaaaaaaaaagtttaagaaagaaacaatgctgaaaacaattccctagaagtaaattttaaggcacttaagtatttttataggataaattcctagaattggaatcagtagatgaaaagatgtgaacctttcacatttaaatagctgtcactaaatggcctcccagataggtgacaccaacttgcaccatctcccaacagcaaataatcatatctgtttcccttctttccctgtcagcacttattttcaagtgtctatggcttggttataaatccttgaaaatgggtgggtgtattagtctactcaggctaccataacaaaatgccacagactggatggcttaaacaacagatgtttattttctcacagttctggaatctggaagtctaagattaaagtgctggcagagttggtttctggtgaggcctctctccttggtttgcagatggccatcttcttaactgtgtcctcacatggactttcctctgtgcatacgcatccctggtctctctttttcttcttataaggacactggtcctgttggagtagggctccacttttatgatcttatttaaccttacatccccaaaggccttatctctgaatataaccacattcggggttagggcttcaacatttgagttttggaaagacacaattcagcccataatagcaggtaaaacgtaaatggaaaaacttaatggagcagatggaaatgttgagccagctgaaataatgagtgcagcttaatgatcacaccatcccaagtgattttgctgagttaaactagaggagcagaatactaaaactgatttttttttgtcttgtacagttgaattctatatttcagaacagtgaattttctcttgctactctggaaacccaaattaaaagcaggtatgtgaatgacatttactgtgggtcaaagggcaatttgagggcattttgggtctgttcctatctggaggggatgtcctatgtttatgtctgagatttagggctgccacatttttagttgcatcttccttcctgagtaggttctttttggcatgaggaaaaaaattgtattactattgtagggcacaaagccaatgggagaacaaaacaaaagaaaatcaataggggaagtcatgcagttagactgagttacctctaatgcccttttcatctctaagtttctatgaatctgtgatttatacaaaaatcatgctttgaagtgctatgtatggacaatgcacgaggatttataaggccttttattttggaatgattcactttcagaaaagagaaattccaaagtgaacttgaaatgtctaaagcaagaatgttgactaatccaagatttgcttggggcacaaatttcgaaaggtgattgcagtgaaatgggcaggcactgagtagtatcatggaaactatggcaaaggcaattgctcacctgagaagtatttcctgtattctttcgctgcacatatactagtcctctgtaaagggacaccccgcagaagctctttgaaaaataggcatggctctgttaagccatggcaaactgatttttaaaacataaaatgctactgcctgtcttctgtacactgggactttggtttctcttacatatccaagtattaattattaatcaagtattaattcatatacatattaataggttcaagaaaattcatataaatgaatggaggtaaatgtacggtaggttattgtcttagtcagttttgagttactataacaaaaatgctatagactaggtggcttaagccacagaaatttattgctcacagttccggaggctgggaagtccaagatcaaggtgttggcaggttcagtgtctggtgatggccctcttcttgctgtgccctcaagtggcagaaagcagagagacagaaagctctcctgtctcttcttataagggtactgtttcaaaaaaattcaaactgttttttttcctctgttgtcataccaacacaacaatcaatatagaagacttctacgaccaaacgtgtggggattttcccccaacacaccaagcagctgacaccagctggttgttctctacttcaattctattctggtgttatcctctcaaaaatagcttcagatctcacaggtccccaagactgcccctcaccccagacactagtcaaaagtccaggcctccagaacttctgactaactgacttcaacttggggttcccgtgacccactctttgagcttgattaatttgctagagcagctcaaagaactcaggtaaatacttatgtgcattggtttattataaaggatactgcagaagatacgaatgaagagatgtgtaaggcgaggtaagggacaaggggaatggagcttctatgatctccctgggtgcaccaccctccaggaacctccatgtattcagctcttgggaagctctccaaacccagtcttcttgggattttatggaaacatcattatgtcagcattcctttcccaagtctcatatgaggcaagactctttctggagagggtcttaagactcacaatcagaaaggtgaagaaagattagagttccgccttggggcaggtgaaaggagggtgggagaagatcagagagattctgtttgctgaagccagcttctgaggcctagcacacctaacattataacaaaagactgtaacaagggctatgggagttatgagccaagaactgtggatgaaaacatatgtgtacacacacacacacacacacacacacacacagagacacatataacacatcaggcaccgattccattcatgagagttccaccttcatgatctaattacccctcaaaggccccgcctcctaatataatcacactggggattggacttcaacgttgaattttgggaggacacaaacattcacaacatttaactcactaaaccaaaactagagatgtctgggggtataaaacattctttttaaaaactgtgtctattatttttccttattacaaaagtaatatgtgaccactgtaaaatcttagagctttacagaaatatatatatatataacatggacggtaaaaatctctgaatacttgccttcccccaccccttcaagaactcctgttaacagcttattttattgatttttctagatttgttttcacacatttactaagagaataagattctcctctacatactgtttgacaactttcttttcatgctttgtaatacatcatgtatgccttttcaggccaatacatgcagatatagctcatttgttttaataattgtacaggattcttttatatgatatgccatgatgttttcctccaattatctagtgatggacacttgagtaatttccacttgtatgtctatttttatgcacttttgctggtaccattatggaatagattccaggatgcaaggttaataaatcaaaggcttgccaccattttggtatgcatataataagcaagcccattggaagcattcctctggagccctagcattatttgaattccaggctgggagaagtctactgttctgcctcagagttgcctttctcctgatctcatgccctgtatacttggtactatatttcattttcctataattttgtaatgcttttgatacagggacatttcagaggaagagatggtcatggatcgagctattgtaagtaatttttcaaaatgaatctacttgtgacctatcctatgcctgattagatgtaagtcaatagctcttccacccaagtatatattatcaggcgaggctttgttgtggcaattgggggtcaaattacattacttcctttgggattggtacaaaaagccatcaagaaaaccatcccctgcttttttgaactatccatgtggcagctttttgaggcacattttctggtctacagggattgtaaatggtaagtgaatttcttcgttatagatgtcttgcaaaaaaaacctagctcttccaagagtgacacaattgtttgcaagactggcattcacacaataaatccaccctctatttgtccagatttgaagccagagtgtgataaaactatctcccatcatccttgccccaattctcagttcttgttccattgcctcaaagctttacaatagcacactctaaaatgagtagcaagcacacagctttccaggtatttaagtgtgaggtaagtatttgatgatacagaatacaatcaagcccacagtacaggggccagaagcagtgactcacacctgtaatcccagagatttgggaggctgaggtgggaggattgcttgaggccaggagttcaagaccagtctgagcaacatggggagaccccatctctacaaaaaataatttaaaaatattagccaggcacggtggtgcattcctgtagtcccagctactgaggaggctgaggcggggggatcacatgagcccagatttcaaggctgcactacactatgattgcaccactgcactccagcctaggtgatagagcaaggctctgtctcaaaaaacaaacaaacaaaaacctatagtgcatagtgcattccaaattatccactatcattaaaaatattttctgtaaatagctgagtcagaaattttgatatatacacattatagcatgatataactaaaattcctttcagtaacaggtgtaaaatccttttggtgataatatggtcaagctgcctgggttggaacccctgcttttccacttcctgactatgagaccttgggcaacttaattaacttctctgtgctggagtttcctcatctgtaagatgaggactgttggaaggataaaatgagatcatctatgttaagtgtttaacactgggcttagaacatagtaaatgtttgatagtgtttacaattgtcaattgcatgttaatatctagatccagaaggcttagattctgctcctagttctgtgtcttgtcaactgtgtgatactgggcagaccatttaacttctctgtgactcagattcctcatgtaacaaagagggcgacaatccctgtattgcccaccctacagggttggtgtgaggagtaaatgcattgatgtttttgagggtagtttgcagacggcaatgagttacataaatgtgaagcataattatataattgttgttaacaataagccctgtactcagttatgacatttgtttaaagatttcagtgactatgtacttttcttttgcattagttggaacagagagaaggacaagaaatggctacaatttcctatgtaccatacaggtaggaagtaggaactgagtttattaatagctggcacatttagttctgattttccttccatttaattctgcatgtgcggccagttggccagagttgtcagaagaagatcaaagtacccagtgattatttcacatatgctgtaattaggtccttgccttcatgaaatatgttgtttcggttggtcatggcacaggctagcggccagcctgctgcctctttgcagtgaagagaaaaaggggtggtcataatctgggacgggggagtgaagtgtttgttttggtcaaaaaggtccacgaaacacttggcagggaaattggaaacaacaacaacatggaaagtagcttcggttctgttcagactcgtggtccagctcctcctggaatgctggctattgttgatctgttcgacgcacatcaggaagaacatatagtcaaaaaaggcccatgaagaggtctttgaaatggagtagagggtctgtcgcaagcaggaggagaggtttaaaatgaagactcctcttcggactggaaagatgaaagctgagaagagctaggctccaaaggaaggagacaggatgagcagggacttcaccaaatatagatcaagggaggggcagatatcacttagattagacatggagataagttttgagcaagtacaggtatgtctaacttgcaacaactggcaggaaacttagcaaatatcttcttcaaaaagccgtgtctacaaatggaaatggaaaaaagatataggtaagtttttgtatctgaaatgtgcttcctaatggaatattagaggaattcagaatatttgaggatcttgctgtagaggatagaggatgaagtcaaggacagctctatcctttcatcagtgatcttttagtggacataaatactgagtgagtttttgtgaccatgggaaacattatttccctgaggctgagttccatcatctgtgttatgggaataataatagcattacctcatacggtcgttgtgagaataaagtgaatcagaacatgtggaggaagggtttcacaaatgttagctactatcattatcattatcatcattattacttattatagaaatgagccttcttcagaacacttctttatagactaactgagcatcatatgcctatttgcctgatttcagtaatgatgggtaaattggagaccagaagaataaaaggttctctctgaaataataaatcctgaaaactccatcttctctattaattattacaaactcttagagaaatctcaaggctagcaatttcaacacaatgcatacgttactgaccattcttttgaaaataggttttgcattgtctgttttggataagagaaaatttatcagaacatttcagtatgctgtcttccatcacttcttaagattggctgcttaatagctgtaaaatgtttgacatttatgaactaccaattaaatcagctgtacagaatttctgcattgcaggccaagttgcactcccttgacataactgcaacaatctttcttttttattctgctttgtagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactaggtaatttttttggggggtggatattgcagtatgaacttacttcctttattataaaactcataatgcatacttggttaaggattctgagttcagaaaggagagaagtcatctttctgttttttttttcatattcttggtacccacttgatctgatgacctttctacctttaagaacttatggaagaacagaatgctggaggagttaccagagactgctggtcagctctggatattagcaatggccaatccgtcaatggaatgggaggattttctctcttgcataaatacacagagacctgaagagcttcctcattaacacacaataaatgcctaatagatacttgctaatttattgattgattcagccatcttattcatcttggcaagtgatcagggaactgtcccagatttctctcatgggggcattctctgattagcaaagctttactggtaaaagtgcaaggctaccaggccactccacctccttcccagtgcagctttgttccttttccccaatagactgctgtagaaatcattgagctcacacagctctaatgccagataacacacacaggcattagaacgcacaatccttggcaacagactaattaagtataagagggcagcctgtgacggtgcaggggtgtgagtgaaatggggggcagaaacgtgttgaagccacaggtagagcccaacatgtaaatgacactaatgaatgtgtcctaagaatgagaggaaggcacctttcaccctcactcagaatggagactgggatagctgagcaaagctggctgggccacttctcacagcattctctcaacacctgagggaaatatttccagaatcagggtcatgaaacccagtaagtgctcagaaaaaaatgggaacttatcatatagacttagcccatgtcacatctcccttcgtgtgacagcaaaaccttgccttaacagccctatgtggaagtttgccctgtccctcagcaacatcaaaaacagagccctagactgtgtgcagtggcttacacctataatcccagaactttgggagggtgaggcaggaggatcacttaaggtcaagagtttgagaccagcctgggcaacaaagcaagacgctgtctctacaaaaaataaaaaattagctggacatggtgatgcatgcctgtagtgccagcttttcaagaggctgaggcagggggatcacttgaggccaggaggttgaggctgcagtgagccatgatcacaccattgcgctccagactgggtgacagagtaagacctcatataacaaacaaacaaacaaaacagagctcccctgtctatactgatcatgtcagatacactgaatttactaaaatgaaatccatcccagagtccattaagaagggggccattccagagagagaagttcgtctatagtctcctgtctttggatataaaactgctaacagtgggtatctcagaagctgggcaattggtaggtgggaacttttgacttttgactctacactccaccacgtggcttgaaatttttcaattcttatgtattgttttaaaaacaagacagaacaatgtcaggtgaggtggctaatgcttatagtcccagatctttgggtggctgaggtgggaggattgcttgaggccaggagtttgagaccagcctctataacatagcaagacgctgtctgtacaaaattttagaaaaacctatctcatcaattcgttgttttaatgaaaaggactaaatatgtggttatactgggtggtttattatttaaaaaaaaaacactccatataatgatattttcaataaggcctggtccaaatggctaggtagaaaaagttttcttttttatttgctgatctttacgtgcagcataataatgacgttcataataatatataatattatattattatatagtaataataataatggatgtttgtaatacttttaagtgcctcttgtcctttaaaatgtgcatacattttctctgtagagcctggaaattgcaaagctgatgaaacagcctctaaatacaaagggacctataagtggctattaaccaaccctacggagacagcccaaaccagatgcataaaaaatgaggatggaaatgccacaagattctggtatgtacaggccaagttctaattgctgattcagatatacaaagatctacctaattggggacatgtttctatgtcatttgtctgagcatgctcccttcctccacctctagtgccagtctttctttctattacctttcgtacctgtttaaacatacatgcaacataacaagaaaaattttcaaggagacaaaagataaaagttacccatcatcccagaagaaaattcaagaagacaaaagagaaaaaagtcacccataaccccactgcctgaacacagctgtttttaggttggcatatatttttttcatgtaacctttctctgtatgcctttaagttttatgtagcagtaatcactattcttgtatcaataatgtaatttaccatttcattcaatggtttatcaaacattttccatgttttacatttattatcttaatgttcatttcaaaataacgaccttggaaaccatctagttgatgggctatagtaatttactaaatcacttttctattgttgactttatcattttcctttttaaaataatcagccctcttttctcactctctgctgttcatggtttatgccattaacttaagtgggcaaaaccagaggggcagcaggttttgacagaggcttaaaagcactcttttagaaagcaacattaggggctttccttttcctccctgtgtctaatcagttggcaagtcctgcagctttgatggtcatagtcagagcccacatctagcctttcctttccaaccccactgccactaccctggtgcaagcccttattgcccactattagagcggtctccttgccatctaacttaacagtatcccttacccgcctccgccaactatattctacactgctgccagcatgattttcctgaagtatggctgctatcatgccactgtcgtgctccagctccacattgcctcaagaattaagtccaaacccctaaatatagtccagaccgtaggcttcctctcctgctgtctcactcagcattctccctccctttatcatacgctccagtcaaaatgaccatttgctgttctgggctcaatggacgcttcctggtgtctctttctctgcctgtgctgtttgctcttcttggggttgggggaagagatttttctctacctctgtcctttcagcacacagctcagctcaaatgctgaaagtaacgtctctttccttggtagtttgatagattcagttttgtttatacagcttttcatcttatatttgccctaagtttcgagtagttacacttagaattttaaaccccctaattacaagttccttgagggagggatgaagccccaccctgtttgtgtgtgctacctattaccattcctagaatggagtgggtgctcaataaatgtgttagctgacttgaaatgaactggcttgaattgggtgaggcacaggggagggtggatgatgagggccgatgggccatcgagggttctatattaattgtcttaagttaatatgctgagatagagaccacattcgaacaggaatttccccttaaaagaggagtaagaagggacagtgagaggaaagagtcatgtctagaggaccagaatctctgtcttgatgcttggtcagtaggacattgccatgccccattcccagctcccttacctgtttatccactccccttcccccttcccacatgttgaccctagattcacttgctccctaagagcaaaatttcttcatttcacaaagaagtactgggctcccacctttgctttctatgccaggaggcttggggcaggcgaggagaaggcatgctaaggctatatccaccatttgctttaagactatctttgcctcatcctctgatgagaaagctctttcctctctttttcagttcaatcagcatcaacacgggcaaatctcagtgggaaaagccaaagtttaaacaatgcaaattgcttcaagaacttcctgacaagattgtggatcttgctaatattaccataagtgatggtaagattgttttgtacatataagacaaattatggaacttcaattactttgcctacttgaccccaaaccagagagagtataggcaaaccccacttaggaaaatctaccttacgacaatccaatttcagaacaaaggtaattaatgttggtggaggtggtggtgggacatgagatgttaggactatcagtgtttcagtgatttttgtttgtttttgctacatatatatatttgagatggagtttcgctcttgttgcccaggctggagtgcaacggcgcaatcttggctcactgcaacctctgcctcctaggttcaagcaattctcctgcctcagcctcccgagtagctgggattacaggcgcccaccaccatgcccggatgattttttctacttttagcagaggcggggtttcaccatgttggccaggctggtctcaaactcctaacctcaagtgatccacctgcctcagcctcccaaagtactgggattacaggtgtgagccaccgcgcctggccttattttactttttcggctaattattgtttttatttttttttaatttttaaaaagttttaataggtaatacttcactgacttcaatactcaaaaaacaaaaagagtatgtgtaaaacatctccctcccactgctgacctcagccattcagttactatccacagagatattttatggatccataatgaaatgtgtatacatatttgtgtatgtgtatattgtatacacacatatacttgccctcactttttgtacacaaagtggagcatactatacacactattctttacgttgcttttttctcttaacaatatattgcagagattattatatcagcctataaagaattttctctttcttttttccccttctgcattgtattatatataccacaataaatgtgccacaatttatttaacctgtttcttatggatgagtatttaggttgtcagtaacatttttctttgaaaacaagactgtacaactatttttgtgtttttttcattgtagggaaaatactataacatatttttaaaaatactcacatgtttgatagtgtataagatgttttagagttggtattgtctaagcagctgatatagaaggttgcatttctttcaaaaatacatttgtagaccacattagcttttatttttgtttgtgacactgttagcataattcatattattaggcaaaagagattcaaaataaagagtatctcttttaaaaaaccactgcttcgatgaatattacatatatgtcagaattttgagaaagtaggggtatacctaaagcataaatccttgaatgtagaatttctgggtcaatcatacttttgatggtgtcaaaatgctctctgtaatagttacagcaatttagattcccacttgcaaattatgaaaagcacctttttcgcaactccttcatcaacacagcatgtttgttatcagacttctggatctttttgcgatgtgataagcagaaattgatatctcaatgtagtttacaaactttttaatggagatatttacatatcataaaattcgctcatttaatgtgtacaatttagtgggtttttaaaagcatattcactagattgtgcaaccatcatcactaattccagaatatttcatcaccccaaaaagaaaccctgtacccattagcagtctctccattcctcccccaccccagctcctggcaaccactaatctacttttttgtctctatgaattttgccaatttggggcatttcatgtttctgaggttcatccaatgttgtagcatgtatcattgcttcattcctttttatggatgcattatattccattatatagatataccacattttgcttattaattcatcatttgacagatatttcttttccatcttttggttattattaaaaatctagctgtgcacatttatgtacagattttatgtagacatatgttttcaattttctcgggtatacactgaagagtagaattgctaggtcatatagtaaccctatgattagctttttgaggaacttcaaaactgttttccacagcagttgtgccattctacatccctgccaactctgtatgaaggttccaatttcttcacatccttgtaaacacttattactattgtctgtcttttagattatggctggtagtaatgccccccaacacacctttattcctaattttagtaatttgtgtcttcacttttttttatctttgtcagtctagccaaaagtttttaaattttgttaatgtttatagactttattttttagagcagttttagattcacagcaaaattgagtggaaagtacagagcttcagcatgtgccctcccccaaccacctgcagacttccccaccatcaacatcccccaccagagtggtatgtttgttacaattgaatgtacactgacacatcgttatcaccaatagttcatagttttacattagcgttcactcttgctattgtacattctgtgggtttggacaaatgtataatgacacgaatccgccattacagtatcatatgggatattttcactgctctaaaagtcctctatgctccacttattcatccctccttcctctcaacccctggcaatcactgatctttttactatctctgtgtttttgctctttccagaaggccatatagttggaatcttacaatatgcagccttctcagattgtcttctttcacttagttatgtgcatttaaatttcttccatgtgtcttttcatggcttggcagctcatttctttttggcactggataatattccattgtctggatgtaccacagtttatttattcattcacctactgaaggacatcttggttgcttccaagctctaactacgaatacagctactataaacatctgtgtgcaggtttttgtatagatgttaagtgttcaactcatttgggtaaagaacaaaaggtgtggttgttggattgtgtgataagagtatgtttagttttgtaagaagctgacaaattgccttccaaagtggctgtaccattttgcattcctatcagcaatgagagttcctgttgtttcacattctttccagcatttagtgttgtcagtgttttagattttggctattctaataggtgtgtagtggtatctcattgttgttttaatttgcaattccttaatgacatatgatgatgaatagcttttcatatgcatattttccatatttatgtctcctttggtgaggtgtattctataggctgaatgtttgtgtgccccaaaaattcatacgttgaaattctaagcccagtgtgatggtatttggagatgaggcctttgggaggggattaggtcatgagggtggaaccttcatgaatgagattagcacccttataaaagaggcctcagagagcttctttgcccctttcaccatgtgaggttatagtgaaaaaatggcggtctatgagccaggaaatgagttctcaccagacattgaatctgttcttcatagacaacttgccagacatggttctactgcataaaatgggtccctcccatagtgaaatgtcagaaattgaggcacaggcattccagtgcctcgcagaagggccagggaattggccttgaagcagtgaacttctcagacctgttttccttgcagatgatgcaagtttgagatccttgctgaggactatctagaagaattaggaaagcaagcacagttctgattatttctagatcagaaaccaagagtgagggcaataggaaatgttacagcttgaagtgagtgggcggaaagttagagggtttgtgtttcacactgacctccgtccttctgagtgacacattttctttagacatgctaatagaattttctcttgtgcaagaaaaagttaataaacagtcataacaacaacaaaaacactgcactgggttgggatttttagaaaattgactgagaagtcattttatatatataaaaaatctaccgcggagtaaaggaacagttggatgatgattgtaatgtatataactgaaaagtaaactatcaagtttattatctttggaagaatccttctattctacttgtaaattaggggcttaatgaacaatgaatacaatataaaggaaagaaaaatgtattcacgttgaaacaatttattttcttttgctttcaatcttgctgacaagcattagatatcttggttgaagaaaaactcttctgctctctcacttaaatgctcctttttcttaactctttaatatcacagagttagaaaaggtacttttatttcaaagttctttgggttctcttctgtgctcaatgtttgttacctccatgatattaaagatgcatcaggctctagtgaagttgactagaacttttcagaaaactttttcctgtctgtatccattccaccatcagggcaggatagtgagtgcttaagagaaaacagtggtattcccaggaggtcaggtagaaagactgcaaagcacagctgttccaacccccaacacggtggagaaaacggccaaagtcacagatgctgtaaaaagtgatactgaagagctcaagctttggaattagcactgggttagaatatttcaatgttttaacttcttactctatataaaggagataatgtgagtacttttatgactaatacaaaggttattgtgatgaatagatgagaaaatgcacatataatgccttgctgttgtatctacctccaaaatgcccaccgactcattccctctttgtcaattgggaattgaatcagggctggcttgtgactgcttagcccagtagaattagggagaagcggctttgccaatgatgggactaatttttaagaggactggaagtttctgcatcctttctcttggtacactctcatttgagatgcttcctcagagccagacaccatgctgtaagaagcccaaacagtggtgtgctgaaaaatatttaaaaaccagctctacccaaagaaggtgctgatttgtagcttttgccagttttcatgatataataccctctcctccatggctgaatacaaattacaatgtaacgtatagtgactgaactataaacttggtaaaagatgcatgcacagatatattagatatgtaaataatcacaaaagcacagattagtaaaatgtagcaaaataattagaaagtgaagaggtttcagtatcattttaaaatataatttatgcaattgtaagtttatataatttaatttttaataatggccgtgtttaacaactcgttcacagaattcctgaaaatttaacaattggttctcaccagctggtaaaagttggctccagcacatcacaagccagacccagcacactactgagcccacaccactgggggagtccatgtgtagggagtacagccaacagcttcaactgaccagtcagcatcaattgcctgccatgtgagtgagccctcttggacatccagcccagattagccttctgatgtattcagcctcagctgctatctgacttgaagtgtatgagacaatccaagtgagaacactcaactgagcctagttaacacacagaaccatgaaggataataatacattgttgctttaagccagtaagttttagggtgatttgttatgcagcaatagataacctggaacactggctcatagaaattgctcagtaaatagcagatattattattttgaatgttgcaattactggcagattaactgtaacagtatttcaaggaatgaggatcaatttattctgcaacaaataaaggagaagtccctttattacttttgcttgaggaccaggaatttttacacgatgagtgtaatttagcttgaattttccttaaaaactatacaactccagagaaaaagtctataattactttccacaatatagtctcccattggcctgctgtttactttcattctgccacagcagggactacgtgaaagtgaaattgcaccactgaagcccaaagaatcatgactaggcagctcttgttattccattttaaacaaagtctgagcgatttaataagagcagtagaaaggtccgtgaatgagctcactatctttttctatcctgcctagtcttaatattttctcagcttcttttagttaccagaagatagatgttaactgggacaaaatgttaatcgagaaacaactacaaccttgtttaatctcctgtcctcctcccatctcctcagggagaactctgtctttgctagttcagttcctatgtgagccattgttggacaaattggggtaatggttggggaggaattgagaggatctcagttatggttgcttaatttacattgatgagaacagaaagttgtttgcaggaaaaaaaaagagaataaagaaagaaaacaaagaggaaaaggagaaagcaaaaagtagcctgtgtaggcttttgaaggtgttaagttgtggggagcttggggtaggagaaagatttgaggagatgctgataactagggaggtcattgaaagagaggtagtaagagaaatacagacagagagagaggggatgaattttatgctgaattattttgttttctgaaacagagttgactatttgtagtataacctgggttaagtgtgttatgagtgttagctctctctggaatttttcttaacaaatggtattttttattattttcctttatattttggttattggacttgaatgtgagtgctttaagctagcaagacaccacaagaaagctcagctttatatgtgttatattcaactaaaatagaatttgtgctgtattcgtttaacaaagctcttcactttaaaagtgagtcatgattcaaacaaaacaactatttagaagaagcatttatgagataagaacttttgggcactgacaggatatttgatgattttgaatattattgctaatttttaaatttaatttgttattgtggtcgtgacatgtaaaaatcatttattttagagatacatactaaagtatttatggataaaatgatatcatattcaggactcactttgaaataatatggggttggggaaaaggtgagtggaagtgtagagaaaatgcgattatccattcattgacacttgttgaagttgggttattcatgaggaacatggagattcattatacaattctttctacttttgtgtatgcttgcaaatttccataataaaaagtgaagaaaaaagtgggcgagttaatatccattgttcttactctctggaaaatctaaattaactgctttttattatgacgtagtccatatttgctttttttttcctgtggtttgatggttcttgacaggaaaatgtaaccatcacccttaattatgaaaacatagactgagtgtttgctgatatttgagtataaggtgggatctacttaacacaatccaatactcaaaagtctcaatttaattagaatcaaatttcaagataattcttcagggacaaaacgatttccctggtgcatttgaaaaaggatttaatgaatgaaaactttttatgaataaaaacttgacttatgttctactttctgggactacacctattgtagaaacaaagggccaatattttccttctgtaaacacattaccttggtaggtgttctcatctcaccctctttactctttaaagggaaagaagcacaccagaatggcagaagactaagtcatgcagcttttatgtctcaactttctttccccagagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgagtaagtactaatactttggtgaaagacattatttttaaaaaatttaaaatgcagacggccctctgtatctgtgcattctgcatttgtcaattcaaacaaccatagattgaaaatatccttaaaaaaatcttgcgtcgatactgaacaagtacagaattttttctcattattcctaaacaatacagcataacaaggatttacatagcatttacattgtattaggcattataagtaatctagagatgatttaaaatatacattgatgttcataggctatacaaaaatacgaccctattttatatcaggaacttgagcatccgtggatttttgtattcatgggagtcctggaacaagatccctcaaggatacgaacggacgactgtatatattatcaatttcttggcatatagacatcataaattttaaaagtcaggtagttacacattgaaagctcagttagtacaatgcaatggggtcactttactagaatgttcattgtgaaaggatgtattcaaattcgaattgaatcttagtgatagcaagctttcaagtacacagttaccccaaaccaaacccccagtctattcccccaacttttgtgttccctcagtgttcttaatgtctataaaatgtatccaaccagtgctaaagtggaaaactcgagaacagtactagttaactccttctaactcacagccaattaataactaactcttgtatgcggcactgtacatccatttttaaaatcccttaaatattttggtggaattcttttacttctctccatctccaccactaccatcctattcctagccccatttctctcaccagactgtctacaataacctcctaaatggtctctctgcctccgttcttgaccctctatgggtcatcttctacatagcacccggagtaatcttttaatgtatatatcaggtcatgtccttactttgcttttaaaaccactcagtggctttccattacacgtagaataaaatccaaatgtcttataaagtcctacgaggccctgcagggtctggcttacatgtaacaatttcattaattttcacgacaatctttagagatgagtgtaatattacttttgactttcaggtgaggaaactgaagctaagtgagattactttatttgcccacacagttagaaattagagaagctaagatttaggtgtcaacttgtctgattccaaagccagtgctcttatttaataattcctaaatgatataaagatagtgattaaaactcaaagaaaagtcttgcaataaggaaatcttgcaaggaggatgggttttacttttaaaaggtaggatgctcttctccatctgtggtttcttgcagaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgaggtgagtgcagctcagggaactgagagccaatcagccaagcactgtttcaggtcttcattcatttactccttgggagagagagggcactccgttatggttttaaggggaccttatggaaatacagacatcccagggaagattcgtatataatctttagtaggctaacgtcttggttggaatggtgtctgggaattgtgcaatgataccacctttggccctgtgaccccaaattatctcaaatgtcagtttattattggccaccatttaaggaacacattatatgttggacattgtgctactgcctcctttgtacagataaggaaacagagaagtaatttgcccaagaacacatagcctaatgactaagccaggattgaaacctatgtctgtctggctttaaagcctgggccctttccaccatatcataccaccttagcctttggcatgttataggctgccaaccctactcaaaacaatttcagaggttagattttttttacaattaaaaagtaataaaatgtacatataagaaaatgcacaaatcctaagtatacaccctctgaattttgacaaatgcatacatctatgtaatccaaacccctattaagatatagaatgttggccaggtgcagtgccacacctgtaatcccagcactttgggaggtcaaggtgggaggatcacttgaactcaggagtttgagaccagcctgggcaatatagtgaaaccccatctccacaaaaaaattaaaaaattagccaggcatggtagtgtgtgcctgtggtccagctacatgagaggcttaggcgggaggattgcttgagaccagaagatcaaggatgcagtgagccctgactgcaccactgcattccagcctaggcaacagagcaagattctgtatttttaaaaagatatagaatattactatcacctctgaaagcccccttgtgccctttccaagtgaagctctgaaactactacctgcagtggcaatcactgttcttatatttttctgcgatagtttttcctgttctacaacattatataaatgaaatcttataatatgtactgttttatataaggcttctttcatgtagcataatttttttttttagtcatccttttgtttcagtagtttgttcctcctttttattgctgaataatattccaacgactgggtacacaacagattccttgtctgttctcctcttgatggacatttggattgtttccagtttggctattatgaataatcctgctatgaacctttgtgtataagtctttatgtgatcatattatttctatgtcttggataaatacctaggaatggaattgctggctcataggtacatgtttattatttatttatttattatttattttttgagatggagtctcactctgctgcccaggctggagtgcagtggcactatatctccccaccgcaacctctgcctcccagattcaagcgattctcctgcctcagcctcccatatagctgggattacagccactcaccaccatatccagctaatttttgtatttttagtagagacggggtttagccatgttggccaggccggtctcaaactcttggcctcaagttatccacccacctcggccttccaaaatgctgggattacaggtgtgagctacctcacccggcctgtaggtatatgtttaaatgtattagaaactgtcatagtgttttctagagtggtaaatgatgtggagtaatttttcatgttcatatttgttatttgtatgtctttggtgaaatatctgttaaaatcttttgcccatttttaaatggggtagttttctttctttattgcaatagtttttgggatacatgtggtttggggttacatggataatttgtttagtagtgatttctgagattttagtgtactcgtcacctgagcagtatacactctgtccccaatatgtagtcttttatccttcaccccccccaccactctttcccttgagtccccaaagtccattacatcattcttatgcctttgtgtccccatagtctagctcctacttataagtgagaatatatgatatttggttttccattcctgagttacttcacttagaataacagcctctagttccatccaagttactgcaaaagacatgatttcattcctttttatggctgagtagtattccatggtgtatatataccacattttctttatctacttgtttggttgatggacacttaggttggttccatatctttgcaactgtgaattgtgctgctttaaacatgtgtgtgcatgtgcctttttcatataatgacttcttttcctttgaatagatacccagtagtgggattgctagatggaatggtagttctcagtttagttctttaagggatctccatactgttttccacagtggttgtattaatttacattcccaccagctgtataaaagtgtttccttttcaccacatccatgccaacatctattgttttttgactttttaattatggccattcttgcaggagtaaggtggtatctcatggtggttttaatttgcatttccctgatggttagtgatattgagcattttttcatatgtttgttgggtgtttgtatatcttcttttgagaattgtctacgcatgtcctttgcccactttttgataggatcctttgattttttcttgctgatttgtttgaattccttgtagattctggatgctagtcctttgttggatgcatagtttgcaaatgttttctcccactctttggattgcctgttgactctgctgattatttcttttgttgtgcagaagctttttagtttaatttgatcccatttatttgtttctgtttgtgcatttgcttttggggtcttagtcatgaattctttgcctaggccaatgttcagaagagttttttccaatgttatcttctagaatttttatggtttcaggtcttatatctaagactcttacatttaagactttgatccatcttgcgttaatttttgtataatgcgagggatggggatccagtttcatttttctccgtgtggcttaccaattatcccagcaccatttgtggaacagggtgtcccttctccactttatgttttcacttgctttgtcaaagatagttggctgtaagtatttggctttatttctgggttttctattctgttctattggtctacatacctatttttataccaataccatgctgttttggtaactatagccttgcagtataatttgaagttgggtaatatgatgcctccagatttgttctttttgctttgaattgctttggctatgtggacttttttgattccatatgaattttagaatttttttctagttctgtaagaatgatgatattttggtgggaattgcattatctatagattgcttttggcagtatggccattttcacagtattgattctttccatcatgagcaagggatgtgtttccatttgtttgtgtcatctatgatttctttcaacagtgtttcgtagttttccttgtagagatctttcacctccttgattaagtatattcctgggtattgtattgtattgtattgtattgtattgtattgtattgtattgtattgtattgtattgtattgtattgtattttgcagctgttgtaaaaagattgagttttttatttgattcacagcttggtcgctgttggtgtatagcagtgctgctgatttgtgtacattgattttgtaacctgagactttactgaattcgtttatcagatgtaggagctttttgaatgagtcgttatggttttctaggtatacgttcacatcattggtgaacagcaacagcttgacttcctgtttccaatttggatgccctttatttcttactcatgtctgattgctatgactaggacttccagtactatgttgaacagaaatggtaaaagtgggcatcccttttattattgagttgtaagtgttctttacacattctggatacaaacaatttatcagatgtatgttttgaaaatgttttccgtatgacttgcctatctattttctcaataatgtctttcaatgagcagtttttcactttcttgttttctttccttttttttttttttttttttttttgttgttgttgttgttgtttgagagtgggtctcgctctttcacccagactgaaatgctgtggcttgaacacagatcactgcagccttgacctcctgggctcaagcaatcctcctgcctcaacctcacatgtagctgtggccacaggcacgcaccaccatgcctgactgattttttaattttttgtagagatggggctctcactttgttgcccagactgatctcgaactcctgggctcaggcaatcctcccaccttggcctaccaaagtgctgggattacaggcgtgtgccattgtgctcaccaaaagttttaaattttcgtgaagtctaatttatagttctgttttcttttatgaataaccatatatgacttgtctatgatacctttgtctatcaggaagccatgaagacattctcttatgcttttctttaaaagctttatgattttagcttttatgtttagaactcaattaattgatttatgtattgcatgaggtaggagttgaggatcattttgttttacgtggatatccagtatttccagcatcatttgttgaaaagacttttccttccccattggcttgctttggtacctttgacaaaaagtcaaattttgtataaatgtaaggctatttctggactttcctatactgtttttttttttttttaaactcgtatgttattaccaggtcgtcttggttcctgaagtgttgaagtcaggtaatatgaatacttcaacattgttgcttttcaagattgctttggttattctaagccttttgcatgtccatataaattttcaaatctgctgatcaatttgtataaaaaacttgctgagattacgatttggattgagttgaagttattggtcaattttgggagaatttatttcttagtaatattgagtcttctaatctaggaacatttatttagttctatttacatttctctgagcaatgttttgtagtttaggtggggagatattgcatgtcttttgataaatttattcctaagtattttgatttttgatactgttgaaaatggaatagttttaaaactagatattccaattatttgctgctagtatatgaaatgcaattgattatatatgaaatattatttatattatatgctatatatatacacattttgtttcttatgcacttgctaaattcacttattgcttctagtaattgttttagagattccttagaactttccatgtaagccaacatcatgtgacaatagagagttttatgtattctttactgatctttattccttttatttctttttgggggcctattctgatgtttaatacttccaataaaatgttgaatagaagtggttgaagtgggcatccttgtcttatttttaatattaggagaaaagtattcactgtttttccattactgtgatgttacccatttttgttttgtttttttaaaagatgttctttatttgattgaggtagttaccttctattcttggtttcctgaaaagatttatcacaaattgttgttgaattttgtcaaaacctttttctgtatctctcgaagtaatcttttggctttcctctttatcctcttaatatggtaaattatattgattttaaaatattaagccaatcttgaattcctagaaaaaaccctactggtcatcatgcatcatcatgtttatgtattgctattttctaagtgcttatgttttgtgaagtatttttgcccttacattcatgaagagtattggtctgaaattttcttttttttgtgatttctttgtcaggctttagaaagattttggcaacattctaaaagtgagttgggaaacggtccctcttctactttcagaaagagtttgtgtaacattgctgtcatttcattaaatgcttgatagggttcactaggaaaccctctgggtctgaaatttctttgtgggaagttttttgatatcaaactagatttatttagtggatagagagccattcagattttctgattcatcttgtgtcagtttttggatagttgtatttttctaagagtttatttcatctaacttgtcaagcttattggcaataatttataatattttcctatttttttaacatctgtaggatttatagcaggagtcagcaaagtttctgtaaagggcagataataaatattttaggctttgcaacccacaggtggtctctgtctgctgaatgttcttatatgtttgtttttgttctgctctccgttcctcttgccccctgccctctcctccccttctttctcttctctcttctccttccctcctttctcctgtcttctccttccctctcttctcctctcctctccctccctctcttctcctctcctttccagccctctctattcttctcctcttcttcccttgctgtcctctgttttcctttcctctcttattctctcctctccctctgcttctttctttgtgcaaccgtttaaaaatgaaatgtatgttgtgcaactctcaccaccatatgtctgcagaacgttgttcatcttcccaaagctactggggaggtcagcctcctcagtagctgacccgttgaataacaagtccccattcgtccctttcctagcccttgacaaccacaattcttccgatccctgtgattttgactactctaggtacctcatgtaaatggaataataccatatttgtcctttgtgactggcttttttcactttgcaaaatgtcttcagggttcatctatgttgtagcatgttagaatttgctaattttttagggctgaataatgttccattgtatgtatttaccacactttgttcatccattcatacaggggttctttttgaagtgatggaaatgttctaaaattgattgtagtgatagttgcacaactctgaatgtggtgaaagctaatgaactgtatactttaaatgggtgaagtatatggtatgtgagtaaagtctcaataaagctgttaccaaaaaaaaaaaaaaaagccacgaaacctaaaagtgacatgtaaaatctattcttagctcagggcaacataaaaacaagccttaggaaggatttggcttgctgattcatttgtcaacctctgatttatagtaataaatcctctttcatttctgatattggtaatttctttttttgctcctttatttttgatagtatagggatttttccattttgttgatccttttaaacaacctttggccttgttaattttccctattacttgttttctactttttgatatctgattttatgtttattacttcctttcttgtacttattttggttttagttttatcttctttacatagctgctgctgctgctgctgcctcctcctcctcctcttcttcttcttcttcttcttcctcttcttcttcctcctcctcctcctcctcctcctcctcttcttcttcttcttcttcttcttcttcttcttcttcttcttcttcctcctcctcctcctcctcttcctcctcctcctcctccttcttcttctccttctccttcttcttctttttcttcttcttttaagatgaggtctctctgtcacccaggctggagtgcagtggtgtgaccgtagctcacagcagcttcgaactcctggactcaagcaatcctcccacctcagcctccccagtagctgggactacaggcacgtaccaccacacctggctaatttttagattttttatttttgtaaagacagggtctttctttgttgcccacagtggtctcgaactcctagcttcaagcaatcctcctgcctcagcctcccaaagtgctggggttacaggtgtaagctactacccctggcctgtctagcttcttaatgtggatctatatatcattcattttagacctttcttcttttctaacataatcctaaaaagctgtaaatatctttctaagcactgctttagctgtagtccacaaatttttatatgttgtattttattatgtcagttcaaaatattttatattttttttagtccgtgaattatttaggagtgtattgtttaaattacaagtatttgggggctatctaagatatcgtattattattttttcagacagggtctcactctgtcacctaggctgaagtgcagtggcacaatcacgactcactgtagcctcagcctcctgggctcagatgatcctcccacctcagcctcccgagtagctgggaccacaggtgcatgtcaccacacctcgctactttttaaaacattgtttgtaaagatgagatctctccatgctgcccaggctggtctcaaactcagcctctcaaagtgttgggattgcaggcatgagccaccccaccaagcctgagatatcttattgttattgatttcttgtttatttcattttggtcacagaatatacttagtataatttcaatccatttacatttgttgaaatttattgtattagtcagagttctctagagggacagaactagtaggatatatatgtatgtatatatatatgtatataaatacacacacacacacatatatatgagagtttattaagtattaacttacatgatcacaaggtcccacaataggctgtctgcaagcttgaggagcaaggagagccagtccgagtctcaaaattgaagaatttggagtctgatgttctaaggcaggaagcatctagcacaggagaaagatgcaggctgggaggctaagccagtctctccttttcatgtttttctgcctgctttatatttgctggaagctgattagatagatggtgtccattccaattaagggtgggtctgcctttcccagcccactgactcaaatgttaatctcctttggcaacacccccacagacacacccaggatcaatactctgtattcttcaatccaatcaagttgacactcagtattaaccatcacaagtccatcccttttcaagttgaacccatacacatttcctgagatcatacataatcttcaaataaagacaacaataaggtcataattatgcctaacataatacaactatcctttgtacaactggaaatgcacaaatccccaacacaaatactattacataaaattaacaatacttaaatgctgatatgaagtcagtaaatcctatgtcacacgataaaagaaaaaaaaataaaatgaagatttttcttagtacaagtgtatacatgcacaaacatgtttttaacaaaagaaggaggaaatattcatgacaattacagtctccgtttttgtagctggtcatgtggtcgtagctggtattgatgactacattcttctgctacccattctctattccctttgccttcagcaagcacctctgcaggtcgtggtttttttcctggtggagtgacccaagccttcatttttgaagggtctgggccatttgtagtcctgcctggattgggctgttgtagtttcccattgaccttaatcacagggcatggtaattctaagagatgccctagtggatctcctgtattccatgcataccttacctccgttgtagagtagtagactgatttcatcttgatagtccggatcaatcaccccagccaacactgtaactcccttcttagcctattgacttaaaggtaggaggaacccaaagtgtccaggtggcaatcttaacttccagtttaaggagatcgatgttgtgtctcttggtggcagcgttcctccctctggaactaagacctctaggccagcagaatgtaatgtcgtgggaacaggaagcaaaagttttgctagtggatcattaggggtgatggtgagtggtgccacttccacttccaactcttgattcctggaactgtgaatcctggctatgggaaaaaaagtaccatatattggacgctgatttagagcacttattttatatcccaatgtgtgatttattttggtgaatgtttcacatggacttcaaaaaaaatgtgcattctacagttgttggatataaatagcaattaggtcaaggtgccagcagtgttgttccaatcatctttgttctatcctagttgttctctaattgagaagggtgttaaaatctctaactttgtgcaactgtctatttctccatttagtcctttcaaattttgctttgtttattttggggctcttttattaagcacatatacatttgtgttggtttgtctttctaatactaatcctacccctaaacatatttatcattattaaatacccctctttatctctgtcttgaagttattttatctggtttgaatataaaaaaccaagtcatccaagccttcttatggttactctaaaaggtatgtatgtatattttatattcatttgcttcctagctgtctttatatttaaagtgtacctcttgtagatagcatatagtttgtgttttattttttacccatcctgataatatctgacttttaattggagcgtgtagtttttttaacatttaatgtaattatttatgtggttggatttgagctaccattttattttaatttctgtctatccctctggcttttgttcctctgttccttctttcctgttgtctcttgctttattttaatatttattatagttgctttttaattgtttactgactctttaattatatatatttgcctttctttctttctttctttctttctttctttctttctttctttctttctttctttctttcttctttcttcctttcctttcctttcctttcctttctttttggagtctccctctgtcaccgaggttggagtgcagtggcacaatctgggctcagtgcaacctctgcctctcgggttcaagcgattctcgtgcctcagcctccagagtagtggggactaaaggcatgtgccaccacgcatgggctgttgtttttttatttatttatttttttatttttagtagagacagggtttcaccatgttggtcaggctggtttcaaactcctgacctgaagtgatccaccagccttgacctcccaaagtgctgggattacaggtgtgagccaccatgcctggcctgcattgttttcttaatggttgctctagagattataatatacacttgtatatttttttacagtctacttagagttaatattgtactgcttcatgtaaaatgtagaaactttaaaccagacgtgtcaatttataccccctgttttttatgctataattgtcacacacatattttacacaagaagattataaacttcacaagacaatgttatagtcattactttaaaaagtcctatgttacttaaaaaattgagagaaaaaatggttttttacatttacctagatatgtattatttttggtgctcttcactccttcctgaaggtcagagttctatttggtatcacttcccttcagcttaaaaaaattcacttaggatttattgtagtgcaggtctgataatgataaattttctgagtttttaatttatctgaaaatgtctttattttatctttatgcttgaaggatatttttgtttgtaataggattcaggattggcaagtccttcccccagcccccagcattttaaagatgtcatttcactctcttctggcctttatgttttctgaagagaaatcagtaatcatttgagttcttgtttctctgtatataatgtgtaatttttctctggctttttaaaatattttctttgatattctgcagtttgactattatatgcctgggcattttttttttctttgtacttatcctgctaagggtttgctgagcttcttgaatatgtaaatttataccttttactgaatttggggaaattttcactgttattccttcaaatactgtttcctcaccattttctctttcctctccttttgagactccaattacttgtatgtaagatcttttgatactcccccacatatccctgagactgttcatgtttttaatcatttcactatctattcttccaaaaggatcatttatattgatctacctttaaatttgcagacatctgttgttttcatgttactattggacccatcctgtgcaattttttaaattgtacagtttttagaattcatgctaaatgaatagattttagctactcttgccacaaaaacaacaaaaaaagaggtaactatgtgagaccatggatatgttaatttgcttcactatagtaacctttttactctctatatgtatcccgtaatattatgttatataccttaaatacacacaataaaatttactttttaaaaattccaattatactcaaagtttagaatttctgttttgtttgtttctgtttctttttaaccattatttcctctctccattaattgcaaacatattatcttttaaatacctcagcatagttatactagctgctttaaaatccttgtctgctaattctaatatctggaaaatctcaaggtttaactccattgattatcttttaaaaatgggtcacattttttcttcacgtattgagtaattttggactatgtcctgggttttataaatgttatatatatgaacactctagattctactctattcttttgtagattatagatttttgtcataacaggcaattaacttggttggactatactgtagacaccaactcttgattggcagttcaaatctcagttaattcctttattcttagtggaagtatgtcctgtacatatgtggtccagaggtcaggcatatatttgggcagaatttatactcagaattttggatcccgctttccattccagatgtccaccacaacccccatcacctcccagtggctatggttgccctggcttttgtttctggttcttcattccacaaagactgcaattaaaaaaaaaatcaaagttttagatgtccttcacagcattagtttcagcctgccatcaggctacaagatgtaaaaacgggtaccccaccttgtgatgttacctttttccaagtgtttactcttctccagaaactgtctgcttttggtaattttccagtgccttcaagtcgttgttactttgtattgttgttatatgcaggagagttgagtttattaggagctacttagccatattgaaacagatgttgaattcccagtgtattttgtttacaatggggttttctatcatgaatcttggtggagagacaaaccaaacaacaccagttgtattcttggtgccaaactgcttacatattgaagctaaatcatgacctctccatggtacttgattgccctagcagagttcatttctgcttagcaaagagccatatgggttttgagactacaagtcatttttagaaatattattcacttttaacccccactatacacccagctagataatagcaacttgagaggcagcatagataattttaaaaagtgggccaaaattgcatatatctttgttcacccacatcccagttgtgtgatcctaagcaattcacttaatctttctacgccatttcctgttgccataatacaacgtacctctcagagttgatagagagattaaatgggagaatgcaggtaagtgtgtccacatattctgttttgtatgggagaatccagatttatggctgtggacttagtgtaattattaacaaagcccttttgactctcaaaaatgttccagtacttgtcaaatactattaccaatcaactcagcaaatacttctgatagtggatgtcttgttccattttgtgctgctataacagaataccacagaatggataatttctgatgaacagaaatttattggttcacagttctggtggctgggaagttgaagatcaaggggccgcctgcggtgagagccttcttgctgtgtcatccaatggcagatgtgcaaagagagggagagagagaacaaaagattgaactcacagcctcaagcccttttataattggcattaatccattcaacagggtggagccttcatgacctaaacatatcccattgtgccccagcccccattattatcacattggggattaagtttctagtacatgctttttgggggacatattcaaaccatagctgtgagcatgcagcagaattgctaagcgctaatgcctcacttccctgcttcactttttaaccaaaacattgctccataaactatgaggaaagtgcctaatatcattgtattgtgttttttattgttactttgttttttccttttaacatatggaggaaggtagcctgagttccaagactggtctttatttctgataatcagggcaaatgacctaatttgtcatttccctctcatctctattattacccaggtgaaaggagatcaaagggagagaacctcaggaataggcttagaaaggaaaagatgatgtgtgtttgtgtctatgtctgtgtgtaccaggatcatgtcttggcctgtgactgtgtgtgtgtgtgtgtgaaaagtgtatcatcgcttatggagctagttcccacctttcagtcctttgggtgatattctgaggctgagctggggtgggaggtgggcaggacttcactatgatgaatgaagactccaattttcattttttggcttttcttggcagattttcctaggcaatgtccctgtgggagggattttggcttccatatatttgcctaaatcactgacggagagaattcctcttagcaacttacaaacgatcttgtttaatttctttggccaaacttcactctttaaggtaaattcttgcctgtggtaactgtgatgaactggcatatggtgactcattgtaattatgaactcttgctattttcatgatgttctgcttattttagaatatgctgattgattccacaagtcttccaacacaacccctgccccttaacatgaatcaacgtctactttaatgatgttctacagtttttagttttcacaatatctcagctttggaaggaaacttaaggattatctggtggctaaacagaggcctcaagatgtttcaaagccaaaaaagaacagcgagttctcctgatgaaatgatgtttcggcttatcagtgctttcctcccaaatctcccctggctcctcaaagccaacatgtccactattcttggccaattcctttgaagttgggtggtatccagaaggacatttgcctgcaggcatttgttgctacttcccacagcccccacagaactttctctgaaggctgcagtcctcacccactagaaaacagaggcagcatgatgtgatgctgaagagtgtggactcaggggcaggctggttgaattaaaagctggcaatgccatattctgcctgtgtgtcctcaagcaagttactcaaccttcatgtgccttaatttccttctctgtagtatagggtaataagaattccttatagagctattgaaggattaaaggaattggtgtatttaaagtgcttacaataccgcttggcacataagtaccatgttaagtgtttgctctactattattagtatcctgtcttaggtctctgcctaacaaaagcctcattcgtttagaccactctgtctcatctagctattgggaagacagtaatcagagtttgcatgaatttgaagataatgaacactattaattgttaatatttacatttattatttcatctacttctcatgagaagctgatactcaaaaaggttaagtaatttttcccaaggccacatacctaaaaagtggcatagctaggaatcaaacccaggctatctgacttcaaagttcatgtatttaaagtcaatacaataattttcccagatgtgtttgtatttctaaagaggttatccaaagtaatgaatttctaatggtcaaatatccacatttcttttgtgggaggttgcactgggccagctcaaaatatagcacatacccataccacacgccacctcaaatataccatgtcacctccagctatgtctgtaagactttctgttcccctggagttctctagccactcctttctctctctaaattctatgtgttcctgtgggcttagctcaaatcccacccagggtggctgcctggagtaagtgagtctctgctctccttcctgcctcctgggcaaaatatttagtgggcaaaacattttaataaaaattaaaaatatgctccacaacactttgacccttttggtaggcttacaatttctctttgtcacttgagatgccattattttggtcttaatttctctcctttcttcagagggctgtgcttgtctcgtagaataagagataaacttgttttgcatagatttcacacttaataagtcatttttattcactaacactttctactggaagagattaaagatctttgccaaaattaaactgcaaacatcatagtaccagatgaagaaggattagaactagcctgcttcaaattcagagttgaaagggccctcctaactcatatcatcccatctattcattttaccattggtaaaagtaaaatggatattgaggacctcgagtctcagagaggggaaggaatctgctgaaggtgtcacaatttattcattcattcactcaatcatttattcattcagcaaatatttatttaattcctactgtgtgtcttgtacggtgctgaatgctgaggatgcaatgctgagcaagatacatagtgcctgctctcatggaacttccagtctgctggaggggaaaacagacctaaatgttctaacattaaaggggtgaccctaggctgggatctgtgccactggttattggggaaagagtacttacaaaaatgctgctctttaattctatttttcttgaatccccgagtatcacagccttgctttcgcactactttctctaatattttttgatcaaaatcttaagtcattatgacacataaccttagaaatttgtttgtttgtttgtttgtgtcttttaaagacaggatctcgctctgccacccaggctggagtgtagtggtgcaatcacagctcactgcaacctctaactcctgggttcaagagatcctcctggctcagcctcccaagtagctgggaatataggtgctcaccactgtgcctggttaattttcatatttttttgtagagatggggtctcactttgttgcccaagctggtctcaaactcctggtctcaagccatcctcctgtctctgcctcccaaagcgttaggtttacaggcatgagccaccgtgcctggtccatagaaattgttgataaggcaccactcttggataatatgtgtctcctcctccacacctcctctagctgtgattctcagggagagggacaggcactaggcggttacaatatggcacaggggctctgggtgcatagaagagggaatctaccactcatctggaagatcaggaaagtgcagtgagagaaaggtctcagcggagccctgaagttgagtaggagctcaaagatgaaatagggcaaagagaaggagagaagagagtttcagagagagggaatagcttgtctaaaagttcagaggtgtaacagataaaacttgagcctacagtgcaaagggtggaaggatgaggaagtttctattcctttcctggcatggctaccgttttgtagtaagggaaatgaaaccagagaaaaggctaattaagttttggatcatagtgtgtgtctcctcctttggccttttcactacagaaaactgcgtcacttagactaagttgggaggatcattaaataacatctagtctgccatctttcctagtgtcaccaatagaccaggaaggggtaatagggcttaggaggaacaagagagctagggttagcccttagccttttgagtgtcagcagggcccttcccattatatcttgctgttggccatctctaaatcaggttgccccaggctggttttgaatgaacagaacaggtcagaaacaggaagtaagtagagtcctagtggagccccaggctgaatttgcaactacccaggctgcagggctcaggtgtgtagggtaggtagtagggactgcacactgtttcttcagaaatatgaagccttggcatcttctaaaagtggcccagcaggatctccaaggaatgtcatctgcgttcacgtcctctaggcttttgtggggaagtcctcagagatttttcttcctctccctcttgtctggtatcaccagccctacctgtggcctcttcacatgtgcctgtgccccagaacaggcagcatctcagctgacttgcatcctggagccttggcctggggtactttggcactgttagttagcaagccccacttctcaagagatacattctagtttgttgcctttaaaccaacatttattaagcattcctgccctgtcacccactagctgagtgatctttatccatttaggcactgagccactcaagcctcagtttatctgaaaaatgcttatatggcttcaatgaggactgcaaatggcatgtgcatgaaaagcacataataagtggctcactgtgggcacaagacacctgctgtgtcctaggatatgtgaggaacaccaggctatacaatgcctgggctctggcctcagagctcacagtcccctaagaaggcgatgactgtcctctgaaatttgtttcaaactgggtgttgatcaacctgcttccatctctgtcagaatagaacaagaagtggtttataacttacaaatgatagatttaggtttcttatagaggagctccctaaaagtaagcaaggatggttgagagttagaactgggataagttgtgaaatgtcaaggtccagaaagttaccaaaatagagaatagtttcattttgttgctagtgcagtactgagtagcaggtgcaaaacaaatgcgtgctaaatacacatttggttggatggatggatggattaatgaattgttctagcttggtataatggagaccttatgtgaagacaggagatgagctgaataacctttgaccttagcttgcaattttattttccacatttctgtacctaacattgtgtgtagcacttcaaaattccagattgattattaatatgtaagtaattagaaatttaggtcctgaactcctcttttgtttcatctgcagaccaaaaatgtcactaaagcattaaccacctatgttgtgagtgccagcatttcagatgatatgttcattcaaaacttagctgacccagtggttatcactctgcagcatattggaggaaaccaggtaatatatctattttcagctcagaatcaaatggcctcaggaactcttcacgacttttctgttaaaagtaatttgttaattaacagatgtgattctaacacttaatgaggaatgtcctattccaggtagcaaatgtgtgttataattggaaccttccagaaataatgccttatcctaaagtgatagggaatgatgggcattctagcactgtgacagattggtggggcagtgactggatcttttggatgtcccatcacactaaatgacatgtgattccatttatttttgagcgagacaagcaacttcactcaaaataattgaatatttgtattacttgaatttccagaaataacattaaaacgtgtatgaattatcaccaaagaactaaaagcatagtcatatggcataacataagctatatattactaaataatcaactttagcctaagtacaagtatgaatgactattccattatttgacgttagtgtatggccagtgtgacgtctcaatagatttctcagttcccagtctaaaagaccatatagttcagcatacttttcactggtcttgattctagaagggaagaagagaaggaagagagggagaggaaatttaaagaaacaaataccaaatgaaacgtgttagataggtaagatctctcaatttggtctgggctacagcacttcaattatccccggtaactaattgctccttgcctgcagtttcctggagactacaggagctggtgaagtcttaggaatgttctgtaggcctaatgatggggcagatcaaatttctgtccataaggcttgatctcagcggtgagccccgaattccaaagctccagaaggaacacatcagccctgcattgactatccatagccttgtaccagaagggcatggcaatttttaatactaccaaatattttaaaggacatatcagatcaccagccggtgacatgctgttttctcacttgtaaatccagagttagatggtggagttagtctaaaagccaattcacaaatggcccaaatgtgtatgtgtatgtgtgtgtgcatgtcagtgtgtgcatgtttaccatgggaaaaaatattgggaagaaaacacttatgtgtatatgttactatatggtaaatatcacaaggcaagatgtttacctctgatttctttttttccagaattatggtcaagttcactgtgccttttgggattttgagaataatagtaagtatttttgttagcaactttgactttgccccagaccattttcccacttggcagttaaatgggagggggttgtgctgaaactactgtcttatcagaccctacagagcattctgaatgaccaagatacaggatatgatttttatatcaaattagggcatgggaattaagacaactttcctttttgataggtaagatctctcaattggtgctggggctacagtgctccaatcatgcccaataactaattgctccttacctgcagtttcctgaagattataggagcttattacaagtatcttaggccccaaaaataattatttggaaaatcagaaaaattacacaactcgagggtaagcaaagttggaagaaagaaatttggaaggcccagcgcagagtagccttgaactgtttgaagaaagttgaggaaggaatacctggttctttatctgtgctctcccacagggttttgcaagatctatgatctccttccctttttttttcctcacctcttttagactgactgtgtgaccttgggtagacaatttaccccctctgagccccagtctttttatcttttcattgaggagatgaaacttcttggttggtctctaaggaccctacttgcttgaataagcatgagtctttggagacagacagtagaagactgggaatggtcattgctgactgggttgctcttagcattgccatcttcactggaaatatccagggttatcaccaaatctcagagaatttccacacagaataaatttccctaagaacgccaggagtggctaagtgaggagtccttctgcctgtggaaactctgcctggaacctttccctttttcactatccttggaattctgggacaaaatggaaattctcttcccattcggctccctagagtataagaatactacttctttctgacaaacaaaaataacactgccctttcctgatcccctccaagtctctcaggataaaactctataaagcgatgagctttgtcccctacaacctcaatatgttgatctctatgttcattaacgcaaattgctggggtactcccaggtcaccctttgcccctgcacctctgccccgtggatctagaacctctggaatctatggcattatcccagatggacaaatgttgaccaaacttagctgcctgcccggggataacccctttggtctagtgccacttgggaagttctagtctcaaatctgatctagtacctgagatctacaggttgtggaggtatgagtgttagttctaaacctgagtgtgctcagaagaaactagccagatgtctagtagagcagaggctctaattggccctgcagagctccagaccatgatctgactttgattgaaagcacttgagaccctttgaattgcgggttcagctgggtgttcagatgtctattccagtccctctgagtaagctcaagtaccagcttatattccatacgtccatgtccttaaaaatattctagatctgcttgcttcctatttattggctacttaaaaaaaagttcatggttagagtctgtcctaatttgtagaggtatggtacaagaacaggaaaagggagagccgaagaagttgtgccatttacgaagtccccaaaaagtcaatttagtctgttagacttaatttaatttcagtgttcaattatacccctaatcttgctatctcagcaaataatattaattataacacacgtttggatagtgaatataatgaaaagttaaacatttctgagaaaaacaaaattgctttgaaatttccttctgtctcctacagatgggctgggtggatggaattcgtcaggctgtaaagtaaaggaaacaaatgtaaattacacaatctgtcagtgtgaccacctcacccattttggagtcttaatggtgagttgtctcttagtcactcctcgatggaagtttgacaatttttattagaccagtaatatatgtgtgaactgttattaaaaaatggtatgcatttggaaaaaaatcccccttccaatttgttcatccaaagtagatcagattgagacaaatatttatttatttattctccttataaaattaatgcttgcttctcaaatttcaaacagtacagaaaaggtccctttaacctccctcccaagtgatcaccacctttaacaggctaacatgtatattcatttaggttcttttcctgtgtatataggaatgtacatttttgttttataaacatggtatcaaattattcatactgtttttaccgattgcttttctcatttaacaatatatattgcacaactttcaggcaaatgtgtatgtatctattatacttcaatttttaaaatacctttatagtataccattgcttgggtttaacacaataaatttaactaatccctgactagtggacattatagctgttgctgtttttctcattataaatattgctgtaatacacattcttactcatgtatcttcaaacattggtgtaagtatttttgcaggataagttgacagaagtagaattgctggattaaagggtctggtcattaaaatatttaaatttaagaaggatcataagtatttgctgagtttttcttccaaatgactctcaaatgtattcctttttctctacccgcatcagaatactttcctggatttcttaggtaactttattacatactgttatctgaatgtgtcatatgttacttattcctacaaagaatggttagctttttgagggctgtgggtctgttttatatttatttattttacatatatatatatatatatatgtatgtatatatatatattttttttttgagatggagtcttgctctgtcacccaggctggagtgcagtggttctatcttggctcactgcaagctccgcctccctggcagaggtgggaagaatcacctgagtccagggaggttgaggctgcagtaggccgtggtcaggccactgcactccagcctgggcaaaagagtgagaacctgtcccaaaaaaaaaaaaaaaaagagagagagagagagagaccagggttcttgttccagctctgtctgtaactaactatgtgatcttggtaaggttgtttccctcttttggatcttagattttcttctgaaatgtgaatgactggaatacaccagggtttctcaatcttggcactatagatattctggccaaatagttctgtctttttttttttttttcttaacggagtcttgctctgtcaccaggctggagtgcagtggtgcaatctcgggtcactgcaacttctacctcctggtttcaagtgatactcctgcctcagcctccccagtagctgggattacaggtgcccaccaccacacccagctaacttttgtattttttaagtagggacggggtttcaccattttggccaggatggtctcaatctcctgacctcgtgatctgtccacctcagcctcccaaggtgctgagattacaggcatgagccaccccgcccggccccaaataattctttgtcgtgggggattgttctgtgcattgtgagaagtttagcagcatccttggtctttccccactagatgccagtagcactctccccagttgtgacaaccaaaaatgtctccagatactgccaaatgtccctgggagaggggtaacatcactcctggttgagaactaccaaagtaaacactgcttcttaacctttgatgagtcatgaatctctaatcatctgatgaaagctatggactttgttcttagaccagtgcacacatatattcaaataattttacatgtcatttcagatctttaatagtaattaataaatcactgaactttgtgatctctaaggtccattttgtttgttaattttgtgaaggctatttaaggactaaggaaaaggacttttttttttttttttttttttttgctgttctgtgtagtgttttgagatgctcagttcagataattattcactttgcatcccaaattcacatctctcagcttggttatattttaaatgtagaacatgttaatgatgatgaagccaaggaccaaatgttcttccaatgctattgatggctccccatgccctgtacacagtcagttggactaggcatactcagcaaacaatatttggtcttaccatacatccattcacataatctggttttagaagagctatggcagaaatgttatacatcctgggaacttcctgttagtgaacactggaagcattttgccataaacttgctctggtgtatgtgtaaaacacaacacattgtgttccttaggatttatccaggtctacagtggattcagtgaatgaacagatattagcgcttataacatacaccggatgtggaatctcctccatttttctgggagttgcagtggtgacatacatagcttttcagtaagttgatacagccttgctctgagcacatttaatttggtttgatggatgctattaccattgtaactttgttaatttcatgaacacatcacaataggaagaagtcagatccattagcttatgaagtggacaggttaaaaacaaaacatcaaggcttctctaaaaatattttaattggatttttgtaaaacaagggagttgggataggaaaagatttctctataggatataagagcaccaaccctaaaagaaaatttgataaagtggactttattaagaacttctttaatcaaaagacacaattcagatagtgaaaggcaaaccttacatagagagaagatattcacaatgcatatatcagataaaagacttgtatgcagaatgtataaataactccacaaatcaaaaagcaaaagacaataaagtttataaatggacaaaagacttgaacaggcacctcacaaaagagaatatccatgcctaagcctaacccttaccaaatggccaataagcatatgacaaagttctttacatcattactcatcagagaaatcctaattacaaccacagttatgtacttctctgcacccaccagaatggctaaaattaaaaataatgacaatagcaagtgtcaacaagcatgtggaacaactggaactcatacatttgctagtgggaatgtaaaatggttcagacactttggaaaattattcggcaatacctgttaaatataaatatacatctcgctgttggcccaggaatttcactcttagatatatactcaagacaaatgagcacatatgtccactgaaagatatgtacaataatatttatagcagcttcagtcacagtagcttcaaattagaaacaaccccaatttacattaacagttgattagatgaataaattgtgatatatttgtaaaatggaatgctacacagcagtaaaaaatgaattacttctatgcaatgcaacataatatttaaatctcatagacatagaattgagcaaaggaagccagaaaaataagacaacgtactgtgtggttccatttacaaaaagttccaaacacaggtgaaatctatggggatagaagtgagagtattggttacctctggtgggtgatattgaatgggagaagcatgaaggagccttctgggatgttgaaactattctacctcttgatctgtgtcgaagttccacaggtatatacatatgtaaagatccatcaagttatattgttaacacttgtgcactttaatatttatctcagaaaaaaattcacacaaaatgaaaacagcaaaatttaaatcaataaatatttaataacagcgtaaaataatcaaagggggtaatactttttttattttgaaaaatactgggtgagtttctgcaaagtaaagttgcaatcacttaataaaacttaagaccatatttccatgaggccatatatcgggatctttagaactatccaagtagctctacttggaatggtttccacagtcatcctgctatttggtaatatgtagctccagcctgctgaagcagtggtgatagactcatagtacccaggaaactccttccttctttctaaaagataaaaagaaaaataatagcctctctcaactgcgtagttgagagagactattattatttctgttagttaaggtcactatatttattatgcttcgactttacctggaaagagaatgagggacttcaaagtataagcaaagatgagtaattcttttattctttcacttattatgtagataagatgtggcgatgtttaattaaaaaaaaaaaaacagactttacctaacaacattgtactttctcttttagcaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggtaagtatatctgccattgtttttgatatttatgtcttaagtctgtctttctaattctagctctgttagattctgttaatatcataggtaaaaaattaaggatcgccttgctggtgtttgggcatgcatcttttttttctgcctgtattgctctataaattcaatttttaacctttatggtgaggagctggtgcacaaatatttattgagcacttattgtgtattgtgctaagtgctggctctatagtagtgaacagattttatcccttcctttacagaagttacagtcacaacaaatactgataaaacagctaacacttaggtagcacttacatgtgccagatgctattctaagtgctttatatatgcatttaatcctcataatatctccacgggatagattccatcattattcccatttaatagatgaggagactgaggcacacagaaagatgaggtaatttgccaaaactcacacagctagtaggcaagagagctgggatttgagccaggaagtttgtctccatagtttggacttctaacctctatggtcttgccatattgtttaaagaacaggaaaagacttgaaatgggtgaaagagtgctgggtcagccagaacctgattctcatcacacctcatgactgtgatgatcactgctggccttggaagaagccaggaatggttctcagcatagatctttctgaatacaaatgtcatttcattggcttgctttcctgtatttctaactgacatggtcagctcggctcctttcctctctctcccttgtgtattcaaggcagattttgggttcagaaaatgtgttagatgtgtaggagatgtatattaagtagcataccttgggtacataggaacacagattttatcttccactgcctttgtgaagacaatactctcctgattagctactcatccctttaatgagttcattaacatagtacatgctttcactggatacacagtcagtgctattatctatgttaatatggggagcagagacaggcaaatactgaacagatcataatctaaaagcttgttttagtacacttcggaatccatcggaagcacagagacaaaagcagtcgatacactccccttagtgccttgtgtccctcatcttgattcaatcagaggattgaaaaatgtggaagaggcttcatgaataatccaaaaagcagataacccacacatggccaattgtgaaagggctgtaaatatcacttcatcctggctttccttctccctcatcatcactcattcccagcttcttttttaaacccttcctccaggactcacttcttatctctttgatcttctaatttcatacacatttcttgggttacaaggagaggcaggaaaggctaaagcttggtacttggaagcaggaaaactttagttacacacagaagctgagaagtctgactggctcaatcagtaaagaaagatacaataagccactcttatgttcagtttattacttacataaactgtgaaaggaagagtacctaaaagtgccatctttcacattcttgtcccccacactaaaaagaacgaccccaaaacaaagggaatggatgaccgccacgtgagttgtaggattcccagtggctgaggagctagttttgaatggaagtgatactgtttcctattctgcagccctattctaagggggcagggtacaaaggcccacacctctgcagaaccctgggagatgatgagaagctgtctcctgacagcctcctggaggagatagggaggtgagtaggagatggccccggagcacctcctcacaggcctcccaccttctcaaatttgtggaggcctgcacaccgcccaaattcagataagcctttacctgtgtggtctatgtggatacatgcacggtcaccagggagccacagctgagctgtcccactacagggagttttggagcatttcaatattagacaaaagcaatcaactgtaaggaaaataggtattaatatctgtttatgtttgatgctctgccttatgaatgccaaagcaacctgttggaaaggtttattacttttaatgacaaaaaccacaattacttttgcaccaacttaatgaacccctgtccaagacagtagatttgtttatatttttaaaataacaacagaagggatcttttttttttattttcaatatgtaaacacagcttgaagactgccgcacaacttccatcctaaatatgaggccttcccctgtctctcccttccagccttctattttaaaaaacatctgcagcattctaggtgctgtgcttggggtgggctatacagatttgaagtgaccatcctgtttatcacagaatgggacagtggaggatttttcaagatacttggcattctgggctttggaacagctttggaaagcatttaacaaaacccctaaaatgtatgtaggtgcatgcgcttagtctaggagaaatacaattgagagataaagaaatcatttttttttttgcaaatgtacaagaaattggatttttaaaccctgtgtctacactctcctcacgtttgaccattttgactgaactgattgctttattatagtctgactgaattgagtggttgttaaccggtcgatctagtcaaaatgtcaaactagtaacgagtgtggaaacagtttccctgtcaaaaaagcactgaaggctgcagctgattgcctgtgcccttctcctaaggtgacctagacaaaaagctattgggaacaaaggggcgatgtgaaagggagtaaaaattaggggctcatgatctaagaagaaatgcttgatgcgaacttgcattccactcaactagatacttcttttgccaagttgattttctggcacttgagctatttttaataactagtgggcgttgtattggagccattggcatgctgtctagtttagcagattggagaactccttgaaatgcttaacttggaagaattcacaaacattttgcaaacaatagtattttgatgcccgcacatctgtggcttatttaaacagtgtcttaatgtatcatcacccacagtcattgattaggttgcctccctgctacctgatgaaatgcctttgacttgctttcccactgcaggaatcccggctatcatggtggcaatcacagtcagtgtgaaaaaagatctgtatggaactctgagcccaacaactccgttgtaagtaccagcatctctgtttctctggtggtggggctctggcccagcagggtatagtaaaatgttcttggcctgggattggtcttgacccttggcttcaggaagaaatcaacctaagtccttttgccctaaacataggccacatttatgtgatggttagttgcccgggtcctctatgaccttgggcaagttaccttacctttcagttcaatttcctcttctggaaaatggggataataatgttttctcttaatgtcctgtgcaaattaaaatgatatgatgtatgaaatgtgctcagcatattgcctgttctatgctgtgtaactggcaggtattatgattacaaagctcacacatcaggtcattgcaaagagttagtggcccctacaaggaaattctgagatgatttggaaaacattttttacctttcaacaacaaaggtcttccctgaagaacgctgaacagctttcctttgtaaacggcctcggctttattgtcctcttgtttcttttcatttttttccttttctcccatttgatgtataagttcatctctttagttctctcaaccacaatcacgcgagagtagcaattcacttcaccccacctctccagaaccttcttttacaggcatgtagatagttgccctgtggtcctttaggctgcacaatctcattttacacttctgattgttccattctttttatcattgcctctcaagttctcttccactatagatttcctctcccactggactggaattaaatgtagaaggtcctgctctaagactcccccatctttcatactgagatgacagtttccatggggtcaaaattattttgccctttgcagcagatgctttctaattaaaattccttgttatgttttctttctcttccattttctcttcccttccttctcatctccccctccatcctccccctttgcccgttttgtgacttaaaaagtccccagtgtctacctaatggtgacccttcttgaaccatcaaaagcaagagcaaaagcaaaatcagaacaaaatcaactccactttttcccaaaagagatttttcagatgtgacttggttagtaagaggccgactgctctaatagttttttttcaaattatattttgaagaagtaattcatgcacatggaacaaaatccaaacgtacaacagggtagaggatgaaaagtaagccccgcttccaacccctagctacccagtttccctcctgaggtaactcttattaccaatttattaccaacgatcaaatttgtatggatattctcttgcacactttgttacccaagtggtagatatacaccatttagcaccttggtctttccacttaacaatatatcttggaggtgattctctacccaaacatataacactatctcattttaacagttttctgtggcgtcttttaaggatgctgatgacattcagggaactctaggtgtcagaatctattaggaaaattaaatgtttttttaacatgtttgcaacacacacacacacaaactcacacatatgtgtaagtatccacgccaacataaacgacatgaccaaaagagattttcctggttttagaaaagagagctcagctaagttgacacacagttaaattagtcaagcttctctgtgttcaaaaatcagggaaaatgcctccagtaattgcaaatgttattaaatggactatctgttcatatgaatcactgcatattttttctttaataaaaaccgtagagttgttaatcaatccagtaaccagtgttgcctttgtcatccaaatacatcatattttaaagcagtacacctagagttctctttttgtagcattttcattaactttcataatttcaccattgtttgatgtagctttcagaaaatccattcattgctcacatcctttcactgtgatatttatcatgtaaagtagaattaatcctgcaaataagagcttaggtgtaaggtggtggcgggggggcagggcgtgcgggggcggtgtggggagcacggcgacagagagccactttgggggaaaatgtatcattcgtttttctgctgttaacgaagagaaccatttcctagggaattggactgacaggtttctgcatatgtagggcagaaacatcctctaggatttctgacttagtgttggaaagaaccctgaactggggctcaggagattgaggtttttgtcccagctctgcctccagttggtatgagtgaactctgtccagttcatttctctagggcagatgcccttagggtgaaataaaattgactagatgatcttcagtctctgagaaataggactttatgtttccctatctcatgatagtcttctttgtttcttacagttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggtaactggtgcttttttgccttttctgtggccagctacacatgcagcaaagcttttgttgctttggaaaataatcacctgttggaaacattaactagatgttagtcttcattaaatgcacccacagcccactctctcttgctcagtggtatagggagaagcccagataggtaacccaactttaggtaattggaaatgtctatatcaaacactgattggcaatacttcttatagtgttcattgtatcaacacattgtgctagaaaatgtacagattcacactcacgttgactttttgaggtacacaatccagctaaacatagcaattaactggaaagcaaaaacattaaagttttgaccccataggctctatctgcatctgatatcctaatattttgggaaagagccaggctagactatcatagaatcatacaggaatgaaggttaaaatcaaagggctgtgggaaaggccaaggttgtagccttgagtttgctgtaaaacaacctttaaaaagttacaataattggttgaattagatgatcctaagctaaaggccctagagctcttttaattattttcctttattccgatgaaatgaacaaataatcaatgaagtgatgaaatggtagacaaaagatggcatgagaagtaaaagctaggggccgggtgtgatggctcgtgcctggaatcccagcacttttggaggccgaggcaggcagatcacttgaggtcaggagtttgaaaccagcctggccaacatggtgaaaccccgtctctactaaaaaatataaaaattatctgggcatggtggtgtgtgcctgtagtcccagctacttgggaggctgaggcaggagaattgctcaaactctgggaggcagaggttgcagtgagctatgatcgtgccactgcactccagcctgggcaacaaagagagactctgtcaaaaaaaaaaaaaaaagctagagtctggttcatatagctctgaataattgctgacgttcatcttaacttgattttgcctattaaaaatattggggggaagaggcatgcaaaatgattttgtgtgagtctctaattctaccccatacttttatcctcaagtgtcgtccagtccatttgggctactgggacaggctgagagtcaagttggcatttcattgagttagagtctcccttcgtgctctccactatttttttttcattcaataaacccttattttccatactgaagcccactgatggtaccatgggatgctcccacaaggaaaaagttctatggtcaaataactttgggaaatgtggcaaattacattccccctttcttggaatagcactgtatacattagcatggtaaaagctctattatgaaaaaaaaaaaacctttaaaaagttgttttaatgtagtgtcttaaaaacctctgaaccttttattgtggtcattgttaatccttgaggaaccttgagaaaaataaattgacatgcagttattatatgacaggcacttgcaaagtgctgcggagttgagggggtgggaagcaatgtagcagaaggcatggtttttgcatttatgttttaggactcaagaaactatcttattttagagcaatgaggtggatcaacggaaactttttgtcccaccagatcctgccaaccatatacatccatgttctaattggaatgtaagaagtcacaaaatatgttgttcttccttcacatgccatttttattgcctctggtagtaggaatggaatttttagaaactctcaataccatcctcgcttggttccctttgaggctactggcacttggttgaattctagtgtagaactgaaggttgtattctagtgtaggactgaggccctggtgatggttctacactttttctctggatagaactgtctggcccacactacagtattctaacccgatgctctaacctcaagaactaaccagtcatggtatagaatgtccacggaaacggtttagaacccaggtgcctgtgaagacttcatccacagtggtaactccaggcttctctttggctcagtgattctgaggagaaatgtactcactctgtggaaagaggggttaaaggaaagctggcaaaagatcaagaaagctaggcaatttcgagcttataaaggaggggcaggggtgttttcaaaaccactcttatggtggaaagtagcatctaaggaaggagcctgcatggatagaagcagaatttaataggatatttcttttcttttcaacatttatttcagattcagggggtagatgtgcaggtttgttagctgggtatatcatgtcatgttgaggcttggggtatgaatgatcccatcatctaggtagtaagcatagtacccaatagttagctttttaacccttactttttccctcttctccccctaatagtccccagttgtctactgttgccatctttatgtccatgtgtaccccatgtttagctttcacttttaagtgagaacatgcagtacttggttttctgttccttcattaattcacttagcgtaatagctcctagctgcatccatgctgctgcaaatgacatgatctcattctttttttatagctgtgtagtattccatggtggctatgtagacagtttctttatccaatccacctttaatgggcacctagtttgattccatgtctttgctattgtgaatattgttgcaatgaacataagggtacatgtgtctttttggcagagtgatctgttttcttctggatatatacccaataatgagattgctgagtcaaatagtagctctgttttaatttctttgagaaatcttcaaactgctttccacagtggcagaactaatttacattcccaccaacagtatataagtgttctaattgggtatttcttgaaaactaaaatcaaagtcccatagatccagcaccaaaagagccaagctgtctctgtctgtcagatatgccttatgcccatcaagcacaaagtcttgccagtcctgcctaaaatgactgcaagatagcatgtgccatcttgtagcaagggagttttcagagctcagagtttcaaattcaagacacacacacacacacacacacacacacacacacacacacaacccgaataacctccaaaacaaacagtggaacaagtgaacaaagtagtcgtttaaaagacaaatgacaagcttgcaatgctggctgaaggggatgggggcgacctgtggtcaagtgggaaaaaattatgctcatgatgagctatttgtgaaggaggaatgcacaaataaaaatgcaggtgacaaaaacctgacatcttccctcatgcctgtgttttcctagtgagtaagcagatcaatctgttatgggaaaggaaaaggaaagctgtcaggcagagggggagagttggcaggcagttcattggaattcacagaataaccttttaagtcggaaaactaaactccatgcaagaaatcagagtagtaataggtgcttgatgtcactgtcaccccttgtacatgctgaagttggaggagttttgcctgctctgagactgtggtttgctctcctcggggtgctgcaccgccttccaggtggctgctgctcagaaaaacagtgaacactgctgaattcatccccgcagttgtttggttacacatggagataaaacccttgggagagttagcgagacatgccattccgtttagcctccagattgctgcctcccacctggaatccgagtctcagggctggggctagggagccaagatcttcccaatcaaacttcccattgagtgacaggaagtcacttgcctctgcctgaaactttccagggactaagagctcaccattctgtaaagcaaagcatttaacttcttatcagctctgatgtggtaccagttttccttacctgaggctagtatagtacagtagttaagcccttgtgttctatagtcagactgcctgcattcagaactggtgctgctagctccatgttagccctgtgacctgggtcaagtttactagacttcttggactccaagttccctcaactataaaaatgagactaatagtacaatgcctgccatatactaattgctaaataaacactagctgtgatttgttagtacatggttgctctgaaactttcttccattgctcctggttctaaccgggcaactgtacagatacaagcctagtttgtccttttcatgacagccctttcagatctgtggctaagtaagcatctcttctcaccctatgttttccactccaagtttttttttaatctagatacaatatcccaactctttcagctttttttcactatccttcttcaccgtattcttgaatacttctgtttgtcatcttcctctcctcccaaactgaacatggtgctggtgggaggtatggtcaaacaaggacagaatatggcaggagactgtcactcgcctcagtcaagattctttacttccagtagtgctgtagctgaaatttgctttgggacatttacaatagactggtgctcagtttacaatgggttaagacctctttgatactaatcatttaccttcaggacaaccagccaatttagaggcaagctgaacctgtatagagaataaaggtttccaaactgcacttggatcaaaataaatattttgaggctcaagcagttatcactatgttgtagatggatgtgcgagtttgtgtatcaagtgtcttggagttcaaatcaacatacatttattgagcggccgcacttagtgtatcaaagacaaagggcaaaatgacataaatatgaaaaggaaacatatctcggccctcaaagactcaacagctaggtggagaaatgggaaatagacgaataattgtatggctacatatagcaaataatacaagaaacaaaatgttatgagagttcagaagtgggaaaaatgagtttcagtttgaggcatctggaaagattttgtggataaagactttttgtaatggaacataaatataagtcaggctattgacaggagttatttctgccaatcctacccccaactgcaggaaatctaattggtcctccagggaatttgcaatcaagataattttttttttaagacagagtcttgctctatcacccaggctggagtgtagtggcttgattctgactcactgcaacctccgcctcctgggttcaagtgattctcagcctcccaagtagacgggattacagacatgtgccaccacacccagctaatttttgtatttttaatagagatggggtttctctgtgttgaccaagttggtcttgaactactgacttcaagtgatccacctgcctctgcctcccaaaatgctgggattacaggcgtgagacatcacgcctggccaagataatcttaagtcatatttttatcttccaaggacatattttagagggtgggaatgagaaatggccagcactgctggcaaagactttcagcccttccctcccccttgcaggacaaaatcagggctggcattagaagttgagggtcaaatccatggtttccacatggtgtcattatgccaaaaagcatgtgtaatagttatttattgctatataacacattaacaatttttaccagcctaaaacaacaaaaatttattatttcacacagtgtctgaggatcaggaattcaggggcagcttagctgggtgtttctgactcagggactgtcgtgaagttgtagtcaagctgtcatctgggcctgcagtgatctgaaaacttgactggggctggggaatgtgcttccaggaaggctcatccacatggttgtggactggaagcctcagttcctcaccatgtgggcctctccacagggatgccaggatgtcctcaggacaaaatacttggcttccttcagagtgatgagagagggctcgctcttttataacctaaccttggaagtgacatgccatcccttctgctatattctattggtacaatgtggaagtaaactacacaaggatgtcaatgccaggatgtggggatcattgagagcaatctcagagaggggctaccttacctctcacactctaggatgaacagcagtccaggggcaaaacagtggttgacatgaagtcttgatatagacatttttgcctttgggagggagtctacaaagacaagatcagaaagccagtaatggccctggggttccttgaaagtagtatctctcatgacagaagcaggcctgagtcagggcattggtgacagctggtgaaagaaaccaaaaaagactgaccttcttcttctggcttaggattcttcatttttgtgtttcactgtgtgatgaaggagagtgtgcgggagcagtggcagatacacctctgctgtgggtggttgcgattggataactcttctggtaagatgtcagtttggatgaagttttgaatattacatgttttacaaaactgatcagattaatttgtctcctaacttgagtacttacagcatatcagcatcaaaacacaggctgtttccatgtcataaaaatgatttgtgcttttgagctgagatgagtgaagtcaagtgaagaatgtgacttgggccatattttaaactagggatgcttttgttttggcccagattccctggattgcttaccttcactgtcacatcagtctcaattcaattaaaagaacactgaatgcgtgcctactgtgttccaggcactgggtctcaggggcttctggctggtagccaacagtgggttgagtggatgtaggaagcaaggagtggtggtggagatggagagaacttataaacattcctaagatgcctggccagtgggctgtacaggtgtactgatggcccacgaactgggggatgtagtgaactcagatgttgcctcttagcactggtgcttcccttgagaatgtttccactgcaggcaaactgctgttctatgtatcaaaaggatcttccattcaattcaggcagcttctctcagtctcaatacaaagcctaatccattttctttagtgaaggcagcacttgaactctaagattctacaagtagcactgagattccccccattccccactttattttattttttttcttccagtattttattttatttatttattttttttattatactttaagttttagggtacatgtgcacattgtgcaggttagttacatatgtatacatgtgccatgctggtgtgctgcacccactaactcgtcatctagcattaggtatatctcccgatgctatccctcccccctccccgcaccccacaacagtccccagagtgtgatattccccttcctgtgtccacgtgatctcattgttcaattcccacctatgagtgagaatatgaggtgtttggttttttgttcttgcgatagtttactgagaatgatgatttccaatttcatccatgtccctacaaaggacatgaactcatcattttttatggctgcatagtattccatggtgtatatgtgccacattttcttaatccagccagaatctacaatgaactcaaacaaatttacgagaaaaaaacaaacaaccccattccccactttatgctggccatatcagcaacctgctggtccttgtgctctgggaaaagcaggcatccttggtatgtgaattgtctcttcctataccacacattacagtacaaacctacttcttacaacttcatagaaaagctgactccttcaggtacccggaatgaacactgtgcatcaagctttgtttttttgtttttgtttttgtttttgtttttttttttgagacagagtctcgctcttgttgcccaggctggagtgcaatggtgccatctcggctcaccgcaacttccgcctcccgggttcaagtgattctcctgcctcagcctccagagtagctgggattacaggcatgcgccaccccgcccggctaattttgtattttttagtagagaccgggtttctccatgttggtcaggctggtcttgaactcccgacctcaggtgatccgcccgcctcggcctcccaaagtgctggaattacaggcgtgagccactgcgcctggcctaaactttgtatttttaaaccaggttattgaagtgtaatttatataccatacaattcactactttaagtatagaatttcatgagttttatatttttaacttttcttggtatcatttcagatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatggtaagaaaaaaaggctgtgttgtctacatttatattccagagatattgaattaatgtgagaccacatactgggtcttggatgatacttcctcttcaaaactaaatgcacatgtgcatgtgtatacctcgactcattcttggctgagaaagtgtgtatagaagcatagaaatgtgtacagaagtgtgtataggtgtttctgtgcctagtaaatttagtaagtatgaatgtgttattagactaatagaggaaagaagagatgagaggttagaaaattcatgagtaattaaaaacaattgtcacagaccattaaaaccagaaggaaccttagacattgtctagtccaatccgttcattttacagttgaggaacctcaatcagagaaaaggaaaatgccttattgacagtcactgagcccatctttaccatccagtagaactggggccagtcactcagccctcagccatccagcagaactggggccagaattcaggtcttctggctctcagggctagtcctatcaagaaaacagagatacacatcactcttagatgctgagcttcttccataggaagccatatttctaagctgagacagatgttcagttgggaatggggtgttgtacctaattatgtaaaaagagaaagtgtaggaaaaggattggcctacaggcttaaagtaaagagaaaggcaaagtgagcaagaacttaagaacttcaggatgatactgtgatgagtctgcattgtgtgcttctagttagatgatagtgcagtggtctttggttgcctttctttaagaccaaagtatactccagttcacacacactttggtggcctggctgtagtcattctcctgccttctcagtgctggaggtaggactgcctcattcgctagtatttttctttatgttggctccaaaaaccagttctatgtccaagggctgaaggcaatctggaagcagcatggtgggttaaaaaagcatcaaacttggagttggaaggctttggttcaggttccagctctgtcagtcactctgtgaccttgagcacatcacttctctgcttggagctacattctttctacctttcatatgaggggactagaatggataatctcttaagtgcctgccagtttcaggaccgtgtatggggcaacgctattttccagtttgggctggttgactagtgtatagcatctcagtctcccatctttgtgtgggaaagttagtgatgcacatgagaaaaacctttccctggccacaagcatttatcaaactctggccaagtaacctgtggatatgtcttggtgctcatataaagtcactggggtgccatgacatagacaaggcatgggttgtgggagctccttagtagataatagttggggctggttggaaaataacatttttcaagagggttatttagcattggatttcttgatgtccctggggactatttaattagcaaatatacagcccaatgtgtacatattttgcttcagaggatcagtagcaaataccatatccaggatattgatgttgtcttaccaagcaatcgacctggaaaaccaacattaaagtgctcatcagttgagaggaactgagccagtggggcaggtagacctgccacaggttctaaaactgaaatctgggtccttccattgtactagtgacagccagaagcttgattctattagcagagagtgaaaaatcatgccctctgtaccaccaggcattctcaagcttgagaaatagccaaactttcagtgcaagaatatcaaatatgtaaggggtataaatgtgtatgttcacattttatgtcatcttctcttgaaggcctccgagtttgtacataaatatcctctcctaggttaaggttaaggtcaataatgctgcctcttattcacaatgtaggaagaacatatgcactggttgtccaaacagtgctgtcaggatgaattaattcaccccggattttatataaaacagtccaaagaaagcaccatatccttcccttctcttctaattgctttattttttccttcatttgataaaattttcttatgcttctactatgtgcaaagtccctgatgccgcagctgaaaattttctttttttctttactgcagatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcct

SEQ ID NO: 5102 - DNA, 112035 bp, human
ggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgaggtgagttccatggtcagcattttacaaatgaggacactgggggctccagagaagttagggaactagccacaagtcacacaggtgggactcaaactcaagcctgtctttccacaaagcctaggttcttattcactactctgataacagtttgtgggttttggggtgaatcatggattattccaatacacctcctccttctccattcccctgtgaagaatcctggccttaagctgggtcgactcagcctcctattagactgaattttctgttgaagatatgagatgaagaggaaaatgcactggtttggtagtcaggacaccttggttctagctcctgctttacctttcacaagctctatgactttggatgagtcattctacccttgggaccccaggggcctcacctgtaaagttcagaggctgacagggatcatctctgaatcctccacgggattttggtggtatttctgtcacccctaaggggctgtaatgacaccttctgggacaaaaacaacatccccttcttgagacgaacataaagccagttcaataaatctatttactttcaaggcgacttgaagaataaatgtccagtgagggtaaatagctggcttcaccttacagatggagtaagatgtgaatatgttcatgcctctttggcctttgctttctgctcatagttctgaacactacacctcctcctccccactttcttagtaaagtgaaatgagccttagtcaagtaaacaagtacccttttaatatatccaatttaattaaagcaataatcaactaggaactgaaaataatccttagtgaaaactgggaaagagccctcaaattaatgggttattgcagggttgtaataatctgagaactttgcccatgctgattttatgctcaggagagcagccccatgacgtgctacaagccgcaaaaagaggatctacccggatcaataagccccataaagctaagagcagagaggctggtttgatgcagaaaagaaggtgactgaggcatggacagcagaaaatgagtctcctgtttagtacttctttcatttcacatcaaacataggaatttagagacaagatctggtcatttgagggtgggaagttaaaagagtccagttctcaggtaagtgtttctcttcctcccttcctccttccctccctctttcctttccttccttctttccctctttccccctctctccttctttcccttaaatttttctgaaccacaaaattaagaaatacgcatcatgaaataaccaaattgcttgaaattgtgtgaggtataaaattcaagtctttaatcctcaccctttctttctcttttcctctttctttacttttcctccttccttccttttatgttttttcaaaattatgaaagtaatgtatgctcattgtaaaagcaaacagtacagaatcacaggaagtataaaggaaacatttaattcccatttttccttcctatctctttcctccccttcctatcttccttaccttcctctctctctccctttcttcctttctcctttcctttgatttttaaaagtatgtaactaatttataatctttgtaaaataaccagacagtacagaacagtatggaaaattcctcatgccccatcccctttcctcaacccaccttttcatgccttatatatagacttaccttattcctttttttttttttttttggagacagaatctcgctctgtcgccctggctggagtgcagtggcatgaacacagcttactgcattgtctgtctcccagattcaagtgattctcatacctcagcctctcaagtagctagaattataggcatgcgccaccatgcccggctaattttgtatttttagtagagacagggtttcaccatgttgcctaggctggtttcgagctcctggcctcaagtgacccagctgcctcagcctctgaaagtgctgtgattacaggcatgagccaccatgcccagcctttattccttttaatggttgcatagtattctgttgtgtaaatgtcccatgatttatttattgggcaccaggtaagtttctgaaacataccttgaagttgttataaaagtttaggggaaatggaagaaaaatataaattggattacttgctgctgaaaatcccattttatagatagcaatcatatccatttctatagcactttatgctttgaaaattgccttcgaaatatcatctcatttgatcctcttcaagagcagctctgagaaatatgcagattattatctccatttttacagataaggaaactgagtcccagggaaattaaggaacaaaaatatgtatggcctcacagccagttactgattctcagcctagtcctcttatagcactataaatttaagctgcatttcattttgcaagtcatgaaagatttagacacccccttacttctaagctcatagtttagaaaatccatccaactcatacaaattcccttattattctaatgagaatggtggtagaatccttggtaaatatgaagagcctgattaatggctggcattcatagcaagctcaagattcatttgacttcctaattggcttctgttacattaaatgtaaagtgggtctattcattccaaatcccacttggaggtagaaagaaatacaatacgttgcattatcctatagaaaaagaaatgtttaaatcagtagtaaatcattcagaagtatatttcatttaaaatcagaaatgcccatcagcaccctactgccaattttctgtaacatgtttcagtaggatttgcagttttaacaccattttgtttggagaaaagagggttttaagtgcattttccacataagacactatagttacaattaattaaggagagaagctgggtgaacataatgaaatggtgattagatttctctaaacagatctgttttaaaaatacaaatgatttgatgagttacttttgtcaacaaggtcttcttgcataacattccttcaagaaatttaggatcattataactacaagtagttgaattgaagtttgtgcattagggttgaatatatcacattttggttttttgtttgtttgtttttgagacagagttttcacttgttgcccaggttggagcgcagtggcgcaatctcggctcactgcaacctccgcctcccaggtccaaggaattctcctgcctcagcctcccaagtagctgggattacaggtgcccgccagcatgcccagataattttttttttggtatttttagtagagatggggtttcaccatgttggccaggctggttgcaaactcctgacttcaggtgatccacccgcttcggcctcccaaagtgctgggattacaggcatgagctacagctcctggcctcacattttgtaattatgcatttaatgtctgtcctccccacagggctaactgtcctatgatggcagagatgtgtgtcttgtcttctcagcactgtattcccagggagcaacacagtgtccagcacatagaagggattcaataaaatttattgagctagtatatagataaatccatcagtgaggtttcagccaggctgggtatctctggtaaatgcctatcatgtggttggctgacatgactttaagcaataggaaaaaacccttaggtggtatgcaaaggagaagtgtggtcacatacgcttagaaattgtattttctgaatatctgagctgggcatatttttgactttttaaacacagacttagacaatgaaagaacacatcatatatcagaagctttatggattgattctcatgtcgagttttatctttctctcaggtaagaaaatgtattcttattatctctttcaatgtctcatgtatagtaggttatagaaataaaccatttgaaaaatactaccaatggagatttgctgggctgcctcttaatggtcaccttttggtcaatatggctacagaagaagctgaagcatcagtaagtgaattaattcattcatcattctgtactactgatagagagctggcctcaagaaggcagtagcttggactactacctttgacatttcttaaagcaactctgaaatgccatttggcggctaatgcacacctaacagaagatttgggttttcttttggactgtttcctctcctccgtaatgctttatttaaagctgtctgaagcattgtgatatcatctttctgtctccattatatgtatatggcaagaatcatagaatacagatggggaaactgaggcatgcaaacagctggtaacagattcataaagcaatgggcatatattctggaagcacccagaccttccctagactctatgacaggaatgaaaataatttgtctctattttacagtagataattaagacaattcactgaagtagctggtaatttggagacttcaggagaaggtcttggtaaactgcaatcttgtccacattaagtaaattcagtttgtagcattgcttatttagcacataagtacttagctaaaaggtcataaatgccagtgagtgacaacgcctgatgaaattgacctgtgtttaatttgaacggtcctcaagcgtaagagctaatctgcaaaaataccaaatcatcattgccatcaagagcaaacactggcttcttgctgcatgcagagcctgataggaaaccatgtttcttataatagagattgaaatggggcctacggggtacagtggcaactttgtcacctggcctggcctacctgctaaaaagttgatttatttttcctctacctgtttcctcaagggcaagaaactgtattttcccaatttctttatccaaagcatccaacacaggccttgacacacagtttaggcacttggttcatatgtgctgatttaatgaattcatgcaatttgaaatgatgaaaattttcaacatctgtatggtggtggggtatatgacacaaactccattggtttttgtgaagggctacagggcatggtatagagcaatctagaatagtggaatatgggaatctagtgtagtcatggaataaaaagtgaagagtgtgtggtactgaaaagtttgcatgggtttgcgaggaatgtcaccactcagtgaaaattattattattgttattattattattattttgagacagagtctcactctgttgcccaggctggagtgcagtgacgcaatcttggctcactgcaacttctgcctcccagattcaagcaattctcctgcctcagcctcctgagtagctgggattacaggcgtctgccaccatgcccggctaatttttataatggtcagtgaaaattatgatagatgtgcaggtcctcaacctgcagaggtcaatttaaagcagtcacaaggttttccagactgtttaagtctcaaattcatgagtcaaacaagttttttttgtaggttatcaaacattgaattataattgttctttgattgccgagaaattcattacttttttcttggaaaaaaaagaccctgtccttggaaacaacggcataactcaggttcagttcccttcaggctccagatgagtcaccagcctcccaactgtgagggtcattattggggagagattaaggccagattaagtggagggtgactcagagatgctctaactgggaggagccagagtgtggagcaaaactgtctccatagaagaatatcaagggttgagaaggagaagccaaatctgtattaaagtctatggggtgagagcagagccagaaagaagagatgaagactgaggtcaagagctgaatagttgcagaatggagcaggaggtaaaaaataaggcataaatgagagaagagggcctaggacttaggctgtatgtgggactcggtttcctagttctctgtcttagtctgctcaggatgccataacaaaatactatagattggatgatttaaaccatgggcatttatttctcatgtttctggaggctgagggttcaagatcaaggtgccagatgattcaattcttggtgagggccctcttcctggcttgtagacagctgccttctctctgtgtcctcgcaaggctgagagagagcaagagagctctgctttcttcctcttctataagggcactaatcccaccataggggctccaccttcatgccctcatgtaaacctaattactttccaaaggccacaccttcaaataccaacacattagaggttggggcttcagcataggattttaggggagggggaaacaaacattcagtccataacatgattttcctcttaatggtgctggctattggctgtgtaatggatatgggtaggtttgggttgaagacatagggctatagtagttgtcctaaggtcttgctcataccatgtacacacacacacacacacacacacacacacacacacgctcacaccccaagtggagtaggacaggctttgctggctgaaagagtgtaacgtgttctggagcattcttgaggcaggaggctggggttttgtgacattcttgaggtgggaggctgggtttttgaggcacctagcctctacagtcagtaacttttgctcctgtattggataggcaattagtcaatctgggccggaatcaactttcctgagaagttgtcacatatgcagagacgacctgactaggaattgttttgacacaggaaagccccagagccatgtcagaaaatcagtccttaggctgtagagacaaactaggccagggcagtcaggacacagtaggagtgtagaggtaaagaaattcttcttctgaaaggtgtttgtgtagccagggttcaggaaaagccctatcttttctttttttaaaaaattttattttttaaattgtaaatagacacaggatctcgctgtgttgcccggactggtcttgaactcctgagctcaagtggtcctcccacctcagcctcccaaagtgctgggattacaggcatgtcccaccctgcctggtctatcttttcttgagaaactaattccacgagaaaagagaagtggaggataaactttgagcagaaactaaatttctgtatgaattcaagagttgagctgtccaatatggtaattacttgcaacatgtggctaggttttaattaattaaaattaagttaaaaattcagttcttagtaatacaagccaggttttaagtgcttaatagctacaggtggctggttgctaccatattaggcattgcagatacagaacatttccatatcacagaaggttttattagacagcactgttctagaaggttgtagagactggcatttgagaaaagatatttgttttaaacagctttattgggctgggtgtggtggctcatgcctgtaatcccagcactttgggaagccaaggcaggtggatcacttgagctcaggagtttgagacagccttggcaatatggcaaaaccccgtctctactaaaaatacaaaaatgagctgggcatggtggtatgcacctgtaattccagctactcgggagactgaggcacaagaatagcttgaacccaggaagtggaggttgcagtgagttaagatcgcgtcattgcattccagcctgggcaaccggagtgaaaccctgtccctaaaataaaataaaataaaataaaataaacagctttactgaaatataatttacataccatacagttcacccatttaaagtatacaattcaatggttttcagtatatttagagtggtggaaccatcactactatctaattccagagcatttttataacccccaaaagaaataccatactctccgttcctcccccagcactccaggccttgacaatcagtaatctgttttctgcctctatgaatttgcctattctggacgtttcaggtaaatggaatcatacgatatgcagccttttgtgactggcttcttccactttacacaatgttttcaaggttcatccatgtgtagcatgcatcagcagttcatttatttttattgctgaacaatattcaatggtatggatatacctcatatttttttccattcaccagttgatggacatttaaattgtttctacattttgactattatgaataatgctgtatgaacatttgtgtacaagttttgtgtgggcatatgctttcatttcttttgtgaatatacctaggagtgcaatggcagagtcaaatgtaacttcatgattaacattttgaggagcacgcagaccattttccaaagaagctgcatcattttacatccccactagcagtgtatgaaggttctgatttctccacatcctcaccaacacttgttattgtctatctttttgatcatagccatcctattggaaatgaagtgatactccactgtggttttgatgtgcatttccctatgactattaagcattttttcatgtgtaaaaacagacattttgtctaacaatactcaaagcctttcacctgggaaattgtgcattctagactctgaagcataagttctttctttttaattttttcagatacatatttccttgagttggcacaggcatagcacatttgtctagcataggacagatgaaaaacgctcatatgatagcctgtttgagcttgagcatgtcacttaggagggtgactgaccaccatattctgtctcaggctagtaagttgtacaaatttccttcaacagtaaaaatattgacagggaattgcataggctgaaaagtaggtctgaaacagttttccccatgttgttcaccgcccggaggtggatgggcttctaggatccttggcctggatttttgttacctaggtgcttttgagttggtctatcaaggtagggcttatgggagctgttagcatcacaacatagagatcttagtagagggccctgtatttccactgccaggtaatgatcagtagtctttcctcttctggaaatggcttctctgcacacaccattatgcaaacttaggggctatctttcattcttccctttctctcactctccacatctaatccattgagtcttgttcatgccaccacaaaaatacatcctaaatctgaccgttttcttttcttttcttctctctctctctttttaaaccattttaactgcttccgccatgggctgagccaccatcattttctcttggctgacttcagtagcctcctaatgttctccctgctttcactcttgctctgctacagtctattctccacacagcagccagagtgatcctttaatatatcaagtcagatcataccactcttttactcaaaacttgccaataagttcctatcaaaattagaatataattcaaactctttaatgagacctaaaaagcactacatgatctgatctcccactgcctcttgggcttcacttactaccatgcatcctctttctccctctgctccagacacactggcttcctagtattccgtaaacacaccaagcacagtcccaccaaaaggcctttgcacgtactgttacccatgtctgggtcactcttattccacatctttgtaccctggctcttttttcatcccttgggactaagctaaaaatgactctttctcagagaggcctttcttaactatcctacataatgtagacatttcctttcccctcatctctgcttttcccattacctaactcatcaacctgtcaatttctttcagagtactgtatgtaatttgtgttttttcctttacttgtttattgactgcatctgtccctggaatgtaagctgatgagctcagggaccttgtgtgttatgtctcctctattactgcactctaacactgacacatagtcaatgctcagtgaccatcactgttgagtaaataattttttttcagggagcttctggctttatgagtaaggacatctatttttttgggtgagacatgggccttgaatccaagatttgaaggaaaaatcacatgacctatgtgaggataattcctctgtctcctatgccaagaactcttggcaggccacaaatggagtcagcagcctaggtactagaggaagggatgtgttggacaactctgtggctggtgattggtgacagaaatgaggatcagggttggacgcttctatatctggtaggcctggtttatctaaggattagcctggttacaagaccagtggaaagtgtgggcagtgggtggcagatagtgactctgattctctgtggttgtgcacactatggccatggtgatgtgggtaatggagctccccagtatcaggtacctattgattatatctactcagacagtcatggggctgctagaccagggcctggtctacaaagtttttcagtgctccagaacgttgaattccaaggatttgtgattctaagagccagaagactccctcctcaagtgagtatctgctcacctgcccttttatgagtgggtagtgacacttccaagataaggcagacatggagtagccttggtagaacgctcactctcagagtggccagattcttcaaagtataaacacaactgatgcctctggtgggcccttttcctcaaatctgctctgcagcctcaccttgctctcataggtattaccaggtgattagctgggttctgagccctacacagtgttgagtcaagttgtgtcttcccagcattcatatgttgaagtcctaaccctcagtacctcagaatatgatcttctttggaaatagagtcattgaaaatataattagttaagataaagtcatactgcagtagggtgggcccctaatccaatattattggtatctttataagaagaaaaagtgtggacacacacatgcacacagggagatcaccatctaaagatgaaggcagatatcggggtcatgtgcttataggccaaataacaccaaatattgccagaaaaccaccagaaactaggaaagaggcatagaacagattctctctcacagctctcaaaaggaaccaaccctgctgacaccttgaccttggacttctagcctccaaaactgtgagatgatacatttctgttgtttaaacaacccagtatgtggtatgttgttatggcagccctggcaaactaatgacacagacactgatgctctggcaggctcactgggttagaattaaaaagaggaaagcaggttacctcatggagaagagacagtgaccagatcatgcccagagtacctgaccatggaagaacctcatttgtcctttgccctgaacgtagtgcaggacagtggacctggaaccacagtcccccaaactttgaaacacttgaacattttaaggagaaactttgccttctaagaaagggtagaaaaacctgtataggatatgtctgatgttacttaatgctgtcataagcagaaaacaaagggattttgctgaaaaaaaaaaacaaaccattcagattgtctatctcttagagttttaaaccatttactctctgactttttattttatttgtttatctatttttgagacagagttttgctcttgtcgcccaggctggagtacagtggcgtgatcttggctcactgcaaccactgcctcccgggttcaagtgattctcctgcctcagcctcccgagtagctgggattaaaggcatctgccaccacgcctggctaatttttttatttttagtagagatggggtttcgccatgttggccaggctggtctcaaactcctgacctcaggtgatccgcccgtctcagcctcccaaagtgctgggattacaggcatgagctgccacacctggccttactcactgacttttaaaataaatgtatttattacttttggggtctgacagggacagagaattctcccttgatcttttgctaaaagttccctaaaacagaaggcagagcacgagttcagtatacagtccagaacttctcattctatgccagatgcttcattcctgatacctttgcacaagggacagcactccatctgcccacccattagcctccaactcagtgccctaatacaggatacaactatttattcagtaaacagctacaaaggacctactctgtgtccatgaacttggacttccccatctcaaactgtacatgaaaattaacttgaaatggatgaaagacttaaatgtaagaactaaaactgtaacattcttagaggaaagcataagggagaatcttcacgacctttggtttggcaatggattcttagaaatgacaccaaaagcggccgggcgtggtgtctcacacctgtaatcccagcactttgggaggccgaggcgggtggatcatgaggtcaggagatcgagaccatcctggctaacatggtgaaaccccgtctctactaaaaatacaaaaagttatctgggcatggtggtacatgcctgtattcccagctactcgggaggctgaggcaggagaattgcttgaacccaggaagcggaggttgcagtgagccaagattgcaccgctgcactccagcctgggtgacagagcaagactccatctcaaaaaaaaaaaaaaaaaaaagaaagaaagaaatgaaatgaaatgacaccaaaagcatgagcaataaaagaaaagaaaaattcgatacattgaatttcattaaaattaaaaacttttacacatcaaaagacactatcaagaaagtgaaaagacaatacagaattggagaaaatatttgcaggtcatctatctgataaggttctggtatccagaattaaaaatgggcaaaagacttgaatatgtatttctccaaagagtctatgcaaatggcaacaaacatatttaaaaaaatgctcaatgtcatcagccattagggaaatacaaatcgaaaccacaatgagataccactccataacctctaggatgacaataataatagtaaatggaaaacaacaagtgttggctaagatgtggagaaattggagccctcatacattgctggtaggaatataaaattgtacagctgctgtgaaaaacagtttggctgttactcaataagtgaaacatagagttactatatggcctagcaattctactcttacgtttataccccaaataaataaaaacatgtgttcaaacaaaacaaatgacatgcatgttcatagcagcactattcataatagccaaaagagagaaacaatccaaatgtctattaacgtgaatcaataaacagaatgtgatacatccatataatgaatcttattaagccatggaaaaggatgaagtactgacacatggtacaacatggatgaacattatgctaaatgaaagaagccgacaagaaaggacacatattgtctaactccctttatataaaatgtccagaacaggcaaatccagagacaaaaagcagattagtagttgccaggggctggaggggaggggcaaactgagagtgagtgcttaatgggtacagggtttcctttttggatgatgaaaatgttctggaattagataatggcgatagttgcacaacattatgaatatgctaaataccactgaatagtagactttaaaatggtttaaatggtaaattttatgttatatgaaatttcccagtacaaataaaatggtgcttggcactcctagggtagtaacagccatttaagtgagatttatgatgagtttttcctaacacggaaaacacttatgctatgagtgagaaaagcaggggacccaattttccttacaatatgatctcagcctcacaaaaacaagcaaagcctgtgcacagaaaaaaactgaggaaatataccaaaatgttaatggtgattatctctgagtggtgggactctctggctggctttgttttcatctttttacttgctaatacttttcagtttttctttaagaaaacatgtacagtatcacttttataatggaaaaaacaccttaaaaacagtaaggaagacaataaatgtcatttaaaataaaaggaaacagtggatagaggcgaagagacacagaggagccaaatcaagagagaacacgcttcaggggagcaatcatgcaatttggacttgaaaattgccagggaacagatggcagcatctaagcagacatctgcaatggatagcgaaatcatatgcaaagacacaagtggcctttgaagcaggcccttgagaggcgcggcagagaacgctacttgcctggccaaacataagggcaaagcccctctccaccttgtcacagtctggcctcctcagagccctgctggaggcccagaggctgcggtggggctcagctcagttgggcttccatgtgtgagggtgcaaaagaggctgtggaggaaggaagaggcttctgatagtgaccctggcaaacatggcagctgacatttacatggggttgcacagtttataaacattctcacacacataacctaaatgttagttatgattgcatcatcttttatcatggccctatgaggtaggcagttattatttccatcttactgtggaagaacgaggcatggagaagtgatatgagctatttatttaacttttatatagtgttctctatgtgccagacactgtgctgagagctttcacaggcatctgttgcctatgttcacacagctagtaagagacagaactgggactcaaatttggctttttagacttcactataccacatttctgcttatgtctaagcagaatttacctatatcttcagaatcttaagtaaggccacagtgattctatctatctatctatctatctatctatctatctatctatctatctatctatcatctatctattatctattatttatctgtctacctatccattcatccatacatctctccatccattcatctatctatccatccacccatccatctttatttttctgattataggtgtaatacatgattgtttaaaacatgcaaatatgctgaaataagtaacataggaagtaaaacatttccctaatctcacacctaaagataatcattcttaactgtttaatatgtgctcttccacacttttttctgtgggcatactacctgcatatttttcttttagtttttaataggataatactgcacctgcacttaatataactcctatttcacacaatagtaagccttgaaaaactctccatgactatagaggcctatcttgtttgtttccctattccattgtatagaggtagcaattttcctaaatagtcacttattgatagacatacaggttcgtcaattgttcttgattataaacaatgtggcaataaatatcattgtactctcatctttgtctatctgtatatttgtctaaaatgaattgatagaaatgaaattgctgggtcaaaggatacacacaattatatacaattaagattgccatagataatggcaaattgcccttcagaaaaataatacttaattggcactcccactagcagcgtgtaagagtgactcatttccccacaggcttgccaaagctggatattctgtcttctaaaattctatcaaccaagtaggcaaaaatggtgtctccttattgttttaatttgtgcttagaaatagtaaggtggcatctttctatagtattggcctttatatttctgcttttgtaaattgctttttcccatcttttggcaactggttttaaattagtatactgcaggctgggcatgatgtctcacacttgtaatcccagcactttgggagactgaggtgggaggattgcttgagcctaggagtctgagaccagaccagcctaggcaacatagtgagatatcatctctaaaaagaattaaaaaatttgccaggcatggtggcatgcgcctgtggttccagctaattggaaggctgaggtgggaggattgcttgagcccgggaggtcaaggctgcagtgaaccatgttcatgccactgcactccaacctgggcaagagagtgagaccccccctcttaaaacaaaaaatcaaaaactaaattagtatactgcagagaggagaggcccttgtagaccatatgagattatgatacattctcttttaaggtgcaactaggccctggagatttatgctcaccgtaaaaccagttcttaaatgtatctgacatcatttcagagggctgaacagaaaggcagttaaccaacaataattgagacttgggtttcatatcacttattgtcttgtgggattaactcttgatttattagccacacaaaagatgataaagtaatataatcacagaagccagggacagaagtaagcattttctcattcatcaatggatagttcagaaataactccccggcaggtggatagtatgagttcctgcacatgggagtgtgtgatgcaggtggaatgtatatgagtgtgtgtggggggcaggcatatacatgttattgtttgcttttggaaaatgtccactagaggaatggagggagagaatactatatggtcagagaatatctggaagctttcatttggcggcatctcccagaagcagggaagtatttacttcctgctagcctctgtagtgttctgttatggctgtcactgttttagagtggtggtcccaacgttacaactgtaattcagggagtggttacagttccaattctgccacagagctctttatcttctggcttaggctgtactggcactggaattaggttgataattaggtaatcctcagatatttacctagtagactgggggtgtaagatttgtagtggtgatagtatcatcactcatctgcagcttcttgtgaaacaaagggcatatccaatgtaaagtttcaaagatactgccgaactacttaccaaaagaccgcacccaatggacatgtccttcagcaatgtttaacaaggttttgcatacatcatctcacttaatcttcaaataatcttgtaaagtcatcagggagaggctattatctggcatagactataatgtgaatggtggcccttaaagttgaacgggcatacaatgctgtggccccaaatctccattttactgaagcaaacattgaggtatcaggagggtaagttacttgctcaaagttccacagctgatgagtgtcagggcatggatttcaacccaggctgtctgactccagagccaatggtaactggggtctatggccatcttgaaaccactgcagtgcccttggtgaggagacagaaggaggccatcaggatgcacccagggcagtgccatgtcttccattcctgagtacaaacaagtcccagagtttcagtatcgcccagctggtcattcttcaggcctctgtcagtgcctttcagtgagaagcagtccccagagacagaataaatcagatcatttggctcaggaaaaggcattggagaaacaaattgctgttgcaccatgaatgtaataaggcagttaggtgggcggaaatagttctcttttgattatatgagtgaggattatgtgtagcaaatttgaattccaagctgccttttccttggcctcttccctaccctttcactagccatacacttctaactgcctctccaagctgtccagctggtatgtgctctgggaacactaatctaacttttcatattagtccaggcaaaatataattaggaagaaactcttctgccaaaacaaaaatcacatgctaatgtcaaatagagatgattttttacatctactatttttgtttatttgcaccagtattgactcataattatattgtataacccagatttgactgtattgccaaatacaataaaacaatttttaacagaaatttcatttgttttctctttcccctcccccaaatttggacagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctgtgagtaacttaacaacttttttccttagcaagggtagtgttgacacagtacttctctgctagcagtggccccaggttgctagttttgtcatcactttttaatgaggagcacatactgttttcttttatctttattttgatatgatttcaaacttatagaaagattggaagaataggatagaagaacacacacacacacacacacacacacacacacacacaccacttatttgtttctaagtcatttgagagtaagttgcaggcataattctttgctacccctaaatatctcagtgtgtatttcctaagaatgaggaattctcttaaccaggctataatgatcaaaatcagaaaagttgatgttgatacaatactaacatctaattcacatttcacattcatatttagccaattatcctagtaatttcccttataactattttttgcttggcccaggatccaactcaggatcacacattacatttagttgtcatgtctctttagactaatttggaatagattctcagcctttctttgtctttcatgacctagacatttttagcatacagtccagttactttgtctctcaatttatgtttgtctaatatttcctcataattagattcaggctatgaatttttggtaagaataccacagaaatgatgttatattcttctcagttcatcacatcagtagacacacggtgacaatttgtctcattattcataataactttgatcacttgattttggtgatgtctgtcagatttctccaccataaagttattattttttcctttgtaattgttgagtaatttctggggagatatttggaggttatgtaactatccccttcttaccatactttcacccaataggttttacatctattcatgattcttgcctgattcactaatcactatgatgtttgcaaaataatgatgtttaaaattccatttttttacatttattagttggcattctattgtaagaaagagctttttcttcttccatatttatgtgtttatttatttaagacacagggtctcactctagccaaggctagagtgaagtggcatgatcatagctcactgtaacctctaacttctgggtgggctcaagtggttttcctgcctcatcctcccaaagtgctgggataacaggtgtaagccaccacacccaaccttatttatgtgtttatttatttgaacatgaactcatggattctcattttattcaatgggttacaatctgctactatcatttattttgatgttcaaattggcccagggttggtcagtgagagtttttcaatctggctcttgtgtccttttgacaagttccccatcattctttgagcattttcttactctctggcacaacaagatgttccaggctcttcttgtacgttttctgctcagcccaaggagcagtcattttactaaggcgtccctcttccttttagtggggaatgatatttataaaccaattcattttttcttctgagagcaattatgatatgggagaactctttggaatggagttcttgtaaggaacctggcttcttggaattacacctgtatttgtctcctctcgagtttggggaaggaaagatgagattgcttttctctgcataatcccactctgctctcaaatccagtcctctccactatcagcagcagcagtctttagcacaggtagtcagtgataatagcatcaagacaagatttttttgcatttcccaaaactttcacttattcttgaaggagtattattgactgttgttatgggttttttccttccaggaggaagctgttaggaaaggaataggggctagatccatgcctaaaagggctctctcagactaaggggatatgttttcaccaacagtctggatgctgtttgagttaactgcagaggaacattccaggggatttctgtttctttgagattagaccaatgcaaaggagcaggaaagctattcctttgtgctaccacccaaagatatttgttttttctcttttctggggccttaaaaacaaaagagaatattcctagctggctctgattacaaaactgagctacagactagtaggttaagcctgaacagctcacccaaagcagtttaaagtaactttatctttgatctaaggaaccggaagtatggccttatatccatgtgctcagcagtggtgttttaaaaccacatctggccagcgaatggccatgagttttcctaccactttgtgggtagatagctaaatctaactgctgtgttaaagtactagacaaccctgttttattttgctcttttgtacactttttttttttttttttgagatggagtctcgctgcgacacccaggctggagtgccatggtgccatctcatctcactgcaacttctgcttcccgggttcaagcgattctcctacctcagcctcccgagtagctgggactacaggcacatgccaccatgtctggctaatttttgtatttttagtagagacagggtttcaccatattggccaggctggtctcgaactcctgacctcaagtggtctgcctgcctcgccctcccagagtgttgggattacaggcgtgagccaatgcacccggcctctttcatacactttttaatggacgaccatcctctgggtctgactgaatcatggtgggcataatgcacaatctaacgtaacaaacaaggaaattatcacctcaaacaaacaaaaaaaggtagtaaatgttctctctactattcagatctcttcaagtgttctttccaaaccttggaccaagagttcctaatctaggggccagaatggccttgaaggagttgacaaagcccccgaaatcacaacaccctaaaaatacagggcagattttttttcagagggtgcagtctatagtttccatcacatgctaacatattatggtaattggtgccttttactaagttcttaccgtgtgccaggcattttatacaaaaggaaataggggctcagagaggttgagtaaattgcctaatgtcaccaatcaaataagtagtgtagctggggtttgaacagattggtctggttgcaaaacacatgttcttttcacctcccaccgtacaggactatctcaagtgagtctgtggcccccaaaatgttatgctatgttactatgtcttagaagcttcctttggaggtaatggctggtttgataattcacctggggaaattaggctactagctgtagtcattgcctgcctcaccactgaaggatctgtaaaataccatagaatttcacctatttcgattttggctgtatggtatctgggacaaagggggcaatatatgaataaatatgagtgattacaacatgtctagcttcagcttttgcctaataaattgatatttatggtccatagaaggattatgacctttaaaaaataaattttaatgagtacattgctaggttacaaatctcaataaatctatttacacataaattatatatatatttatatattcatgagaacaaggcttttggggaacactgcctgaaaaacatgaaccctacctgggtttaataaacaagtattcactatagttggaaatgtcttggaatattaaacaacatggtgacaaataataacagtgaaatttctagtcattagaaatttagttttcaagtagttttaagcatcttctacttatttttaaaaattacaaatgtaatacatgtgtttgtgaataaaatatatttaaacaatacaaaatcatatgaaatatcaagtaaaacctacccttcactatcctcttcacagaggtgtctgttaaaaaattttttccatgggtttgtaataagtgtgtgcatgtatgtgcatgagtgtgtacagtttttaaaaagggatggcactgggagatatacctagtgttagatgacgggttgatgggtgtagcacaccaacatggcccatgtatgcatgtgtaacagacctgcaagttgtgcacatgtaccctggaacttaaagtataataaaataacataaaataaaataaaataaaaaggacagagtgggaaataaaataataataataataataataataatatatacatacatgtggttctgcaacttgatttattttaacttaatactatcatggacagacacataggtatatttagatctgtttttagggctacatatattccatgcaacataatttacatgtaacataatttatttaactagcccatcattgatggccatttaagttgctttcaattttttgcaattacaaataatgctacagtaaatttcctcatacatatatcttggtacgtttaggttttcaattttgtaagacacgttcctaagggtagaatttctcagtaaaagcctataagctgttacaatttaaatagatttatcatttttactagttattttattaatgtaactattcattgaaaattaattgacctctaaaagtaaaattactagatatatatggtaaaagatttaaaaatacataaaagtataaatctaaagtctcctttcacttcaatcttttactctatgtgtctatccccaaaagcaatgattgttaataatttcttatatatccttgcggaaaaaatgtaaaacttgaatttacatgtaaatatattttttttctttttcacagttgggttcatcattatatgcatccttttctgcatcttttaaaaatttaataatatttttggaggcattttcatatcagaaaatatagagctatctgattcttttggggggaggctgctgaatagtatgaaagaaaaagggtatggtataatttattcaacaagctctgtttgaaggactttgaagttgtttctagtttctagctatgacaaaagtctacagggcttttaaaagtaatgggtggtgacagaaatatcttgaagcaaccgtaaagaaattatcacaagctaaagttcctctcaagatatggccagcataatttcctaatctcaactcagacacatgatcaaacaaaggaattttttttgacctgtgaatgtatgaagaaaaagagtcttccaaagacatgcagattaaattccttttagatctgcatttaagaaatcctttctattgaaaagaatgaaataacctgaactgagttcatcatgggaaatctacactgtatcaaagcatagcatccctatatctgcggggtcattgatttgctgaggttcgttaattggtctaatgctccagcttctttgaattagtttatgaattgactattcttaaaatatgcagagatggattatatggtctatgtcctttataaaggcctttgtttggctcactattaattcctctatccaattatcagctctgataggaaaagttccatggtgatgggctctactagctaaaagacaatttggtcttgccctcatacatcaattctctgtgctaccctccttcctcatcacgaaaagtaagcatgagctgtttgtagttcactcaaagccttcttatttgtattctccttcacaggatgacattctcctatagactcagagatagaagctctagcctgtctgtctattgcagcattcgtttttcatgcttttgcctggaaactgaatgcagacaccactttgaaaaaaaaaagtttccttttcaccttaaagatactcatttcatatttttctaccccacaggcagatctgtctgtggcagtttctggtcaccattatctctcacaaatctaatcaacatgctgaattatatttatagaggtcctgactgaaagaaaaaccagatgtgacatgtgggctagaacgacacatagatttaatatgaggtgatatacccaaatcacaaccagaatttggtaccttagaaaatgttctacttaacattctgttggcaggtacatctgcaacaaaatgcctcataaatattcagctactctatacctctgttctccagctcccaatgattacaataatacaattttgtgtagagtgaaagagcaaatggcaattaagcccacagacccctgtgaattagtatggattatctccactttaaaatacagagacagcaaggcttatgcaaattatttgtgcaagtgatcacttgttcacaaacaggaacaaagtgaatatggcaaatcatgtttgtgagccctccaaggatggaggcctgacctcatggcttctgtccaatgtgaatagatggatattcagtcattgctcaagcacagtactggcttttgcatttgattttttttttttttttgagataaggtctcactctgtcgcccaggatgtagtgcagtggtgcaatcagagctcctcactgcagccttgacctcctgggctcaaaccatccccctgcttcagccaccccaccccgagtagctaggactacagatgtgtaccaccacacctggctaattttaatttattttttattattttattttattttattttttggtagagacggggtcttgctatgttgcctaggctggtcatttactttttattaactgaattttttattgagagataattgtagattcacatgcagttggaaattcttgtacactttgtctagtttcctctaatggtgacattttgcaaagctatagtataacaaacagaacattgacattgatacaacccaccaatcttactcaggtttctctagtttttattatattcatttatgtctgtgtattaagttctatacaattttatcacctgggcaaacttgtgtatctaccagcatactgatgctgaacagttctaatactagtaggatccctcatgttgaccttttataaccacaccaacttccttcccaccctttccccctacgctgcttcatacctaacccctgacaacactaatctgttccccatttctaaaattgtgtcatttcaacaatattatataaatggaatcacacattatgtaaacttttaggattaccttttttttttttttaactcagcataattctctgaagagccatccgggttgttgagtgtctcaatagtttactcatttccattgctgagtagtattccatggtatggatatgttacagtttattcaattattcacctgttgaaagacatttgggctgatttcaattttttgctgttataaaaaaaatccctgctatggacatctgtgtacaggttttttttgtgaacataagtttttatttctctgggaaaaatgccttggcttggctgtatggaagttgcatgtttagtttttttcttaatttaaaaaataattaaatttctgtgggtacatattaggtgtacatatttgtgtagtatatgagatgttttgatacaggcatggaatgtgaaataatcatatcatggtacccatcccctcaagtatttatcctttgtgttataaacaatccaattatactcatttagttatttttaaatgaacaattaagttattattgagtatagtcaccctgctgtgcaatctaatagtaggtcttaatagtaggtcttattctttctaacttttttttgttcacattaatcccctccttcccctcccccaagtccccctctacccttcccagcctctggtaaccatccttctactctttatatccatgagttcaattgttttgatttttgtagcccacaaacaaatgagaacatgcgatgtttgtttttctgtgcttagcttatttcacttaacataatgactccccgttccatccatgttgttgcaaatgactggatctcatttttttgtggctgaatagtactccgttgtgtatatgtaccacatattctttatctgttcatctgttgatggacacttaggttgcttccaaatcttagctattgtgaacagtgctgcaataaatatgtgagtgcagatatctctttgaaatacttattccctctcttttgggtatacacccagcaatgggattgctggatcatatggtagctctatttttagttttttaggaacctccaaactgtttgcacatttagctttataagaaactgtcagactgtttacaaactgtcagactgttttacaaaactgtttttcagttttacaaagtagctctatcactttatattccaccagcaatgtataagggatctagtttctcagcatctttgccagcatttggtgttgccactatttttcattgtagtcattcttgtaaatttgtagtgatattttattgtgctttcaatttgcattaccctgatgcttcatgatgttgaacatcttttcctgtgcttatgtgccgtcttcctgtgttcatcagtgaaatgtctgttcatgtgttttgcccttttttaaaaactgggttgtttgttcattttattgttgagttttgaaagtaaaaaaatatattctaattttttttttttttttgaggcggagtccggctctgtcacccaggctggaatgcagtggtgcgatctcggctcactgcaagctccgcctcccggggtcacaccattctcctgcctcagcctcccaagtagctgggactacaggcgcccaccaacacgcccgactaattttttgtatttttttttaatttttattttttttattatactttaagttttagggtacatgtgcacattgtgcaggttagttacatatgtatacatgtgccatgctgatgcgctgcacacactaactcgtcatctagcattaggtatatctcccgatgctatccctcccccctcccaccaccccacaacagtccccagagtgtgatattccccttcctgtgtccatgtgatctcattgttcagttcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggagtcgccacactgacttccacaatggttgcactagtttacagtcccaccaacagtgtaaaagtgttcctatttgtccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagcccttttcagatgagtaggttgcaaaaattttctcccattttgtaggttgcctgttcactctgatggtagtttcttttgctgtgcggaagctctttagtttaattagatcccatttgtcaattttgtcttttgttgccattgcttttggtgttttagacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaatcctagaagaaaacctaggcattaccattcaggacataggcatgggcaaggacttcatgtatttttttttagtagagacggggtttcaccgtgttagccagtatggtctcgatttcctgaccttgtgatccacccacctcggcctcacaaagtgctgggattacaggcatgagccaccgcacccagccctaatatattctaattttttgttgggtatatcttttgcaaatatttccttctagtctgtagattttttaaaattctttttgtatttatttgtttatttatttatttatttatttgagactgagtcttgctctgttgcccaggctggagtgcactggcacgatctcagctcactgcaacttccacctcctggattcaagtgattcatgtgcctcagcctcctgagtagctgggactacaggcacatgccaccatgcctggctaatttttgtatttttagtagagatgaggtctcaccatgctggccaggctggtctcgaactcttgacctcaaattctccacctgccttggcctaccaaagtgctaggattacagcatgagccaccacacttggcctaaaaattctttttatatgggctttcacagaacaaaagcttttaattttgttaaagtctagtttattatttaatttttttaatgagtcatgctttcgatgttcaagtttaagaactctttgcttagccctagatcccaaagattttctcctatattttttctaaatattccatagctttgtactttacatttaagtctgtggtccattttgagtcaatttttgcataagatgtgtgaggtgtaggttgaggttctctctctttctttctttctttctttctttctttctttctttctttctttctttctttctttctttctttttctttttctttcttttttttggtctattgatgtccagttgcttcagtattaattgttgaaaaggttatacttgctttattgagttgattttgtacctttgtcaaaaatcagttgagcaaatttttatgtgtctatttctgaattttccatcttttccaatcatctatgtatctatccctctgccaataccacactattttgattgctgtaactttacataaagccttaatattgggtagagagattcctctaaccttattcttcttttcaaaaattggttcagttattctaggacttgtgcatttccataaaaattttagactatgcttgtctgtttgcatataaccttgatggaatattgataggaattggattatatctgtatatcaatttgaagagagctgacgtctttactatgttgaatcttccaatccgtgaacacagtgtgcttctccattttttaaggttttctttgatttgtttcattagcattttgtgatacacatgctttgttaagtgtatacctaagtatttcattttcattggagcaattgtaaatagcattgtgcttttgatttcagtttctgcgtgttcatttttaggacatagaaatgtgattgctttttgtgtgttgattttgtattctgaactcatttataagttctggtagatttttttcttgaagattccttgaggttttctatctggactactgcataatctgcaatgccttaaaaaatttttttttgcctttttggggtgcctctaacttccagtaccacgttgaatcatactggtgagagtggacatccttgccttgttcctgatcttagctggaaaacattcaatctttcaccattacagttgatgttagctgtaggtttcttgatgatgccacttaccatgttgctaaaaatcccctctattcttaacttgcccagagattgtatcgtgaagggatatgaatttttgtcaaatgccttttttggatcagttgatataatttttcttctttatcttgttgatattgtgggttatactgatagattttcaaaggtttagccagctttgcatatttggaatagatcccacttggtcatggtatataattatttttatatattgtttcatttagtttgctcatatattgttgaggatttttgtatttaatttcaggagagatattggtctgtaatttctttctttttttttttttactgtctctgatttcagtatcaggatgacactggccttataaaatgtgtaggaaagtgttcctcttttctggaagagattctataaaattggtgttaattcttccttggcagcaaactccagtgaaatcatgtgggcctggagattattttgtgaaggcttttaaattagtagttcaatttctttaatagctatagggctattcagattgtctatttcctcttgatggagctttggtaaattatgggttttgaggagttgtctatttcttctaacttgttgaatttgtgaacataaagttattcataatattctcttattgtctttttaattgctgcagaataagtagtgatattctctgtttcatttatgatattgatgactgacttgtgcttttctctttttacttttatcagtcttgctataggtttatcaattttattgacttaaaaaatcatatttgctccattgatttttctctattgtcttcttatttttaatttcattgagttcttttatgatcttgcttatttttttattctgcctgctttggatttatcttggggttttttttaggctcttgaggtgggagctgagattattgttttgagatatttcctctttttaaatgtatgcatttagtgctataatctttcttctcagcactgttttagttgtatctcccaaatttttaaaattaaatttaatttgattaaaatagttttatttaattcaatgttttaaattttttttgttaaaatgtcttctttgattcatgggttatgcggaagtgtgttgtttagaacttttctatggtctttctgtaattgatttctagtttgatttcataataatcagagaaaaccatcttataaattcagttcctttaaatgaggtttgttttatggcccagtgtatggtctatgttggtgaatattccatgggtgcttcaaaaatatatatattctgctattgttgagtggagtgctctatatcaactaaagtctgttgattgtgttgttcagaacttctatatacctgctgattttctgtttagtagctttatcacttgttgagacaggggtgttaaaattcccaactataattatggatttactatttttcctttcagctccatcagttttgcttcatgtattttgaggctctgttgtttgatatgtatgcatttaggatcaccatgtcttcctggtgaagcaatgcatttattattatgtagtgtcctttcttgagtccagtaattttccttgctctgtactctagtgaatattattatagccatttttactttccttaaacttactgcttgcatggtataatttttccattcttctactttcaacctacctatatgatgatattcaaagtacattcttttgtgaacagcaacatatgggttacttgagcgtactttaatattccatcttgatttatttatggggttttgagtttctctttgcatggttttcctagtggttggacttggtattacaatatgaaaatgtgactactgttgtcagcattttatcagtttgagtgaggtatggaaacctcacttccattttggtcctttgactttcctcaccttttagattttttttgaagggatcttgttctgtcatccagactgcagagcagtggagtgcagtggtatgatcatagctcacagcaacctcaaactcctgggctcaagtaatcctcctgtctcggtttcccaagtagctgggactataggtgtgcaccaccacgcccagttatttttaaaaaaattttttgatagagatagggtctcactttgctgcccaggctggtcttgaactcctggcttcaagcaatcttcctgctttgacctcccaaatttctaggattacagacatgagctgccatatccagccacttttaaattttgttgttttaaatatcagatgatgttgcaatttttgtctcaatcatcaaatatgatttataaagctcatgaggaaaaggatcatctattttatgtacccatatttttgttctttcctttgctcgttttttctttctcattctccaagattctttaaaaaaattatttctgtttgaagtaattcctttagctaatcttttaaagataggtctgccagtgacaaggtatcttaattttccttcatcagagaatgttttcatttccattttattcctgtaagatagctttgctggatatagaattcatggttaacaattcttttctgtcagcttttgaaaaatattatgacagcttcttctggcctccttagttctggatgagaaatctgtcatttaagttgttgctcttctataagcaatgtttgtttctttctgtctactttcaaaattttttgtcttttagttttcaaaagttcaattatgatgtgccttgccacagatttctttggcttttatccttcctggaatttgtttagctttttgaatctctaggtttgtgtcttttgtcaaatttgggaagcttttagcctttatttatttattttttaatatacattcagccccactgtctttctcctctcttttaaggctatggtaatatgaatgttggatattttgttattgtcccacaggtcctagtggctgtcttcatttttcttttcaatgcattttctctattgtttagattgggtgaattctattattttatcattatgtttacctgttctatcttctgtcatctctactctactattaagtccatccagctcgtcttaaaaatttggttttgtattctttcattctataatttccacttggttcctttttttttttttcaatacagagtctcgttctgtcgcccaggctggagtacagtggcgcgatcttggctcacagcaacctccgtctcccgggttcaagggattctcatacctcagcctcctgagtatctggcactcaacaccatgtctggctaatttttgtatttttagtagaaacggggtttcatcatgttggccaggctggtctcaaactcctggattcagatgatccgtcttcctttcctcccaaagtgctgggattacaggcatgagccaccaagcctggccccattttttttccaaataatttcaaaaattttaagttcaggatttgcagatttgttacctaggtaaatgtgtgccatggtggtttgctgcacctatgaacccatcaccttgattctttcttaacaatgtttatttcttttctgagattctattttttgcatttcaagataatttgtaattgcttgcaggattatttatatgatgattgctttaatatcattgtcagataattccagtgtctaattcatctcagttttagcatcagttgattatcttttcttactcaagttgtgattttgttgcttctaaatatgacaggtaatttaaaaaattgtatcctggacattttgtcaattaggagattctgggtcttttttaaatcttttattttagcagtcagtcattctgtttaggcttagcacacaggtcttggtccatttttgtgggctgtgcttccaaatacaacttaatttttatagtctttgtgatgttatttcatcttgcttggtttatctggtacccctgaggcttccacctgtctctgctggtgcttcttgggtggggagcagaaggcatctccttaggccaggcctccagctgtctctcagagggggatggatgtgggggcatcaccctaccaatgcctcttgacttccgctagtctctggacaggaaaggaaaatcttgggctagttttcgtagacttggccacctgctgctggagagtccctttttcttgtttcccctgcctaccttggtgtctctgggtgagggaagagaatctcagtactgcagggacaaaaagacttcctggatcaggccacttgctattactggctccctttttcctcttatgcctgcctgccttggtttttctgaatgggcgaggaaaaccttgggttggcaaaaacaatagtcttcccagactgggttatgttcaaccagtgttttttggtggagaggggagattcaggcctgttagggaaggagagtgcttctcttggttgcttattgttagcaaggtgcccagtcagtcccccttgctggagtatccaacttgcctgaagttgtcagagggactcccatttgatccagaaggggaatgagcctacttggactgacttctgtttctaggttggggattaggaagcatagggcctgggccgcatttttatgctgggtttggtgagggggagaagataactgccactatgttgttcctttactcttggggtcccaaaccagtttgttttattcttagcacctttcatagttctcctttggttgtctcttacaccatttccaggatttatagttgtaccttttggggaggagcagggaaaagtggctctatgccatcttgttcagttgagaagtctgcatttgcttttaacatcagttcttgggcagtaaaagctcttgagtgtgtatgcgtagacagatagggtgcaacaaaatgacagagataatatcactggcattgtaactaccttactcacttacaacattttcttttctgagaaggacaggcattaaattcaatggagataagtgtgccatttaggataaaaaaaatccctaccacatatagggaaaagagaaagattgatgaagcagaagtaaagtgaacctcactcattagaaatgataggtgcacagaaagtctgaattactgaatttaagaaaaacaaaagtatgtacagattaagacaataaggtcaccaataaacaaattaagttataaaagaaatttatattcagtatcagcctacattatacaaaatgatcttgaatgttcaagatcattttcaatgccaacccattgcaattaatttctagacttaaggtttataggaatctttaattccaatggatcctgattctaaaaagctactgattgtttgattgaattgtctttatctaggatatgaatgattattcaaggcatatatcatatcagggaatgtccataatttgggatccccactgagttttgattcctgggccagcaaagtcgccttgatgttttagtttagcattgcaatgctgtcctctaaagtttgtttcactgttttggatgattgctgtttcttgcagtgttcagcacttgcagaacttggcatttagtatctaactttgtttctccttggtaccttcagaaagagtctctttctttctttgtttctcctcagattggggtgtttccatataaattgagggcatacatttatgaggaatttgagggcatacattatgagaaattgaggcatttctacatactgtctaatttcttctctaaatctttcatctgtggaaatctcatttcaacactgcacttctctgggcctcatctgtaaatgaaaggattgaatataatctccaagtcctggctctaaaattctgggattttaatgaatgaagactttagtctttattaatacagactttagaggaaaaatttgatacagcagtccctctggaagaaaccttgcatctgaaagatttaatggaaggtttgctgaaatatacaaacccaggctttaggttaaaacggagcaatgtaacatgcattatttctcgagatctctggtacttaaaatgccacctgcttggcaatttagctcaactcatttgtttttatctttctaaatcttatattccttcttgagatgcttactggaagtgttaataacaattgctacatctatggctcagccctctctgataaaaataccatgtctaactcccattccccgtcttctaaaagagttttccactacttatggattactccaatagtgctctttgaatgctgcatcaaagaagataacttagacttttatggtatttagtgttttattgttttcctaaaaagtgaatgcagttcaatcattaatcttttgtaaaggagagggaattgtgaactcttctctcaacaattagtgcattcatagagtgatttcaggctctaggatgccacactcctcaaatgtgctagaagtgacactttcacggaggtttgctaagccagttggctggtgtaaacccacctacaaaattggaaatgaagatcctgacaattctcctttcacgtggagttatggacaaatttgaaagcataaagcttaaaatactcacttggctgctgaaatataccagtttcttgataaggcctaacataatgtgcatctgtggtaattggaaaaatgtcataaaattaagtgaaaaagtactttttatatagctttgtcttttccccttaaaaatgtgtgtacttttatcaactcatctatacagtcaattggaagattgtcattcattctacttgctaatgaccacaaaatcctgaagaacatcctacacacacctcaaaatttctggatatgcaaattataagtaattttaatgctcaagacagtgaaacaaatcagtagattgtctactaccacaattattcctacatcataggtaatatgcttctcagatggataaattcaaaatactaatttccctaaggtaaatatggatgtttgggtgatttcaattggagaaagatcatgactcagtcttgaattttactatgtaccattttcacttggatattcactatcatcctaaattccacttatccacgtctgaactgggtgtttttcttctgagtgaggctgccttcccaatttttctgtttttatgaatattatcactattctccgagttgcccagaagcaaactttgagttctctgagatttctgtcttctttatctcttaaatctctttgttatcatacactgtcaattcttactttccagtagatatagggataggaatcttcacactgctctcacatcattccaagccttattcagttattctattagcttacaaatagatactaaacatctaccatgtgccaggcactgggatagacactaaagatacaatggtgggcaacaaaagatgaggactctgtccatgtggtctagcgaggaagacagacattaaaaatcacatgcaaacaaaggtaaatctccaattatgacgcattaaatgaagaagaggtatgaggcgtcataagagtctaaaatagattggtgtgagctagtcatggaagtcagggaaggtaggtttccctgaagaggtgatgcatgagctgagaactgaagaattggcagaagttaatcagatgaggaaggatgggaagtacattctaagtagaggttacagcaaatgcaatggtcttgtagtgggaaagagcatgccaagtattagagaactaaaaagaggaagactaaaaaaaaacagaggggacttagcacaaattgagactgaagagctagagagggaccaaatcatgcatagctttatatgctttattaagaaaaaattttctttttatcctatgagcaatagaaagcaactaaagagagctcagtgtgtgtgtgtgtgtgtgtgtgtgtgtgtgtgtgtgtgtgtgagagagagagaggaaggggatcagattggcacttaaaaagatcattttggttgtattatggaacagattagagggggtccaagagtagtggcagactagttcagttgggaggctactgcagtagtccaagtgaaagatgatggtgactggttagggtggtaagtgatggagatagagataaactggggtgagccaagagatatttaggagctacgatcaataggacaagattatggattggctatggcaggtgagagagagaatgaaggagacagagggagagacagagagttggagcttgcataatttaatgtatgatagtgtagggccagtcactaaaggaataccagaagaggacccagtttggagagaagctaatgagttcaagttggagaatgttgagcttgaggtgttaatgagatatccaagaaacgatatcaagtaaacaattggttatataaatgtggagctcaaaatagagcaaaatagagatctggtcaagagatataactttgagatttgtctgggtataggtgtaaattgaaatcctaggtgtagagaaactatacagccaaatgtgaagaggtcctgggacaaagcgttggtcaggtaaaataggatgagtctaaaaatgagtggacagagaagtaggagaaaacgcaggagtgtgatgtgtaatggaaagcaatgaaaagagtattttaaactcattacttctactaaataaatgttaatttgggagttccagattaaaacattttcaatctggtgtttaaatgactgatagaagtttgaccaagtgaaagccaactgttttttgagcacttactctgtataagaagctatgctaagtgttttatgcacattaactcaatctcataacgattttataggataggtgttattataatcctcatattatagaggaggaaactgaagcacggagaggttaagcaactagtccaaggttatgtaatgggtgtgaaagtgatggagccagcatttaaaactaatccatttgaatctaaggttgattttttctttttggaatattttaaactacacaattcaatttctttaatagatataggactattcaagttatctgtttcttcttaactgagttcttatagctgtatttttcaaggaattggatcctttcccaaagctaatcttcttaatcaatgcactactgtggcatgcatccctctttcaggaatgtttatatattttatgaagatactacgaaatggatatcttcctaccagttacttaaccagagtgttatgagtaccatatagaggtcttagagagtagaaaattatcttaaggaaaatcaagtgatcaagtgatttgattatatctatgatactttcttacaaaatgaaaagaaattatagagctctttctagttgtctctaatttccaaagctgaatccaaaataacacattctttctgatttttttagttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacaggtactgctccataatgcatgtggtgtagccccaacagaattcatgcactatgggtcatgtgttctccaaagtggcccgttcttggaaggcagaaaagaatgaagaagggtgcaggtgtttcttgtctccttcagacagtgggtacagtgagtaccttgtccaaatacaaaattctctagccatctttcttgtctttgccttattgaaatataatgtaaatgtatgttttcactcagcatgacaatttctaagcctactttccacctgttttgttcttgactgtctgactctgattctgccaatgtgcacatggactaggaacctcatcccttcccagtaagagaatcatacggccttaggtctgagcatgctgaccacacaccagaaaacaccagaaaaaaacaccagaatatatcttatcttgccttttggattccttttatgcaggtctcagccttctccaatccctacctgcagctgactaggagtgcttgtccaaggccagggaatatttggcttccatattgttcaaatttggaatattcctgcaacttttaacattctacaatagaaatttgataggatacacaagagcaaaagggaaaaaaggagagaaaaacccaaagcagaaaacaaggcacaggaagaaaaaaacagttactttctcagagaaaatgatcttctgagataatgttcagtttggccattgagtggactgaaagtctgttggccaatgagagtggagaattggtgggatttgtggagtgtctgtcaactagaaatcaaggaagtgcccaaataaagcaaaactgggatggtaacgtcctgttctgctttttgatatggagccgaaagtgttggttcttgaccttggagttaaattaagctaagtttaggcatgagacgttattatttggtttactttaaaacagagaacacttttcaccaaatttacagaagtcaaatttcttgaactaaatgaataaaattaacctccttatttttaattacagtttccttctacaatgttgaaatgagcttctctgtctttgttgaagagccaaggatccctattaccagtgttataaatgaatttacggaaaattcggtaaaataatcttttgcatatttatggcatatataaatatatgtgaatatatacatttatatatatgacagaatatattaaaactaggctttacttttttctaccaataataaatttcacagctaagtagtttttttttttttgctgcaaatctgtctactctgtaagcaacatcatgagaatgtatgcaatctctctttcatagtgccaatgttgaaagcttttatggaacgttattattttcatttgttgagatctgtacatttccctttagagacacaaattctgagtctttgccaaattttcctatttgggaaaagtgggagagcagtgataacaaaatgtatacttaaatacaatggtatttaagtattattgttttctgcattttatttctttttccaacacaatgaatgttttacttatccttaattttttcttgatatgactaatacatactctctgtaacaaaatcagacattgacatcaaaaacccagaaagtaaatgtcctctctctaatactgctctgtgcattaactcctcttaatagtttaaggtacattcttttagatattttttctgtgcatattataacattgatgcatgtgtgttcttttacaaaataattgtagttgtactagttatgctatttttcaacttgctccccctcctctgcacttaaccatgtatctttgcacatattcatgctggtaaatataaatcatacactttaacagatgcatagggtttcactacatggttgtagtatagttttttttttaaatcctttggtggacatttaagttgtttctatcttcttctctatttagaaacaatgctgggctgggcactgtggctcatgcctgtaatcctagcactttgagaggttgaggcaaaaggattgcgtgagccaaggagtttgagactagcctgggcaacatggcgagatcttgttttctttaaaaaaaaaaaaagtttaagaaagaaacaatgctgaaaacaattccctagaagtaaattttaaggcacttaagtatttttataggataaattcctagaattggaatcagtagatgaaaagatgtgaacctttcacatttaaatagctgtcactaaatggcctcccagataggtgacaccaacttgcaccatctcccaacagcaaataatcatatctgtttcccttctttccctgtcagcacttattttcaagtgtctatggcttggttataaatccttgaaaatgggtgggtgtattagtctactcaggctaccataacaaaatgccacagactggatggcttaaacaacagatgtttattttctcacagttctggaatctggaagtctaagattaaagtgctggcagagttggtttctggtgaggcctctctccttggtttgcagatggccatcttcttaactgtgtcctcacatggactttcctctgtgcatacgcatccctggtctctctttttcttcttataaggacactggtcctgttggagtagggctccacttttatgatcttatttaaccttacatccccaaaggccttatctctgaatataaccacattcggggttagggcttcaacatttgagttttggaaagacacaattcagcccataatagcaggtaaaacgtaaatggaaaaacttaatggagcagatggaaatgttgagccagctgaaataatgagtgcagcttaatgatcacaccatcccaagtgattttgctgagttaaactagaggagcagaatactaaaactgatttttttttgtcttgtacagttgaattctatatttcagaacagtgaattttctcttgctactctggaaacccaaattaaaagcaggtatgtgaatgacatttactgtgggtcaaagggcaatttgagggcattttgggtctgttcctatctggaggggatgtcctatgtttatgtctgagatttagggctgccacatttttagttgcatcttccttcctgagtaggttctttttggcatgaggaaaaaaattgtattactattgtagggcacaaagccaatgggagaacaaaacaaaagaaaatcaataggggaagtcatgcagttagactgagttacctctaatgcccttttcatctctaagtttctatgaatctgtgatttatacaaaaatcatgctttgaagtgctatgtatggacaatgcacgaggatttataaggccttttattttggaatgattcactttcagaaaagagaaattccaaagtgaacttgaaatgtctaaagcaagaatgttgactaatccaagatttgcttggggcacaaatttcgaaaggtgattgcagtgaaatgggcaggcactgagtagtatcatggaaactatggcaaaggcaattgctcacctgagaagtatttcctgtattctttcgctgcacatatactagtcctctgtaaagggacaccccgcagaagctctttgaaaaataggcatggctctgttaagccatggcaaactgatttttaaaacataaaatgctactgcctgtcttctgtacactgggactttggtttctcttacatatccaagtattaattattaatcaagtattaattcatatacatattaataggttcaagaaaattcatataaatgaatggaggtaaatgtacggtaggttattgtcttagtcagttttgagttactataacaaaaatgctatagactaggtggcttaagccacagaaatttattgctcacagttccggaggctgggaagtccaagatcaaggtgttggcaggttcagtgtctggtgatggccctcttcttgctgtgccctcaagtggcagaaagcagagagacagaaagctctcctgtctcttcttataagggtactgtttcaaaaaaattcaaactgttttttttcctctgttgtcataccaacacaacaatcaatatagaagacttctacgaccaaacgtgtggggattttcccccaacacaccaagcagctgacaccagctggttgttctctacttcaattctattctggtgttatcctctcaaaaatagcttcagatctcacaggtccccaagactgcccctcaccccagacactagtcaaaagtccaggcctccagaacttctgactaactgacttcaacttggggttcccgtgacccactctttgagcttgattaatttgctagagcagctcaaagaactcaggtaaatacttatgtgcattggtttattataaaggatactgcagaagatacgaatgaagagatgtgtaaggcgaggtaagggacaaggggaatggagcttctatgatctccctgggtgcaccaccctccaggaacctccatgtattcagctcttgggaagctctccaaacccagtcttcttgggattttatggaaacatcattatgtcagcattcctttcccaagtctcatatgaggcaagactctttctggagagggtcttaagactcacaatcagaaaggtgaagaaagattagagttccgccttggggcaggtgaaaggagggtgggagaagatcagagagattctgtttgctgaagccagcttctgaggcctagcacacctaacattataacaaaagactgtaacaagggctatgggagttatgagccaagaactgtggatgaaaacatatgtgtacacacacacacacacacacacacacacacagagacacatataacacatcaggcaccgattccattcatgagagttccaccttcatgatctaattacccctcaaaggccccgcctcctaatataatcacactggggattggacttcaacgttgaattttgggaggacacaaacattcacaacatttaactcactaaaccaaaactagagatgtctgggggtataaaacattctttttaaaaactgtgtctattatttttccttattacaaaagtaatatgtgaccactgtaaaatcttagagctttacagaaatatatatatatataacatggacggtaaaaatctctgaatacttgccttcccccaccccttcaagaactcctgttaacagcttattttattgatttttctagatttgttttcacacatttactaagagaataagattctcctctacatactgtttgacaactttcttttcatgctttgtaatacatcatgtatgccttttcaggccaatacatgcagatatagctcatttgttttaataattgtacaggattcttttatatgatatgccatgatgttttcctccaattatctagtgatggacacttgagtaatttccacttgtatgtctatttttatgcacttttgctggtaccattatggaatagattccaggatgcaaggttaataaatcaaaggcttgccaccattttggtatgcatataataagcaagcccattggaagcattcctctggagccctagcattatttgaattccaggctgggagaagtctactgttctgcctcagagttgcctttctcctgatctcatgccctgtatacttggtactatatttcattttcctataattttgtaatgcttttgatacagggacatttcagaggaagagatggtcatggatcgagctattgtaagtaatttttcaaaatgaatctacttgtgacctatcctatgcctgattagatgtaagtcaatagctcttccacccaagtatatattatcaggcgaggctttgttgtggcaattgggggtcaaattacattacttcctttgggattggtacaaaaagccatcaagaaaaccatcccctgcttttttgaactatccatgtggcagctttttgaggcacattttctggtctacagggattgtaaatggtaagtgaatttcttcgttatagatgtcttgcaaaaaaaacctagctcttccaagagtgacacaattgtttgcaagactggcattcacacaataaatccaccctctatttgtccagatttgaagccagagtgtgataaaactatctcccatcatccttgccccaattctcagttcttgttccattgcctcaaagctttacaatagcacactctaaaatgagtagcaagcacacagctttccaggtatttaagtgtgaggtaagtatttgatgatacagaatacaatcaagcccacagtacaggggccagaagcagtgactcacacctgtaatcccagagatttgggaggctgaggtgggaggattgcttgaggccaggagttcaagaccagtctgagcaacatggggagaccccatctctacaaaaaataatttaaaaatattagccaggcacggtggtgcattcctgtagtcccagctactgaggaggctgaggcggggggatcacatgagcccagatttcaaggctgcactacactatgattgcaccactgcactccagcctaggtgatagagcaaggctctgtctcaaaaaacaaacaaacaaaaacctatagtgcatagtgcattccaaattatccactatcattaaaaatattttctgtaaatagctgagtcagaaattttgatatatacacattatagcatgatataactaaaattcctttcagtaacaggtgtaaaatccttttggtgataatatggtcaagctgcctgggttggaacccctgcttttccacttcctgactatgagaccttgggcaacttaattaacttctctgtgctggagtttcctcatctgtaagatgaggactgttggaaggataaaatgagatcatctatgttaagtgtttaacactgggcttagaacatagtaaatgtttgatagtgtttacaattgtcaattgcatgttaatatctagatccagaaggcttagattctgctcctagttctgtgtcttgtcaactgtgtgatactgggcagaccatttaacttctctgtgactcagattcctcatgtaacaaagagggcgacaatccctgtattgcccaccctacagggttggtgtgaggagtaaatgcattgatgtttttgagggtagtttgcagacggcaatgagttacataaatgtgaagcataattatataattgttgttaacaataagccctgtactcagttatgacatttgtttaaagatttcagtgactatgtacttttcttttgcattagttggaacagagagaaggacaagaaatggctacaatttcctatgtaccatacaggtaggaagtaggaactgagtttattaatagctggcacatttagttctgattttccttccatttaattctgcatgtgcggccagttggccagagttgtcagaagaagatcaaagtacccagtgattatttcacatatgctgtaattaggtccttgccttcatgaaatatgttgtttcggttggtcatggcacaggctagcggccagcctgctgcctctttgcagtgaagagaaaaaggggtggtcataatctgggacgggggagtgaagtgtttgttttggtcaaaaaggtccacgaaacacttggcagggaaattggaaacaacaacaacatggaaagtagcttcggttctgttcagactcgtggtccagctcctcctggaatgctggctattgttgatctgttcgacgcacatcaggaagaacatatagtcaaaaaaggcccatgaagaggtctttgaaatggagtagagggtctgtcgcaagcaggaggagaggtttaaaatgaagactcctcttcggactggaaagatgaaagctgagaagagctaggctccaaaggaaggagacaggatgagcagggacttcaccaaatatagatcaagggaggggcagatatcacttagattagacatggagataagttttgagcaagtacaggtatgtctaacttgcaacaactggcaggaaacttagcaaatatcttcttcaaaaagccgtgtctacaaatggaaatggaaaaaagatataggtaagtttttgtatctgaaatgtgcttcctaatggaatattagaggaattcagaatatttgaggatcttgctgtagaggatagaggatgaagtcaaggacagctctatcctttcatcagtgatcttttagtggacataaatactgagtgagtttttgtgaccatgggaaacattatttccctgaggctgagttccatcatctgtgttatgggaataataatagcattacctcatacggtcgttgtgagaataaagtgaatcagaacatgtggaggaagggtttcacaaatgttagctactatcattatcattatcatcattattacttattatagaaatgagccttcttcagaacacttctttatagactaactgagcatcatatgcctatttgcctgatttcagtaatgatgggtaaattggagaccagaagaataaaaggttctctctgaaataataaatcctgaaaactccatcttctctattaattattacaaactcttagagaaatctcaaggctagcaatttcaacacaatgcatacgttactgaccattcttttgaaaataggttttgcattgtctgttttggataagagaaaatttatcagaacatttcagtatgctgtcttccatcacttcttaagattggctgcttaatagctgtaaaatgtttgacatttatgaactaccaattaaatcagctgtacagaatttctgcattgcaggccaagttgcactcccttgacataactgcaacaatctttcttttttattctgctttgtagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactaggtaatttttttggggggtggatattgcagtatgaacttacttcctttattataaaactcataatgcatacttggttaaggattctgagttcagaaaggagagaagtcatctttctgttttttttttcatattcttggtacccacttgatctgatgacctttctacctttaagaacttatggaagaacagaatgctggaggagttaccagagactgctggtcagctctggatattagcaatggccaatccgtcaatggaatgggaggattttctctcttgcataaatacacagagacctgaagagcttcctcattaacacacaataaatgcctaatagatacttgctaatttattgattgattcagccatcttattcatcttggcaagtgatcagggaactgtcccagatttctctcatgggggcattctctgattagcaaagctttactggtaaaagtgcaaggctaccaggccactccacctccttcccagtgcagctttgttccttttccccaatagactgctgtagaaatcattgagctcacacagctctaatgccagataacacacacaggcattagaacgcacaatccttggcaacagactaattaagtataagagggcagcctgtgacggtgcaggggtgtgagtgaaatggggggcagaaacgtgttgaagccacaggtagagcccaacatgtaaatgacactaatgaatgtgtcctaagaatgagaggaaggcacctttcaccctcactcagaatggagactgggatagctgagcaaagctggctgggccacttctcacagcattctctcaacacctgagggaaatatttccagaatcagggtcatgaaacccagtaagtgctcagaaaaaaatgggaacttatcatatagacttagcccatgtcacatctcccttcgtgtgacagcaaaaccttgccttaacagccctatgtggaagtttgccctgtccctcagcaacatcaaaaacagagccctagactgtgtgcagtggcttacacctataatcccagaactttgggagggtgaggcaggaggatcacttaaggtcaagagtttgagaccagcctgggcaacaaagcaagacgctgtctctacaaaaaataaaaaattagctggacatggtgatgcatgcctgtagtgccagcttttcaagaggctgaggcagggggatcacttgaggccaggaggttgaggctgcagtgagccatgatcacaccattgcgctccagactgggtgacagagtaagacctcatataacaaacaaacaaacaaaacagagctcccctgtctatactgatcatgtcagatacactgaatttactaaaatgaaatccatcccagagtccattaagaagggggccattccagagagagaagttcgtctatagtctcctgtctttggatataaaactgctaacagtgggtatctcagaagctgggcaattggtaggtgggaacttttgacttttgactctacactccaccacgtggcttgaaatttttcaattcttatgtattgttttaaaaacaagacagaacaatgtcaggtgaggtggctaatgcttatagtcccagatctttgggtggctgaggtgggaggattgcttgaggccaggagtttgagaccagcctctataacatagcaagacgctgtctgtacaaaattttagaaaaacctatctcatcaattcgttgttttaatgaaaaggactaaatatgtggttatactgggtggtttattatttaaaaaaaaaacactccatataatgatattttcaataaggcctggtccaaatggctaggtagaaaaagttttcttttttatttgctgatctttacgtgcagcataataatgacgttcataataatatataatattatattattatatagtaataataataatggatgtttgtaatacttttaagtgcctcttgtcctttaaaatgtgcatacattttctctgtagagcctggaaattgcaaagctgatgaaacagcctctaaatacaaagggacctataagtggctattaaccaaccctacggagacagcccaaaccagatgcataaaaaatgaggatggaaatgccacaagattctggtatgtacaggccaagttctaattgctgattcagatatacaaagatctacctaattggggacatgtttctatgtcatttgtctgagcatgctcccttcctccacctctagtgccagtctttctttctattacctttcgtacctgtttaaacatacatgcaacataacaagaaaaattttcaaggagacaaaagataaaagttacccatcatcccagaagaaaattcaagaagacaaaagagaaaaaagtcacccataaccccactgcctgaacacagctgtttttaggttggcatatatttttttcatgtaacctttctctgtatgcctttaagttttatgtagcagtaatcactattcttgtatcaataatgtaatttaccatttcattcaatggtttatcaaacattttccatgttttacatttattatcttaatgttcatttcaaaataacgaccttggaaaccatctagttgatgggctatagtaatttactaaatcacttttctattgttgactttatcattttcctttttaaaataatcagccctcttttctcactctctgctgttcatggtttatgccattaacttaagtgggcaaaaccagaggggcagcaggttttgacagaggcttaaaagcactcttttagaaagcaacattaggggctttccttttcctccctgtgtctaatcagttggcaagtcctgcagctttgatggtcatagtcagagcccacatctagcctttcctttccaaccccactgccactaccctggtgcaagcccttattgcccactattagagcggtctccttgccatctaacttaacagtatcccttacccgcctccgccaactatattctacactgctgccagcatgattttcctgaagtatggctgctatcatgccactgtcgtgctccagctccacattgcctcaagaattaagtccaaacccctaaatatagtccagaccgtaggcttcctctcctgctgtctcactcagcattctccctccctttatcatacgctccagtcaaaatgaccatttgctgttctgggctcaatggacgcttcctggtgtctctttctctgcctgtgctgtttgctcttcttggggttgggggaagagatttttctctacctctgtcctttcagcacacagctcagctcaaatgctgaaagtaacgtctctttccttggtagtttgatagattcagttttgtttatacagcttttcatcttatatttgccctaagtttcgagtagttacacttagaattttaaaccccctaattacaagttccttgagggagggatgaagccccaccctgtttgtgtgtgctacctattaccattcctagaatggagtgggtgctcaataaatgtgttagctgacttgaaatgaactggcttgaattgggtgaggcacaggggagggtggatgatgagggccgatgggccatcgagggttctatattaattgtcttaagttaatatgctgagatagagaccacattcgaacaggaatttccccttaaaagaggagtaagaagggacagtgagaggaaagagtcatgtctagaggaccagaatctctgtcttgatgcttggtcagtaggacattgccatgccccattcccagctcccttacctgtttatccactccccttcccccttcccacatgttgaccctagattcacttgctccctaagagcaaaatttcttcatttcacaaagaagtactgggctcccacctttgctttctatgccaggaggcttggggcaggcgaggagaaggcatgctaaggctatatccaccatttgctttaagactatctttgcctcatcctctgatgagaaagctctttcctctctttttcagttcaatcagcatcaacacgggcaaatctcagtgggaaaagccaaagtttaaacaatgcaaattgcttcaagaacttcctgacaagattgtggatcttgctaatattaccataagtgatggtaagattgttttgtacatataagacaaattatggaacttcaattactttgcctacttgaccccaaaccagagagagtataggcaaaccccacttaggaaaatctaccttacgacaatccaatttcagaacaaaggtaattaatgttggtggaggtggtggtgggacatgagatgttaggactatcagtgtttcagtgatttttgtttgtttttgctacatatatatatttgagatggagtttcgctcttgttgcccaggctggagtgcaacggcgcaatcttggctcactgcaacctctgcctcctaggttcaagcaattctcctgcctcagcctcccgagtagctgggattacaggcgcccaccaccatgcccggatgattttttctacttttagcagaggcggggtttcaccatgttggccaggctggtctcaaactcctaacctcaagtgatccacctgcctcagcctcccaaagtactgggattacaggtgtgagccaccgcgcctggccttattttactttttcggctaattattgtttttatttttttttaatttttaaaaagttttaataggtaatacttcactgacttcaatactcaaaaaacaaaaagagtatgtgtaaaacatctccctcccactgctgacctcagccattcagttactatccacagagatattttatggatccataatgaaatgtgtatacatatttgtgtatgtgtatattgtatacacacatatacttgccctcactttttgtacacaaagtggagcatactatacacactattctttacgttgcttttttctcttaacaatatattgcagagattattatatcagcctataaagaattttctctttcttttttccccttctgcattgtattatatataccacaataaatgtgccacaatttatttaacctgtttcttatggatgagtatttaggttgtcagtaacatttttctttgaaaacaagactgtacaactatttttgtgtttttttcattgtagggaaaatactataacatatttttaaaaatactcacatgtttgatagtgtataagatgttttagagttggtattgtctaagcagctgatatagaaggttgcatttctttcaaaaatacatttgtagaccacattagcttttatttttgtttgtgacactgttagcataattcatattattaggcaaaagagattcaaaataaagagtatctcttttaaaaaaccactgcttcgatgaatattacatatatgtcagaattttgagaaagtaggggtatacctaaagcataaatccttgaatgtagaatttctgggtcaatcatacttttgatggtgtcaaaatgctctctgtaatagttacagcaatttagattcccacttgcaaattatgaaaagcacctttttcgcaactccttcatcaacacagcatgtttgttatcagacttctggatctttttgcgatgtgataagcagaaattgatatctcaatgtagtttacaaactttttaatggagatatttacatatcataaaattcgctcatttaatgtgtacaatttagtgggtttttaaaagcatattcactagattgtgcaaccatcatcactaattccagaatatttcatcaccccaaaaagaaaccctgtacccattagcagtctctccattcctcccccaccccagctcctggcaaccactaatctacttttttgtctctatgaattttgccaatttggggcatttcatgtttctgaggttcatccaatgttgtagcatgtatcattgcttcattcctttttatggatgcattatattccattatatagatataccacattttgcttattaattcatcatttgacagatatttcttttccatcttttggttattattaaaaatctagctgtgcacatttatgtacagattttatgtagacatatgttttcaattttctcgggtatacactgaagagtagaattgctaggtcatatagtaaccctatgattagctttttgaggaacttcaaaactgttttccacagcagttgtgccattctacatccctgccaactctgtatgaaggttccaatttcttcacatccttgtaaacacttattactattgtctgtcttttagattatggctggtagtaatgccccccaacacacctttattcctaattttagtaatttgtgtcttcacttttttttatctttgtcagtctagccaaaagtttttaaattttgttaatgtttatagactttattttttagagcagttttagattcacagcaaaattgagtggaaagtacagagcttcagcatgtgccctcccccaaccacctgcagacttccccaccatcaacatcccccaccagagtggtatgtttgttacaattgaatgtacactgacacatcgttatcaccaatagttcatagttttacattagcgttcactcttgctattgtacattctgtgggtttggacaaatgtataatgacacgaatccgccattacagtatcatatgggatattttcactgctctaaaagtcctctatgctccacttattcatccctccttcctctcaacccctggcaatcactgatctttttactatctctgtgtttttgctctttccagaaggccatatagttggaatcttacaatatgcagccttctcagattgtcttctttcacttagttatgtgcatttaaatttcttccatgtgtcttttcatggcttggcagctcatttctttttggcactggataatattccattgtctggatgtaccacagtttatttattcattcacctactgaaggacatcttggttgcttccaagctctaactacgaatacagctactataaacatctgtgtgcaggtttttgtatagatgttaagtgttcaactcatttgggtaaagaacaaaaggtgtggttgttggattgtgtgataagagtatgtttagttttgtaagaagctgacaaattgccttccaaagtggctgtaccattttgcattcctatcagcaatgagagttcctgttgtttcacattctttccagcatttagtgttgtcagtgttttagattttggctattctaataggtgtgtagtggtatctcattgttgttttaatttgcaattccttaatgacatatgatgatgaatagcttttcatatgcatattttccatatttatgtctcctttggtgaggtgtattctataggctgaatgtttgtgtgccccaaaaattcatacgttgaaattctaagcccagtgtgatggtatttggagatgaggcctttgggaggggattaggtcatgagggtggaaccttcatgaatgagattagcacccttataaaagaggcctcagagagcttctttgcccctttcaccatgtgaggttatagtgaaaaaatggcggtctatgagccaggaaatgagttctcaccagacattgaatctgttcttcatagacaacttgccagacatggttctactgcataaaatgggtccctcccatagtgaaatgtcagaaattgaggcacaggcattccagtgcctcgcagaagggccagggaattggccttgaagcagtgaacttctcagacctgttttccttgcagatgatgcaagtttgagatccttgctgaggactatctagaagaattaggaaagcaagcacagttctgattatttctagatcagaaaccaagagtgagggcaataggaaatgttacagcttgaagtgagtgggcggaaagttagagggtttgtgtttcacactgacctccgtccttctgagtgacacattttctttagacatgctaatagaattttctcttgtgcaagaaaaagttaataaacagtcataacaacaacaaaaacactgcactgggttgggatttttagaaaattgactgagaagtcattttatatatataaaaaatctaccgcggagtaaaggaacagttggatgatgattgtaatgtatataactgaaaagtaaactatcaagtttattatctttggaagaatccttctattctacttgtaaattaggggcttaatgaacaatgaatacaatataaaggaaagaaaaatgtattcacgttgaaacaatttattttcttttgctttcaatcttgctgacaagcattagatatcttggttgaagaaaaactcttctgctctctcacttaaatgctcctttttcttaactctttaatatcacagagttagaaaaggtacttttatttcaaagttctttgggttctcttctgtgctcaatgtttgttacctccatgatattaaagatgcatcaggctctagtgaagttgactagaacttttcagaaaactttttcctgtctgtatccattccaccatcagggcaggatagtgagtgcttaagagaaaacagtggtattcccaggaggtcaggtagaaagactgcaaagcacagctgttccaacccccaacacggtggagaaaacggccaaagtcacagatgctgtaaaaagtgatactgaagagctcaagctttggaattagcactgggttagaatatttcaatgttttaacttcttactctatataaaggagataatgtgagtacttttatgactaatacaaaggttattgtgatgaatagatgagaaaatgcacatataatgccttgctgttgtatctacctccaaaatgcccaccgactcattccctctttgtcaattgggaattgaatcagggctggcttgtgactgcttagcccagtagaattagggagaagcggctttgccaatgatgggactaatttttaagaggactggaagtttctgcatcctttctcttggtacactctcatttgagatgcttcctcagagccagacaccatgctgtaagaagcccaaacagtggtgtgctgaaaaatatttaaaaaccagctctacccaaagaaggtgctgatttgtagcttttgccagttttcatgatataataccctctcctccatggctgaatacaaattacaatgtaacgtatagtgactgaactataaacttggtaaaagatgcatgcacagatatattagatatgtaaataatcacaaaagcacagattagtaaaatgtagcaaaataattagaaagtgaagaggtttcagtatcattttaaaatataatttatgcaattgtaagtttatataatttaatttttaataatggccgtgtttaacaactcgttcacagaattcctgaaaatttaacaattggttctcaccagctggtaaaagttggctccagcacatcacaagccagacccagcacactactgagcccacaccactgggggagtccatgtgtagggagtacagccaacagcttcaactgaccagtcagcatcaattgcctgccatgtgagtgagccctcttggacatccagcccagattagccttctgatgtattcagcctcagctgctatctgacttgaagtgtatgagacaatccaagtgagaacactcaactgagcctagttaacacacagaaccatgaaggataataatacattgttgctttaagccagtaagttttagggtgatttgttatgcagcaatagataacctggaacactggctcatagaaattgctcagtaaatagcagatattattattttgaatgttgcaattactggcagattaactgtaacagtatttcaaggaatgaggatcaatttattctgcaacaaataaaggagaagtccctttattacttttgcttgaggaccaggaatttttacacgatgagtgtaatttagcttgaattttccttaaaaactatacaactccagagaaaaagtctataattactttccacaatatagtctcccattggcctgctgtttactttcattctgccacagcagggactacgtgaaagtgaaattgcaccactgaagcccaaagaatcatgactaggcagctcttgttattccattttaaacaaagtctgagcgatttaataagagcagtagaaaggtccgtgaatgagctcactatctttttctatcctgcctagtcttaatattttctcagcttcttttagttaccagaagatagatgttaactgggacaaaatgttaatcgagaaacaactacaaccttgtttaatctcctgtcctcctcccatctcctcagggagaactctgtctttgctagttcagttcctatgtgagccattgttggacaaattggggtaatggttggggaggaattgagaggatctcagttatggttgcttaatttacattgatgagaacagaaagttgtttgcaggaaaaaaaaagagaataaagaaagaaaacaaagaggaaaaggagaaagcaaaaagtagcctgtgtaggcttttgaaggtgttaagttgtggggagcttggggtaggagaaagatttgaggagatgctgataactagggaggtcattgaaagagaggtagtaagagaaatacagacagagagagaggggatgaattttatgctgaattattttgttttctgaaacagagttgactatttgtagtataacctgggttaagtgtgttatgagtgttagctctctctggaatttttcttaacaaatggtattttttattattttcctttatattttggttattggacttgaatgtgagtgctttaagctagcaagacaccacaagaaagctcagctttatatgtgttatattcaactaaaatagaatttgtgctgtattcgtttaacaaagctcttcactttaaaagtgagtcatgattcaaacaaaacaactatttagaagaagcatttatgagataagaacttttgggcactgacaggatatttgatgattttgaatattattgctaatttttaaatttaatttgttattgtggtcgtgacatgtaaaaatcatttattttagagatacatactaaagtatttatggataaaatgatatcatattcaggactcactttgaaataatatggggttggggaaaaggtgagtggaagtgtagagaaaatgcgattatccattcattgacacttgttgaagttgggttattcatgaggaacatggagattcattatacaattctttctacttttgtgtatgcttgcaaatttccataataaaaagtgaagaaaaaagtgggcgagttaatatccattgttcttactctctggaaaatctaaattaactgctttttattatgacgtagtccatatttgctttttttttcctgtggtttgatggttcttgacaggaaaatgtaaccatcacccttaattatgaaaacatagactgagtgtttgctgatatttgagtataaggtgggatctacttaacacaatccaatactcaaaagtctcaatttaattagaatcaaatttcaagataattcttcagggacaaaacgatttccctggtgcatttgaaaaaggatttaatgaatgaaaactttttatgaataaaaacttgacttatgttctactttctgggactacacctattgtagaaacaaagggccaatattttccttctgtaaacacattaccttggtaggtgttctcatctcaccctctttactctttaaagggaaagaagcacaccagaatggcagaagactaagtcatgcagcttttatgtctcaactttctttccccagagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgagtaagtactaatactttggtgaaagacattatttttaaaaaatttaaaatgcagacggccctctgtatctgtgcattctgcatttgtcaattcaaacaaccatagattgaaaatatccttaaaaaaatcttgcgtcgatactgaacaagtacagaattttttctcattattcctaaacaatacagcataacaaggatttacatagcatttacattgtattaggcattataagtaatctagagatgatttaaaatatacattgatgttcataggctatacaaaaatacgaccctattttatatcaggaacttgagcatccgtggatttttgtattcatgggagtcctggaacaagatccctcaaggatacgaacggacgactgtatatattatcaatttcttggcatatagacatcataaattttaaaagtcaggtagttacacattgaaagctcagttagtacaatgcaatggggtcactttactagaatgttcattgtgaaaggatgtattcaaattcgaattgaatcttagtgatagcaagctttcaagtacacagttaccccaaaccaaacccccagtctattcccccaacttttgtgttccctcagtgttcttaatgtctataaaatgtatccaaccagtgctaaagtggaaaactcgagaacagtactagttaactccttctaactcacagccaattaataactaactcttgtatgcggcactgtacatccatttttaaaatcccttaaatattttggtggaattcttttacttctctccatctccaccactaccatcctattcctagccccatttctctcaccagactgtctacaataacctcctaaatggtctctctgcctccgttcttgaccctctatgggtcatcttctacatagcacccggagtaatcttttaatgtatatatcaggtcatgtccttactttgcttttaaaaccactcagtggctttccattacacgtagaataaaatccaaatgtcttataaagtcctacgaggccctgcagggtctggcttacatgtaacaatttcattaattttcacgacaatctttagagatgagtgtaatattacttttgactttcaggtgaggaaactgaagctaagtgagattactttatttgcccacacagttagaaattagagaagctaagatttaggtgtcaacttgtctgattccaaagccagtgctcttatttaataattcctaaatgatataaagatagtgattaaaactcaaagaaaagtcttgcaataaggaaatcttgcaaggaggatgggttttacttttaaaaggtaggatgctcttctccatctgtggtttcttgcagaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgaggtgagtgcagctcagggaactgagagccaatcagccaagcactgtttcaggtcttcattcatttactccttgggagagagagggcactccgttatggttttaaggggaccttatggaaatacagacatcccagggaagattcgtatataatctttagtaggctaacgtcttggttggaatggtgtctgggaattgtgcaatgataccacctttggccctgtgaccccaaattatctcaaatgtcagtttattattggccaccatttaaggaacacattatatgttggacattgtgctactgcctcctttgtacagataaggaaacagagaagtaatttgcccaagaacacatagcctaatgactaagccaggattgaaacctatgtctgtctggctttaaagcctgggccctttccaccatatcataccaccttagcctttggcatgttataggctgccaaccctactcaaaacaatttcagaggttagattttttttacaattaaaaagtaataaaatgtacatataagaaaatgcacaaatcctaagtatacaccctctgaattttgacaaatgcatacatctatgtaatccaaacccctattaagatatagaatgttggccaggtgcagtgccacacctgtaatcccagcactttgggaggtcaaggtgggaggatcacttgaactcaggagtttgagaccagcctgggcaatatagtgaaaccccatctccacaaaaaaattaaaaaattagccaggcatggtagtgtgtgcctgtggtccagctacatgagaggcttaggcgggaggattgcttgagaccagaagatcaaggatgcagtgagccctgactgcaccactgcattccagcctaggcaacagagcaagattctgtatttttaaaaagatatagaatattactatcacctctgaaagcccccttgtgccctttccaagtgaagctctgaaactactacctgcagtggcaatcactgttcttatatttttctgcgatagtttttcctgttctacaacattatataaatgaaatcttataatatgtactgttttatataaggcttctttcatgtagcataatttttttttttagtcatccttttgtttcagtagtttgttcctcctttttattgctgaataatattccaacgactgggtacacaacagattccttgtctgttctcctcttgatggacatttggattgtttccagtttggctattatgaataatcctgctatgaacctttgtgtataagtctttatgtgatcatattatttctatgtcttggataaatacctaggaatggaattgctggctcataggtacatgtttattatttatttatttattatttattttttgagatggagtctcactctgctgcccaggctggagtgcagtggcactatatctccccaccgcaacctctgcctcccagattcaagcgattctcctgcctcagcctcccatatagctgggattacagccactcaccaccatatccagctaatttttgtatttttagtagagacggggtttagccatgttggccaggccggtctcaaactcttggcctcaagttatccacccacctcggccttccaaaatgctgggattacaggtgtgagctacctcacccggcctgtaggtatatgtttaaatgtattagaaactgtcatagtgttttctagagtggtaaatgatgtggagtaatttttcatgttcatatttgttatttgtatgtctttggtgaaatatctgttaaaatcttttgcccatttttaaatggggtagttttctttctttattgcaatagtttttgggatacatgtggtttggggttacatggataatttgtttagtagtgatttctgagattttagtgtactcgtcacctgagcagtatacactctgtccccaatatgtagtcttttatccttcaccccccccaccactctttcccttgagtccccaaagtccattacatcattcttatgcctttgtgtccccatagtctagctcctacttataagtgagaatatatgatatttggttttccattcctgagttacttcacttagaataacagcctctagttccatccaagttactgcaaaagacatgatttcattcctttttatggctgagtagtattccatggtgtatatataccacattttctttatctacttgtttggttgatggacacttaggttggttccatatctttgcaactgtgaattgtgctgctttaaacatgtgtgtgcatgtgcctttttcatataatgacttcttttcctttgaatagatacccagtagtgggattgctagatggaatggtagttctcagtttagttctttaagggatctccatactgttttccacagtggttgtattaatttacattcccaccagctgtataaaagtgtttccttttcaccacatccatgccaacatctattgttttttgactttttaattatggccattcttgcaggagtaaggtggtatctcatggtggttttaatttgcatttccctgatggttagtgatattgagcattttttcatatgtttgttgggtgtttgtatatcttcttttgagaattgtctacgcatgtcctttgcccactttttgataggatcctttgattttttcttgctgatttgtttgaattccttgtagattctggatgctagtcctttgttggatgcatagtttgcaaatgttttctcccactctttggattgcctgttgactctgctgattatttcttttgttgtgcagaagctttttagtttaatttgatcccatttatttgtttctgtttgtgcatttgcttttggggtcttagtcatgaattctttgcctaggccaatgttcagaagagttttttccaatgttatcttctagaatttttatggtttcaggtcttatatctaagactcttacatttaagactttgatccatcttgcgttaatttttgtataatgcgagggatggggatccagtttcatttttctccgtgtggcttaccaattatcccagcaccatttgtggaacagggtgtcccttctccactttatgttttcacttgctttgtcaaagatagttggctgtaagtatttggctttatttctgggttttctattctgttctattggtctacatacctatttttataccaataccatgctgttttggtaactatagccttgcagtataatttgaagttgggtaatatgatgcctccagatttgttctttttgctttgaattgctttggctatgtggacttttttgattccatatgaattttagaatttttttctagttctgtaagaatgatgatattttggtgggaattgcattatctatagattgcttttggcagtatggccattttcacagtattgattctttccatcatgagcaagggatgtgtttccatttgtttgtgtcatctatgatttctttcaacagtgtttcgtagttttccttgtagagatctttcacctccttgattaagtatattcctgggtattgtattgtattgtattgtattgtattgtattgtattgtattgtattgtattgtattgtattgtattgtattttgcagctgttgtaaaaagattgagttttttatttgattcacagcttggtcgctgttggtgtatagcagtgctgctgatttgtgtacattgattttgtaacctgagactttactgaattcgtttatcagatgtaggagctttttgaatgagtcgttatggttttctaggtatacgttcacatcattggtgaacagcaacagcttgacttcctgtttccaatttggatgccctttatttcttactcatgtctgattgctatgactaggacttccagtactatgttgaacagaaatggtaaaagtgggcatcccttttattattgagttgtaagtgttctttacacattctggatacaaacaatttatcagatgtatgttttgaaaatgttttccgtatgacttgcctatctattttctcaataatgtctttcaatgagcagtttttcactttcttgttttctttccttttttttttttttttttttttttgttgttgttgttgttgtttgagagtgggtctcgctctttcacccagactgaaatgctgtggcttgaacacagatcactgcagccttgacctcctgggctcaagcaatcctcctgcctcaacctcacatgtagctgtggccacaggcacgcaccaccatgcctgactgattttttaattttttgtagagatggggctctcactttgttgcccagactgatctcgaactcctgggctcaggcaatcctcccaccttggcctaccaaagtgctgggattacaggcgtgtgccattgtgctcaccaaaagttttaaattttcgtgaagtctaatttatagttctgttttcttttatgaataaccatatatgacttgtctatgatacctttgtctatcaggaagccatgaagacattctcttatgcttttctttaaaagctttatgattttagcttttatgtttagaactcaattaattgatttatgtattgcatgaggtaggagttgaggatcattttgttttacgtggatatccagtatttccagcatcatttgttgaaaagacttttccttccccattggcttgctttggtacctttgacaaaaagtcaaattttgtataaatgtaaggctatttctggactttcctatactgtttttttttttttttaaactcgtatgttattaccaggtcgtcttggttcctgaagtgttgaagtcaggtaatatgaatacttcaacattgttgcttttcaagattgctttggttattctaagccttttgcatgtccatataaattttcaaatctgctgatcaatttgtataaaaaacttgctgagattacgatttggattgagttgaagttattggtcaattttgggagaatttatttcttagtaatattgagtcttctaatctaggaacatttatttagttctatttacatttctctgagcaatgttttgtagtttaggtggggagatattgcatgtcttttgataaatttattcctaagtattttgatttttgatactgttgaaaatggaatagttttaaaactagatattccaattatttgctgctagtatatgaaatgcaattgattatatatgaaatattatttatattatatgctatatatatacacattttgtttcttatgcacttgctaaattcacttattgcttctagtaattgttttagagattccttagaactttccatgtaagccaacatcatgtgacaatagagagttttatgtattctttactgatctttattccttttatttctttttgggggcctattctgatgtttaatacttccaataaaatgttgaatagaagtggttgaagtgggcatccttgtcttatttttaatattaggagaaaagtattcactgtttttccattactgtgatgttacccatttttgttttgtttttttaaaagatgttctttatttgattgaggtagttaccttctattcttggtttcctgaaaagatttatcacaaattgttgttgaattttgtcaaaacctttttctgtatctctcgaagtaatcttttggctttcctctttatcctcttaatatggtaaattatattgattttaaaatattaagccaatcttgaattcctagaaaaaaccctactggtcatcatgcatcatcatgtttatgtattgctattttctaagtgcttatgttttgtgaagtatttttgcccttacattcatgaagagtattggtctgaaattttcttttttttgtgatttctttgtcaggctttagaaagattttggcaacattctaaaagtgagttgggaaacggtccctcttctactttcagaaagagtttgtgtaacattgctgtcatttcattaaatgcttgatagggttcactaggaaaccctctgggtctgaaatttctttgtgggaagttttttgatatcaaactagatttatttagtggatagagagccattcagattttctgattcatcttgtgtcagtttttggatagttgtatttttctaagagtttatttcatctaacttgtcaagcttattggcaataatttataatattttcctatttttttaacatctgtaggatttatagcaggagtcagcaaagtttctgtaaagggcagataataaatattttaggctttgcaacccacaggtggtctctgtctgctgaatgttcttatatgtttgtttttgttctgctctccgttcctcttgccccctgccctctcctccccttctttctcttctctcttctccttccctcctttctcctgtcttctccttccctctcttctcctctcctctccctccctctcttctcctctcctttccagccctctctattcttctcctcttcttcccttgctgtcctctgttttcctttcctctcttattctctcctctccctctgcttctttctttgtgcaaccgtttaaaaatgaaatgtatgttgtgcaactctcaccaccatatgtctgcagaacgttgttcatcttcccaaagctactggggaggtcagcctcctcagtagctgacccgttgaataacaagtccccattcgtccctttcctagcccttgacaaccacaattcttccgatccctgtgattttgactactctaggtacctcatgtaaatggaataataccatatttgtcctttgtgactggcttttttcactttgcaaaatgtcttcagggttcatctatgttgtagcatgttagaatttgctaattttttagggctgaataatgttccattgtatgtatttaccacactttgttcatccattcatacaggggttctttttgaagtgatggaaatgttctaaaattgattgtagtgatagttgcacaactctgaatgtggtgaaagctaatgaactgtatactttaaatgggtgaagtatatggtatgtgagtaaagtctcaataaagctgttaccaaaaaaaaaaaaaaaagccacgaaacctaaaagtgacatgtaaaatctattcttagctcagggcaacataaaaacaagccttaggaaggatttggcttgctgattcatttgtcaacctctgatttatagtaataaatcctctttcatttctgatattggtaatttctttttttgctcctttatttttgatagtatagggatttttccattttgttgatccttttaaacaacctttggccttgttaattttccctattacttgttttctactttttgatatctgattttatgtttattacttcctttcttgtacttattttggttttagttttatcttctttacatagctgctgctgctgctgctgcctcctcctcctcctcttcttcttcttcttcttcttcctcttcttcttcctcctcctcctcctcctcctcctcctcttcttcttcttcttcttcttcttcttcttcttcttcttcttcttcctcctcctcctcctcctcttcctcctcctcctcctccttcttcttctccttctccttcttcttctttttcttcttcttttaagatgaggtctctctgtcacccaggctggagtgcagtggtgtgaccgtagctcacagcagcttcgaactcctggactcaagcaatcctcccacctcagcctccccagtagctgggactacaggcacgtaccaccacacctggctaatttttagattttttatttttgtaaagacagggtctttctttgttgcccacagtggtctcgaactcctagcttcaagcaatcctcctgcctcagcctcccaaagtgctggggttacaggtgtaagctactacccctggcctgtctagcttcttaatgtggatctatatatcattcattttagacctttcttcttttctaacataatcctaaaaagctgtaaatatctttctaagcactgctttagctgtagtccacaaatttttatatgttgtattttattatgtcagttcaaaatattttatattttttttagtccgtgaattatttaggagtgtattgtttaaattacaagtatttgggggctatctaagatatcgtattattattttttcagacagggtctcactctgtcacctaggctgaagtgcagtggcacaatcacgactcactgtagcctcagcctcctgggctcagatgatcctcccacctcagcctcccgagtagctgggaccacaggtgcatgtcaccacacctcgctactttttaaaacattgtttgtaaagatgagatctctccatgctgcccaggctggtctcaaactcagcctctcaaagtgttgggattgcaggcatgagccaccccaccaagcctgagatatcttattgttattgatttcttgtttatttcattttggtcacagaatatacttagtataatttcaatccatttacatttgttgaaatttattgtattagtcagagttctctagagggacagaactagtaggatatatatgtatgtatatatatatgtatataaatacacacacacacacatatatatgagagtttattaagtattaacttacatgatcacaaggtcccacaataggctgtctgcaagcttgaggagcaaggagagccagtccgagtctcaaaattgaagaatttggagtctgatgttctaaggcaggaagcatctagcacaggagaaagatgcaggctgggaggctaagccagtctctccttttcatgtttttctgcctgctttatatttgctggaagctgattagatagatggtgtccattccaattaagggtgggtctgcctttcccagcccactgactcaaatgttaatctcctttggcaacacccccacagacacacccaggatcaatactctgtattcttcaatccaatcaagttgacactcagtattaaccatcacaagtccatcccttttcaagttgaacccatacacatttcctgagatcatacataatcttcaaataaagacaacaataaggtcataattatgcctaacataatacaactatcctttgtacaactggaaatgcacaaatccccaacacaaatactattacataaaattaacaatacttaaatgctgatatgaagtcagtaaatcctatgtcacacgataaaagaaaaaaaaataaaatgaagatttttcttagtacaagtgtatacatgcacaaacatgtttttaacaaaagaaggaggaaatattcatgacaattacagtctccgtttttgtagctggtcatgtggtcgtagctggtattgatgactacattcttctgctacccattctctattccctttgccttcagcaagcacctctgcaggtcgtggtttttttcctggtggagtgacccaagccttcatttttgaagggtctgggccatttgtagtcctgcctggattgggctgttgtagtttcccattgaccttaatcacagggcatggtaattctaagagatgccctagtggatctcctgtattccatgcataccttacctccgttgtagagtagtagactgatttcatcttgatagtccggatcaatcaccccagccaacactgtaactcccttcttagcctattgacttaaaggtaggaggaacccaaagtgtccaggtggcaatcttaacttccagtttaaggagatcgatgttgtgtctcttggtggcagcgttcctccctctggaactaagacctctaggccagcagaatgtaatgtcgtgggaacaggaagcaaaagttttgctagtggatcattaggggtgatggtgagtggtgccacttccacttccaactcttgattcctggaactgtgaatcctggctatgggaaaaaaagtaccatatattggacgctgatttagagcacttattttatatcccaatgtgtgatttattttggtgaatgtttcacatggacttcaaaaaaaatgtgcattctacagttgttggatataaatagcaattaggtcaaggtgccagcagtgttgttccaatcatctttgttctatcctagttgttctctaattgagaagggtgttaaaatctctaactttgtgcaactgtctatttctccatttagtcctttcaaattttgctttgtttattttggggctcttttattaagcacatatacatttgtgttggtttgtctttctaatactaatcctacccctaaacatatttatcattattaaatacccctctttatctctgtcttgaagttattttatctggtttgaatataaaaaaccaagtcatccaagccttcttatggttactctaaaaggtatgtatgtatattttatattcatttgcttcctagctgtctttatatttaaagtgtacctcttgtagatagcatatagtttgtgttttattttttacccatcctgataatatctgacttttaattggagcgtgtagtttttttaacatttaatgtaattatttatgtggttggatttgagctaccattttattttaatttctgtctatccctctggcttttgttcctctgttccttctttcctgttgtctcttgctttattttaatatttattatagttgctttttaattgtttactgactctttaattatatatatttgcctttctttctttctttctttctttctttctttctttctttctttctttctttctttctttcttctttcttcctttcctttcctttcctttcctttctttttggagtctccctctgtcaccgaggttggagtgcagtggcacaatctgggctcagtgcaacctctgcctctcgggttcaagcgattctcgtgcctcagcctccagagtagtggggactaaaggcatgtgccaccacgcatgggctgttgtttttttatttatttatttttttatttttagtagagacagggtttcaccatgttggtcaggctggtttcaaactcctgacctgaagtgatccaccagccttgacctcccaaagtgctgggattacaggtgtgagccaccatgcctggcctgcattgttttcttaatggttgctctagagattataatatacacttgtatatttttttacagtctacttagagttaatattgtactgcttcatgtaaaatgtagaaactttaaaccagacgtgtcaatttataccccctgttttttatgctataattgtcacacacatattttacacaagaagattataaacttcacaagacaatgttatagtcattactttaaaaagtcctatgttacttaaaaaattgagagaaaaaatggttttttacatttacctagatatgtattatttttggtgctcttcactccttcctgaaggtcagagttctatttggtatcacttcccttcagcttaaaaaaattcacttaggatttattgtagtgcaggtctgataatgataaattttctgagtttttaatttatctgaaaatgtctttattttatctttatgcttgaaggatatttttgtttgtaataggattcaggattggcaagtccttcccccagcccccagcattttaaagatgtcatttcactctcttctggcctttatgttttctgaagagaaatcagtaatcatttgagttcttgtttctctgtatataatgtgtaatttttctctggctttttaaaatattttctttgatattctgcagtttgactattatatgcctgggcattttttttttctttgtacttatcctgctaagggtttgctgagcttcttgaatatgtaaatttataccttttactgaatttggggaaattttcactgttattccttcaaatactgtttcctcaccattttctctttcctctccttttgagactccaattacttgtatgtaagatcttttgatactcccccacatatccctgagactgttcatgtttttaatcatttcactatctattcttccaaaaggatcatttatattgatctacctttaaatttgcagacatctgttgttttcatgttactattggacccatcctgtgcaattttttaaattgtacagtttttagaattcatgctaaatgaatagattttagctactcttgccacaaaaacaacaaaaaaagaggtaactatgtgagaccatggatatgttaatttgcttcactatagtaacctttttactctctatatgtatcccgtaatattatgttatataccttaaatacacacaataaaatttactttttaaaaattccaattatactcaaagtttagaatttctgttttgtttgtttctgtttctttttaaccattatttcctctctccattaattgcaaacatattatcttttaaatacctcagcatagttatactagctgctttaaaatccttgtctgctaattctaatatctggaaaatctcaaggtttaactccattgattatcttttaaaaatgggtcacattttttcttcacgtattgagtaattttggactatgtcctgggttttataaatgttatatatatgaacactctagattctactctattcttttgtagattatagatttttgtcataacaggcaattaacttggttggactatactgtagacaccaactcttgattggcagttcaaatctcagttaattcctttattcttagtggaagtatgtcctgtacatatgtggtccagaggtcaggcatatatttgggcagaatttatactcagaattttggatcccgctttccattccagatgtccaccacaacccccatcacctcccagtggctatggttgccctggcttttgtttctggttcttcattccacaaagactgcaattaaaaaaaaaatcaaagttttagatgtccttcacagcattagtttcagcctgccatcaggctacaagatgtaaaaacgggtaccccaccttgtgatgttacctttttccaagtgtttactcttctccagaaactgtctgcttttggtaattttccagtgccttcaagtcgttgttactttgtattgttgttatatgcaggagagttgagtttattaggagctacttagccatattgaaacagatgttgaattcccagtgtattttgtttacaatggggttttctatcatgaatcttggtggagagacaaaccaaacaacaccagttgtattcttggtgccaaactgcttacatattgaagctaaatcatgacctctccatggtacttgattgccctagcagagttcatttctgcttagcaaagagccatatgggttttgagactacaagtcatttttagaaatattattcacttttaacccccactatacacccagctagataatagcaacttgagaggcagcatagataattttaaaaagtgggccaaaattgcatatatctttgttcacccacatcccagttgtgtgatcctaagcaattcacttaatctttctacgccatttcctgttgccataatacaacgtacctctcagagttgatagagagattaaatgggagaatgcaggtaagtgtgtccacatattctgttttgtatgggagaatccagatttatggctgtggacttagtgtaattattaacaaagcccttttgactctcaaaaatgttccagtacttgtcaaatactattaccaatcaactcagcaaatacttctgatagtggatgtcttgttccattttgtgctgctataacagaataccacagaatggataatttctgatgaacagaaatttattggttcacagttctggtggctgggaagttgaagatcaaggggccgcctgcggtgagagccttcttgctgtgtcatccaatggcagatgtgcaaagagagggagagagagaacaaaagattgaactcacagcctcaagcccttttataattggcattaatccattcaacagggtggagccttcatgacctaaacatatcccattgtgccccagcccccattattatcacattggggattaagtttctagtacatgctttttgggggacatattcaaaccatagctgtgagcatgcagcagaattgctaagcgctaatgcctcacttccctgcttcactttttaaccaaaacattgctccataaactatgaggaaagtgcctaatatcattgtattgtgttttttattgttactttgttttttccttttaacatatggaggaaggtagcctgagttccaagactggtctttatttctgataatcagggcaaatgacctaatttgtcatttccctctcatctctattattacccaggtgaaaggagatcaaagggagagaacctcaggaataggcttagaaaggaaaagatgatgtgtgtttgtgtctatgtctgtgtgtaccaggatcatgtcttggcctgtgactgtgtgtgtgtgtgtgtgaaaagtgtatcatcgcttatggagctagttcccacctttcagtcctttgggtgatattctgaggctgagctggggtgggaggtgggcaggacttcactatgatgaatgaagactccaattttcattttttggcttttcttggcagattttcctaggcaatgtccctgtgggagggattttggcttccatatatttgcctaaatcactgacggagagaattcctcttagcaacttacaaacgatcttgtttaatttctttggccaaacttcactctttaaggtaaattcttgcctgtggtaactgtgatgaactggcatatggtgactcattgtaattatgaactcttgctattttcatgatgttctgcttattttagaatatgctgattgattccacaagtcttccaacacaacccctgccccttaacatgaatcaacgtctactttaatgatgttctacagtttttagttttcacaatatctcagctttggaaggaaacttaaggattatctggtggctaaacagaggcctcaagatgtttcaaagccaaaaaagaacagcgagttctcctgatgaaatgatgtttcggcttatcagtgctttcctcccaaatctcccctggctcctcaaagccaacatgtccactattcttggccaattcctttgaagttgggtggtatccagaaggacatttgcctgcaggcatttgttgctacttcccacagcccccacagaactttctctgaaggctgcagtcctcacccactagaaaacagaggcagcatgatgtgatgctgaagagtgtggactcaggggcaggctggttgaattaaaagctggcaatgccatattctgcctgtgtgtcctcaagcaagttactcaaccttcatgtgccttaatttccttctctgtagtatagggtaataagaattccttatagagctattgaaggattaaaggaattggtgtatttaaagtgcttacaataccgcttggcacataagtaccatgttaagtgtttgctctactattattagtatcctgtcttaggtctctgcctaacaaaagcctcattcgtttagaccactctgtctcatctagctattgggaagacagtaatcagagtttgcatgaatttgaagataatgaacactattaattgttaatatttacatttattatttcatctacttctcatgagaagctgatactcaaaaaggttaagtaatttttcccaaggccacatacctaaaaagtggcatagctaggaatcaaacccaggctatctgacttcaaagttcatgtatttaaagtcaatacaataattttcccagatgtgtttgtatttctaaagaggttatccaaagtaatgaatttctaatggtcaaatatccacatttcttttgtgggaggttgcactgggccagctcaaaatatagcacatacccataccacacgccacctcaaatataccatgtcacctccagctatgtctgtaagactttctgttcccctggagttctctagccactcctttctctctctaaattctatgtgttcctgtgggcttagctcaaatcccacccagggtggctgcctggagtaagtgagtctctgctctccttcctgcctcctgggcaaaatatttagtgggcaaaacattttaataaaaattaaaaatatgctccacaacactttgacccttttggtaggcttacaatttctctttgtcacttgagatgccattattttggtcttaatttctctcctttcttcagagggctgtgcttgtctcgtagaataagagataaacttgttttgcatagatttcacacttaataagtcatttttattcactaacactttctactggaagagattaaagatctttgccaaaattaaactgcaaacatcatagtaccagatgaagaaggattagaactagcctgcttcaaattcagagttgaaagggccctcctaactcatatcatcccatctattcattttaccattggtaaaagtaaaatggatattgaggacctcgagtctcagagaggggaaggaatctgctgaaggtgtcacaatttattcattcattcactcaatcatttattcattcagcaaatatttatttaattcctactgtgtgtcttgtacggtgctgaatgctgaggatgcaatgctgagcaagatacatagtgcctgctctcatggaacttccagtctgctggaggggaaaacagacctaaatgttctaacattaaaggggtgaccctaggctgggatctgtgccactggttattggggaaagagtacttacaaaaatgctgctctttaattctatttttcttgaatccccgagtatcacagccttgctttcgcactactttctctaatattttttgatcaaaatcttaagtcattatgacacataaccttagaaatttgtttgtttgtttgtttgtgtcttttaaagacaggatctcgctctgccacccaggctggagtgtagtggtgcaatcacagctcactgcaacctctaactcctgggttcaagagatcctcctggctcagcctcccaagtagctgggaatataggtgctcaccactgtgcctggttaattttcatatttttttgtagagatggggtctcactttgttgcccaagctggtctcaaactcctggtctcaagccatcctcctgtctctgcctcccaaagcgttaggtttacaggcatgagccaccgtgcctggtccatagaaattgttgataaggcaccactcttggataatatgtgtctcctcctccacacctcctctagctgtgattctcagggagagggacaggcactaggcggttacaatatggcacaggggctctgggtgcatagaagagggaatctaccactcatctggaagatcaggaaagtgcagtgagagaaaggtctcagcggagccctgaagttgagtaggagctcaaagatgaaatagggcaaagagaaggagagaagagagtttcagagagagggaatagcttgtctaaaagttcagaggtgtaacagataaaacttgagcctacagtgcaaagggtggaaggatgaggaagtttctattcctttcctggcatggctaccgttttgtagtaagggaaatgaaaccagagaaaaggctaattaagttttggatcatagtgtgtgtctcctcctttggccttttcactacagaaaactgcgtcacttagactaagttgggaggatcattaaataacatctagtctgccatctttcctagtgtcaccaatagaccaggaaggggtaatagggcttaggaggaacaagagagctagggttagcccttagccttttgagtgtcagcagggcccttcccattatatcttgctgttggccatctctaaatcaggttgccccaggctggttttgaatgaacagaacaggtcagaaacaggaagtaagtagagtcctagtggagccccaggctgaatttgcaactacccaggctgcagggctcaggtgtgtagggtaggtagtagggactgcacactgtttcttcagaaatatgaagccttggcatcttctaaaagtggcccagcaggatctccaaggaatgtcatctgcgttcacgtcctctaggcttttgtggggaagtcctcagagatttttcttcctctccctcttgtctggtatcaccagccctacctgtggcctcttcacatgtgcctgtgccccagaacaggcagcatctcagctgacttgcatcctggagccttggcctggggtactttggcactgttagttagcaagccccacttctcaagagatacattctagtttgttgcctttaaaccaacatttattaagcattcctgccctgtcacccactagctgagtgatctttatccatttaggcactgagccactcaagcctcagtttatctgaaaaatgcttatatggcttcaatgaggactgcaaatggcatgtgcatgaaaagcacataataagtggctcactgtgggcacaagacacctgctgtgtcctaggatatgtgaggaacaccaggctatacaatgcctgggctctggcctcagagctcacagtcccctaagaaggcgatgactgtcctctgaaatttgtttcaaactgggtgttgatcaacctgcttccatctctgtcagaatagaacaagaagtggtttataacttacaaatgatagatttaggtttcttatagaggagctccctaaaagtaagcaaggatggttgagagttagaactgggataagttgtgaaatgtcaaggtccagaaagttaccaaaatagagaatagtttcattttgttgctagtgcagtactgagtagcaggtgcaaaacaaatgcgtgctaaatacacatttggttggatggatggatggattaatgaattgttctagcttggtataatggagaccttatgtgaagacaggagatgagctgaataacctttgaccttagcttgcaattttattttccacatttctgtacctaacattgtgtgtagcacttcaaaattccagattgattattaatatgtaagtaattagaaatttaggtcctgaactcctcttttgtttcatctgcagaccaaaaatgtcactaaagcattaaccacctatgttgtgagtgccagcatttcagatgatatgttcattcaaaacttagctgacccagtggttatcactctgcagcatattggaggaaaccaggtaatatatctattttcagctcagaatcaaatggcctcaggaactcttcacgacttttctgttaaaagtaatttgttaattaacagatgtgattctaacacttaatgaggaatgtcctattccaggtagcaaatgtgtgttataattggaaccttccagaaataatgccttatcctaaagtgatagggaatgatgggcattctagcactgtgacagattggtggggcagtgactggatcttttggatgtcccatcacactaaatgacatgtgattccatttatttttgagcgagacaagcaacttcactcaaaataattgaatatttgtattacttgaatttccagaaataacattaaaacgtgtatgaattatcaccaaagaactaaaagcatagtcatatggcataacataagctatatattactaaataatcaactttagcctaagtacaagtatgaatgactattccattatttgacgttagtgtatggccagtgtgacgtctcaatagatttctcagttcccagtctaaaagaccatatagttcagcatacttttcactggtcttgattctagaagggaagaagagaaggaagagagggagaggaaatttaaagaaacaaataccaaatgaaacgtgttagataggtaagatctctcaatttggtctgggctacagcacttcaattatccccggtaactaattgctccttgcctgcagtttcctggagactacaggagctggtgaagtcttaggaatgttctgtaggcctaatgatggggcagatcaaatttctgtccataaggcttgatctcagcggtgagccccgaattccaaagctccagaaggaacacatcagccctgcattgactatccatagccttgtaccagaagggcatggcaatttttaatactaccaaatattttaaaggacatatcagatcaccagccggtgacatgctgttttctcacttgtaaatccagagttagatggtggagttagtctaaaagccaattcacaaatggcccaaatgtgtatgtgtatgtgtgtgtgcatgtcagtgtgtgcatgtttaccatgggaaaaaatattgggaagaaaacacttatgtgtatatgttactatatggtaaatatcacaaggcaagatgtttacctctgatttctttttttccagaattatggtcaagttcactgtgccttttgggattttgagaataatagtaagtatttttgttagcaactttgactttgccccagaccattttcccacttggcagttaaatgggagggggttgtgctgaaactactgtcttatcagaccctacagagcattctgaatgaccaagatacaggatatgatttttatatcaaattagggcatgggaattaagacaactttcctttttgataggtaagatctctcaattggtgctggggctacagtgctccaatcatgcccaataactaattgctccttacctgcagtttcctgaagattataggagcttattacaagtatcttaggccccaaaaataattatttggaaaatcagaaaaattacacaactcgagggtaagcaaagttggaagaaagaaatttggaaggcccagcgcagagtagccttgaactgtttgaagaaagttgaggaaggaatacctggttctttatctgtgctctcccacagggttttgcaagatctatgatctccttccctttttttttcctcacctcttttagactgactgtgtgaccttgggtagacaatttaccccctctgagccccagtctttttatcttttcattgaggagatgaaacttcttggttggtctctaaggaccctacttgcttgaataagcatgagtctttggagacagacagtagaagactgggaatggtcattgctgactgggttgctcttagcattgccatcttcactggaaatatccagggttatcaccaaatctcagagaatttccacacagaataaatttccctaagaacgccaggagtggctaagtgaggagtccttctgcctgtggaaactctgcctggaacctttccctttttcactatccttggaattctgggacaaaatggaaattctcttcccattcggctccctagagtataagaatactacttctttctgacaaacaaaaataacactgccctttcctgatcccctccaagtctctcaggataaaactctataaagcgatgagctttgtcccctacaacctcaatatgttgatctctatgttcattaacgcaaattgctggggtactcccaggtcaccctttgcccctgcacctctgccccgtggatctagaacctctggaatctatggcattatcccagatggacaaatgttgaccaaacttagctgcctgcccggggataacccctttggtctagtgccacttgggaagttctagtctcaaatctgatctagtacctgagatctacaggttgtggaggtatgagtgttagttctaaacctgagtgtgctcagaagaaactagccagatgtctagtagagcagaggctctaattggccctgcagagctccagaccatgatctgactttgattgaaagcacttgagaccctttgaattgcgggttcagctgggtgttcagatgtctattccagtccctctgagtaagctcaagtaccagcttatattccatacgtccatgtccttaaaaatattctagatctgcttgcttcctatttattggctacttaaaaaaaagttcatggttagagtctgtcctaatttgtagaggtatggtacaagaacaggaaaagggagagccgaagaagttgtgccatttacgaagtccccaaaaagtcaatttagtctgttagacttaatttaatttcagtgttcaattatacccctaatcttgctatctcagcaaataatattaattataacacacgtttggatagtgaatataatgaaaagttaaacatttctgagaaaaacaaaattgctttgaaatttccttctgtctcctacagatgggctgggtggatggaattcgtcaggctgtaaagtaaaggaaacaaatgtaaattacacaatctgtcagtgtgaccacctcacccattttggagtcttaatggtgagttgtctcttagtcactcctcgatggaagtttgacaatttttattagaccagtaatatatgtgtgaactgttattaaaaaatggtatgcatttggaaaaaaatcccccttccaatttgttcatccaaagtagatcagattgagacaaatatttatttatttattctccttataaaattaatgcttgcttctcaaatttcaaacagtacagaaaaggtccctttaacctccctcccaagtgatcaccacctttaacaggctaacatgtatattcatttaggttcttttcctgtgtatataggaatgtacatttttgttttataaacatggtatcaaattattcatactgtttttaccgattgcttttctcatttaacaatatatattgcacaactttcaggcaaatgtgtatgtatctattatacttcaatttttaaaatacctttatagtataccattgcttgggtttaacacaataaatttaactaatccctgactagtggacattatagctgttgctgtttttctcattataaatattgctgtaatacacattcttactcatgtatcttcaaacattggtgtaagtatttttgcaggataagttgacagaagtagaattgctggattaaagggtctggtcattaaaatatttaaatttaagaaggatcataagtatttgctgagtttttcttccaaatgactctcaaatgtattcctttttctctacccgcatcagaatactttcctggatttcttaggtaactttattacatactgttatctgaatgtgtcatatgttacttattcctacaaagaatggttagctttttgagggctgtgggtctgttttatatttatttattttacatatatatatatatatatatgtatgtatatatatatattttttttttgagatggagtcttgctctgtcacccaggctggagtgcagtggttctatcttggctcactgcaagctccgcctccctggcagaggtgggaagaatcacctgagtccagggaggttgaggctgcagtaggccgtggtcaggccactgcactccagcctgggcaaaagagtgagaacctgtcccaaaaaaaaaaaaaaaaagagagagagagagagagaccagggttcttgttccagctctgtctgtaactaactatgtgatcttggtaaggttgtttccctcttttggatcttagattttcttctgaaatgtgaatgactggaatacaccagggtttctcaatcttggcactatagatattctggccaaatagttctgtctttttttttttttttcttaacggagtcttgctctgtcaccaggctggagtgcagtggtgcaatctcgggtcactgcaacttctacctcctggtttcaagtgatactcctgcctcagcctccccagtagctgggattacaggtgcccaccaccacacccagctaacttttgtattttttaagtagggacggggtttcaccattttggccaggatggtctcaatctcctgacctcgtgatctgtccacctcagcctcccaaggtgctgagattacaggcatgagccaccccgcccggccccaaataattctttgtcgtgggggattgttctgtgcattgtgagaagtttagcagcatccttggtctttccccactagatgccagtagcactctccccagttgtgacaaccaaaaatgtctccagatactgccaaatgtccctgggagaggggtaacatcactcctggttgagaactaccaaagtaaacactgcttcttaacctttgatgagtcatgaatctctaatcatctgatgaaagctatggactttgttcttagaccagtgcacacatatattcaaataattttacatgtcatttcagatctttaatagtaattaataaatcactgaactttgtgatctctaaggtccattttgtttgttaattttgtgaaggctatttaaggactaaggaaaaggacttttttttttttttttttttttttgctgttctgtgtagtgttttgagatgctcagttcagataattattcactttgcatcccaaattcacatctctcagcttggttatattttaaatgtagaacatgttaatgatgatgaagccaaggaccaaatgttcttccaatgctattgatggctccccatgccctgtacacagtcagttggactaggcatactcagcaaacaatatttggtcttaccatacatccattcacataatctggttttagaagagctatggcagaaatgttatacatcctgggaacttcctgttagtgaacactggaagcattttgccataaacttgctctggtgtatgtgtaaaacacaacacattgtgttccttaggatttatccaggtctacagtggattcagtgaatgaacagatattagcgcttataacatacaccggatgtggaatctcctccatttttctgggagttgcagtggtgacatacatagcttttcagtaagttgatacagccttgctctgagcacatttaatttggtttgatggatgctattaccattgtaactttgttaatttcatgaacacatcacaataggaagaagtcagatccattagcttatgaagtggacaggttaaaaacaaaacatcaaggcttctctaaaaatattttaattggatttttgtaaaacaagggagttgggataggaaaagatttctctataggatataagagcaccaaccctaaaagaaaatttgataaagtggactttattaagaacttctttaatcaaaagacacaattcagatagtgaaaggcaaaccttacatagagagaagatattcacaatgcatatatcagataaaagacttgtatgcagaatgtataaataactccacaaatcaaaaagcaaaagacaataaagtttataaatggacaaaagacttgaacaggcacctcacaaaagagaatatccatgcctaagcctaacccttaccaaatggccaataagcatatgacaaagttctttacatcattactcatcagagaaatcctaattacaaccacagttatgtacttctctgcacccaccagaatggctaaaattaaaaataatgacaatagcaagtgtcaacaagcatgtggaacaactggaactcatacatttgctagtgggaatgtaaaatggttcagacactttggaaaattattcggcaatacctgttaaatataaatatacatctcgctgttggcccaggaatttcactcttagatatatactcaagacaaatgagcacatatgtccactgaaagatatgtacaataatatttatagcagcttcagtcacagtagcttcaaattagaaacaaccccaatttacattaacagttgattagatgaataaattgtgatatatttgtaaaatggaatgctacacagcagtaaaaaatgaattacttctatgcaatgcaacataatatttaaatctcatagacatagaattgagcaaaggaagccagaaaaataagacaacgtactgtgtggttccatttacaaaaagttccaaacacaggtgaaatctatggggatagaagtgagagtattggttacctctggtgggtgatattgaatgggagaagcatgaaggagccttctgggatgttgaaactattctacctcttgatctgtgtcgaagttccacaggtatatacatatgtaaagatccatcaagttatattgttaacacttgtgcactttaatatttatctcagaaaaaaattcacacaaaatgaaaacagcaaaatttaaatcaataaatatttaataacagcgtaaaataatcaaagggggtaatactttttttattttgaaaaatactgggtgagtttctgcaaagtaaagttgcaatcacttaataaaacttaagaccatatttccatgaggccatatatcgggatctttagaactatccaagtagctctacttggaatggtttccacagtcatcctgctatttggtaatatgtagctccagcctgctgaagcagtggtgatagactcatagtacccaggaaactccttccttctttctaaaagataaaaagaaaaataatagcctctctcaactgcgtagttgagagagactattattatttctgttagttaaggtcactatatttattatgcttcgactttacctggaaagagaatgagggacttcaaagtataagcaaagatgagtaattcttttattctttcacttattatgtagataagatgtggcgatgtttaattaaaaaaaaaaaaacagactttacctaacaacattgtactttctcttttagcaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggtaagtatatctgccattgtttttgatatttatgtcttaagtctgtctttctaattctagctctgttagattctgttaatatcataggtaaaaaattaaggatcgccttgctggtgtttgggcatgcatcttttttttctgcctgtattgctctataaattcaatttttaacctttatggtgaggagctggtgcacaaatatttattgagcacttattgtgtattgtgctaagtgctggctctatagtagtgaacagattttatcccttcctttacagaagttacagtcacaacaaatactgataaaacagctaacacttaggtagcacttacatgtgccagatgctattctaagtgctttatatatgcatttaatcctcataatatctccacgggatagattccatcattattcccatttaatagatgaggagactgaggcacacagaaagatgaggtaatttgccaaaactcacacagctagtaggcaagagagctgggatttgagccaggaagtttgtctccatagtttggacttctaacctctatggtcttgccatattgtttaaagaacaggaaaagacttgaaatgggtgaaagagtgctgggtcagccagaacctgattctcatcacacctcatgactgtgatgatcactgctggccttggaagaagccaggaatggttctcagcatagatctttctgaatacaaatgtcatttcattggcttgctttcctgtatttctaactgacatggtcagctcggctcctttcctctctctcccttgtgtattcaaggcagattttgggttcagaaaatgtgttagatgtgtaggagatgtatattaagtagcataccttgggtacataggaacacagattttatcttccactgcctttgtgaagacaatactctcctgattagctactcatccctttaatgagttcattaacatagtacatgctttcactggatacacagtcagtgctattatctatgttaatatggggagcagagacaggcaaatactgaacagatcataatctaaaagcttgttttagtacacttcggaatccatcggaagcacagagacaaaagcagtcgatacactccccttagtgccttgtgtccctcatcttgattcaatcagaggattgaaaaatgtggaagaggcttcatgaataatccaaaaagcagataacccacacatggccaattgtgaaagggctgtaaatatcacttcatcctggctttccttctccctcatcatcactcattcccagcttcttttttaaacccttcctccaggactcacttcttatctctttgatcttctaatttcatacacatttcttgggttacaaggagaggcaggaaaggctaaagcttggtacttggaagcaggaaaactttagttacacacagaagctgagaagtctgactggctcaatcagtaaagaaagatacaataagccactcttatgttcagtttattacttacataaactgtgaaaggaagagtacctaaaagtgccatctttcacattcttgtcccccacactaaaaagaacgaccccaaaacaaagggaatggatgaccgccacgtgagttgtaggattcccagtggctgaggagctagttttgaatggaagtgatactgtttcctattctgcagccctattctaagggggcagggtacaaaggcccacacctctgcagaaccctgggagatgatgagaagctgtctcctgacagcctcctggaggagatagggaggtgagtaggagatggccccggagcacctcctcacaggcctcccaccttctcaaatttgtggaggcctgcacaccgcccaaattcagataagcctttacctgtgtggtctatgtggatacatgcacggtcaccagggagccacagctgagctgtcccactacagggagttttggagcatttcaatattagacaaaagcaatcaactgtaaggaaaataggtattaatatctgtttatgtttgatgctctgccttatgaatgccaaagcaacctgttggaaaggtttattacttttaatgacaaaaaccacaattacttttgcaccaacttaatgaacccctgtccaagacagtagatttgtttatatttttaaaataacaacagaagggatcttttttttttattttcaatatgtaaacacagcttgaagactgccgcacaacttccatcctaaatatgaggccttcccctgtctctcccttccagccttctattttaaaaaacatctgcagcattctaggtgctgtgcttggggtgggctatacagatttgaagtgaccatcctgtttatcacagaatgggacagtggaggatttttcaagatacttggcattctgggctttggaacagctttggaaagcatttaacaaaacccctaaaatgtatgtaggtgcatgcgcttagtctaggagaaatacaattgagagataaagaaatcatttttttttttgcaaatgtacaagaaattggatttttaaaccctgtgtctacactctcctcacgtttgaccattttgactgaactgattgctttattatagtctgactgaattgagtggttgttaaccggtcgatctagtcaaaatgtcaaactagtaacgagtgtggaaacagtttccctgtcaaaaaagcactgaaggctgcagctgattgcctgtgcccttctcctaaggtgacctagacaaaaagctattgggaacaaaggggcgatgtgaaagggagtaaaaattaggggctcatgatctaagaagaaatgcttgatgcgaacttgcattccactcaactagatacttcttttgccaagttgattttctggcacttgagctatttttaataactagtgggcgttgtattggagccattggcatgctgtctagtttagcagattggagaactccttgaaatgcttaacttggaagaattcacaaacattttgcaaacaatagtattttgatgcccgcacatctgtggcttatttaaacagtgtcttaatgtatcatcacccacagtcattgattaggttgcctccctgctacctgatgaaatgcctttgacttgctttcccactgcaggaatcccggctatcatggtggcaatcacagtcagtgtgaaaaaagatctgtatggaactctgagcccaacaactccgttgtaagtaccagcatctctgtttctctggtggtggggctctggcccagcagggtatagtaaaatgttcttggcctgggattggtcttgacccttggcttcaggaagaaatcaacctaagtccttttgccctaaacataggccacatttatgtgatggttagttgcccgggtcctctatgaccttgggcaagttaccttacctttcagttcaatttcctcttctggaaaatggggataataatgttttctcttaatgtcctgtgcaaattaaaatgatatgatgtatgaaatgtgctcagcatattgcctgttctatgctgtgtaactggcaggtattatgattacaaagctcacacatcaggtcattgcaaagagttagtggcccctacaaggaaattctgagatgatttggaaaacattttttacctttcaacaacaaaggtcttccctgaagaacgctgaacagctttcctttgtaaacggcctcggctttattgtcctcttgtttcttttcatttttttccttttctcccatttgatgtataagttcatctctttagttctctcaaccacaatcacgcgagagtagcaattcacttcaccccacctctccagaaccttcttttacaggcatgtagatagttgccctgtggtcctttaggctgcacaatctcattttacacttctgattgttccattctttttatcattgcctctcaagttctcttccactatagatttcctctcccactggactggaattaaatgtagaaggtcctgctctaagactcccccatctttcatactgagatgacagtttccatggggtcaaaattattttgccctttgcagcagatgctttctaattaaaattccttgttatgttttctttctcttccattttctcttcccttccttctcatctccccctccatcctccccctttgcccgttttgtgacttaaaaagtccccagtgtctacctaatggtgacccttcttgaaccatcaaaagcaagagcaaaagcaaaatcagaacaaaatcaactccactttttcccaaaagagatttttcagatgtgacttggttagtaagaggccgactgctctaatagttttttttcaaattatattttgaagaagtaattcatgcacatggaacaaaatccaaacgtacaacagggtagaggatgaaaagtaagccccgcttccaacccctagctacccagtttccctcctgaggtaactcttattaccaatttattaccaacgatcaaatttgtatggatattctcttgcacactttgttacccaagtggtagatatacaccatttagcaccttggtctttccacttaacaatatatcttggaggtgattctctacccaaacatataacactatctcattttaacagttttctgtggcgtcttttaaggatgctgatgacattcagggaactctaggtgtcagaatctattaggaaaattaaatgtttttttaacatgtttgcaacacacacacacacaaactcacacatatgtgtaagtatccacgccaacataaacgacatgaccaaaagagattttcctggttttagaaaagagagctcagctaagttgacacacagttaaattagtcaagcttctctgtgttcaaaaatcagggaaaatgcctccagtaattgcaaatgttattaaatggactatctgttcatatgaatcactgcatattttttctttaataaaaaccgtagagttgttaatcaatccagtaaccagtgttgcctttgtcatccaaatacatcatattttaaagcagtacacctagagttctctttttgtagcattttcattaactttcataatttcaccattgtttgatgtagctttcagaaaatccattcattgctcacatcctttcactgtgatatttatcatgtaaagtagaattaatcctgcaaataagagcttaggtgtaaggtggtggcgggggggcagggcgtgcgggggcggtgtggggagcacggcgacagagagccactttgggggaaaatgtatcattcgtttttctgctgttaacgaagagaaccatttcctagggaattggactgacaggtttctgcatatgtagggcagaaacatcctctaggatttctgacttagtgttggaaagaaccctgaactggggctcaggagattgaggtttttgtcccagctctgcctccagttggtatgagtgaactctgtccagttcatttctctagggcagatgcccttagggtgaaataaaattgactagatgatcttcagtctctgagaaataggactttatgtttccctatctcatgatagtcttctttgtttcttacagttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggtaactggtgcttttttgccttttctgtggccagctacacatgcagcaaagcttttgttgctttggaaaataatcacctgttggaaacattaactagatgttagtcttcattaaatgcacccacagcccactctctcttgctcagtggtatagggagaagcccagataggtaacccaactttaggtaattggaaatgtctatatcaaacactgattggcaatacttcttatagtgttcattgtatcaacacattgtgctagaaaatgtacagattcacactcacgttgactttttgaggtacacaatccagctaaacatagcaattaactggaaagcaaaaacattaaagttttgaccccataggctctatctgcatctgatatcctaatattttgggaaagagccaggctagactatcatagaatcatacaggaatgaaggttaaaatcaaagggctgtgggaaaggccaaggttgtagccttgagtttgctgtaaaacaacctttaaaaagttacaataattggttgaattagatgatcctaagctaaaggccctagagctcttttaattattttcctttattccgatgaaatgaacaaataatcaatgaagtgatgaaatggtagacaaaagatggcatgagaagtaaaagctaggggccgggtgtgatggctcgtgcctggaatcccagcacttttggaggccgaggcaggcagatcacttgaggtcaggagtttgaaaccagcctggccaacatggtgaaaccccgtctctactaaaaaatataaaaattatctgggcatggtggtgtgtgcctgtagtcccagctacttgggaggctgaggcaggagaattgctcaaactctgggaggcagaggttgcagtgagctatgatcgtgccactgcactccagcctgggcaacaaagagagactctgtcaaaaaaaaaaaaaaaagctagagtctggttcatatagctctgaataattgctgacgttcatcttaacttgattttgcctattaaaaatattggggggaagaggcatgcaaaatgattttgtgtgagtctctaattctaccccatacttttatcctcaagtgtcgtccagtccatttgggctactgggacaggctgagagtcaagttggcatttcattgagttagagtctcccttcgtgctctccactatttttttttcattcaataaacccttattttccatactgaagcccactgatggtaccatgggatgctcccacaaggaaaaagttctatggtcaaataactttgggaaatgtggcaaattacattccccctttcttggaatagcactgtatacattagcatggtaaaagctctattatgaaaaaaaaaaaacctttaaaaagttgttttaatgtagtgtcttaaaaacctctgaaccttttattgtggtcattgttaatccttgaggaaccttgagaaaaataaattgacatgcagttattatatgacaggcacttgcaaagtgctgcggagttgagggggtgggaagcaatgtagcagaaggcatggtttttgcatttatgttttaggactcaagaaactatcttattttagagcaatgaggtggatcaacggaaactttttgtcccaccagatcctgccaaccatatacatccatgttctaattggaatgtaagaagtcacaaaatatgttgttcttccttcacatgccatttttattgcctctggtagtaggaatggaatttttagaaactctcaataccatcctcgcttggttccctttgaggctactggcacttggttgaattctagtgtagaactgaaggttgtattctagtgtaggactgaggccctggtgatggttctacactttttctctggatagaactgtctggcccacactacagtattctaacccgatgctctaacctcaagaactaaccagtcatggtatagaatgtccacggaaacggtttagaacccaggtgcctgtgaagacttcatccacagtggtaactccaggcttctctttggctcagtgattctgaggagaaatgtactcactctgtggaaagaggggttaaaggaaagctggcaaaagatcaagaaagctaggcaatttcgagcttataaaggaggggcaggggtgttttcaaaaccactcttatggtggaaagtagcatctaaggaaggagcctgcatggatagaagcagaatttaataggatatttcttttcttttcaacatttatttcagattcagggggtagatgtgcaggtttgttagctgggtatatcatgtcatgttgaggcttggggtatgaatgatcccatcatctaggtagtaagcatagtacccaatagttagctttttaacccttactttttccctcttctccccctaatagtccccagttgtctactgttgccatctttatgtccatgtgtaccccatgtttagctttcacttttaagtgagaacatgcagtacttggttttctgttccttcattaattcacttagcgtaatagctcctagctgcatccatgctgctgcaaatgacatgatctcattctttttttatagctgtgtagtattccatggtggctatgtagacagtttctttatccaatccacctttaatgggcacctagtttgattccatgtctttgctattgtgaatattgttgcaatgaacataagggtacatgtgtctttttggcagagtgatctgttttcttctggatatatacccaataatgagattgctgagtcaaatagtagctctgttttaatttctttgagaaatcttcaaactgctttccacagtggcagaactaatttacattcccaccaacagtatataagtgttctaattgggtatttcttgaaaactaaaatcaaagtcccatagatccagcaccaaaagagccaagctgtctctgtctgtcagatatgccttatgcccatcaagcacaaagtcttgccagtcctgcctaaaatgactgcaagatagcatgtgccatcttgtagcaagggagttttcagagctcagagtttcaaattcaagacacacacacacacacacacacacacacacacacacacacaacccgaataacctccaaaacaaacagtggaacaagtgaacaaagtagtcgtttaaaagacaaatgacaagcttgcaatgctggctgaaggggatgggggcgacctgtggtcaagtgggaaaaaattatgctcatgatgagctatttgtgaaggaggaatgcacaaataaaaatgcaggtgacaaaaacctgacatcttccctcatgcctgtgttttcctagtgagtaagcagatcaatctgttatgggaaaggaaaaggaaagctgtcaggcagagggggagagttggcaggcagttcattggaattcacagaataaccttttaagtcggaaaactaaactccatgcaagaaatcagagtagtaataggtgcttgatgtcactgtcaccccttgtacatgctgaagttggaggagttttgcctgctctgagactgtggtttgctctcctcggggtgctgcaccgccttccaggtggctgctgctcagaaaaacagtgaacactgctgaattcatccccgcagttgtttggttacacatggagataaaacccttgggagagttagcgagacatgccattccgtttagcctccagattgctgcctcccacctggaatccgagtctcagggctggggctagggagccaagatcttcccaatcaaacttcccattgagtgacaggaagtcacttgcctctgcctgaaactttccagggactaagagctcaccattctgtaaagcaaagcatttaacttcttatcagctctgatgtggtaccagttttccttacctgaggctagtatagtacagtagttaagcccttgtgttctatagtcagactgcctgcattcagaactggtgctgctagctccatgttagccctgtgacctgggtcaagtttactagacttcttggactccaagttccctcaactataaaaatgagactaatagtacaatgcctgccatatactaattgctaaataaacactagctgtgatttgttagtacatggttgctctgaaactttcttccattgctcctggttctaaccgggcaactgtacagatacaagcctagtttgtccttttcatgacagccctttcagatctgtggctaagtaagcatctcttctcaccctatgttttccactccaagtttttttttaatctagatacaatatcccaactctttcagctttttttcactatccttcttcaccgtattcttgaatacttctgtttgtcatcttcctctcctcccaaactgaacatggtgctggtgggaggtatggtcaaacaaggacagaatatggcaggagactgtcactcgcctcagtcaagattctttacttccagtagtgctgtagctgaaatttgctttgggacatttacaatagactggtgctcagtttacaatgggttaagacctctttgatactaatcatttaccttcaggacaaccagccaatttagaggcaagctgaacctgtatagagaataaaggtttccaaactgcacttggatcaaaataaatattttgaggctcaagcagttatcactatgttgtagatggatgtgcgagtttgtgtatcaagtgtcttggagttcaaatcaacatacatttattgagcggccgcacttagtgtatcaaagacaaagggcaaaatgacataaatatgaaaaggaaacatatctcggccctcaaagactcaacagctaggtggagaaatgggaaatagacgaataattgtatggctacatatagcaaataatacaagaaacaaaatgttatgagagttcagaagtgggaaaaatgagtttcagtttgaggcatctggaaagattttgtggataaagactttttgtaatggaacataaatataagtcaggctattgacaggagttatttctgccaatcctacccccaactgcaggaaatctaattggtcctccagggaatttgcaatcaagataattttttttttaagacagagtcttgctctatcacccaggctggagtgtagtggcttgattctgactcactgcaacctccgcctcctgggttcaagtgattctcagcctcccaagtagacgggattacagacatgtgccaccacacccagctaatttttgtatttttaatagagatggggtttctctgtgttgaccaagttggtcttgaactactgacttcaagtgatccacctgcctctgcctcccaaaatgctgggattacaggcgtgagacatcacgcctggccaagataatcttaagtcatatttttatcttccaaggacatattttagagggtgggaatgagaaatggccagcactgctggcaaagactttcagcccttccctcccccttgcaggacaaaatcagggctggcattagaagttgagggtcaaatccatggtttccacatggtgtcattatgccaaaaagcatgtgtaatagttatttattgctatataacacattaacaatttttaccagcctaaaacaacaaaaatttattatttcacacagtgtctgaggatcaggaattcaggggcagcttagctgggtgtttctgactcagggactgtcgtgaagttgtagtcaagctgtcatctgggcctgcagtgatctgaaaacttgactggggctggggaatgtgcttccaggaaggctcatccacatggttgtggactggaagcctcagttcctcaccatgtgggcctctccacagggatgccaggatgtcctcaggacaaaatacttggcttccttcagagtgatgagagagggctcgctcttttataacctaaccttggaagtgacatgccatcccttctgctatattctattggtacaatgtggaagtaaactacacaaggatgtcaatgccaggatgtggggatcattgagagcaatctcagagaggggctaccttacctctcacactctaggatgaacagcagtccaggggcaaaacagtggttgacatgaagtcttgatatagacatttttgcctttgggagggagtctacaaagacaagatcagaaagccagtaatggccctggggttccttgaaagtagtatctctcatgacagaagcaggcctgagtcagggcattggtgacagctggtgaaagaaaccaaaaaagactgaccttcttcttctggcttaggattcttcatttttgtgtttcactgtgtgatgaaggagagtgtgcgggagcagtggcagatacacctctgctgtgggtggttgcgattggataactcttctggtaagatgtcagtttggatgaagttttgaatattacatgttttacaaaactgatcagattaatttgtctcctaacttgagtacttacagcatatcagcatcaaaacacaggctgtttccatgtcataaaaatgatttgtgcttttgagctgagatgagtgaagtcaagtgaagaatgtgacttgggccatattttaaactagggatgcttttgttttggcccagattccctggattgcttaccttcactgtcacatcagtctcaattcaattaaaagaacactgaatgcgtgcctactgtgttccaggcactgggtctcaggggcttctggctggtagccaacagtgggttgagtggatgtaggaagcaaggagtggtggtggagatggagagaacttataaacattcctaagatgcctggccagtgggctgtacaggtgtactgatggcccacgaactgggggatgtagtgaactcagatgttgcctcttagcactggtgcttcccttgagaatgtttccactgcaggcaaactgctgttctatgtatcaaaaggatcttccattcaattcaggcagcttctctcagtctcaatacaaagcctaatccattttctttagtgaaggcagcacttgaactctaagattctacaagtagcactgagattccccccattccccactttattttattttttttcttccagtattttattttatttatttattttttttattatactttaagttttagggtacatgtgcacattgtgcaggttagttacatatgtatacatgtgccatgctggtgtgctgcacccactaactcgtcatctagcattaggtatatctcccgatgctatccctcccccctccccgcaccccacaacagtccccagagtgtgatattccccttcctgtgtccacgtgatctcattgttcaattcccacctatgagtgagaatatgaggtgtttggttttttgttcttgcgatagtttactgagaatgatgatttccaatttcatccatgtccctacaaaggacatgaactcatcattttttatggctgcatagtattccatggtgtatatgtgccacattttcttaatccagccagaatctacaatgaactcaaacaaatttacgagaaaaaaacaaacaaccccattccccactttatgctggccatatcagcaacctgctggtccttgtgctctgggaaaagcaggcatccttggtatgtgaattgtctcttcctataccacacattacagtacaaacctacttcttacaacttcatagaaaagctgactccttcaggtacccggaatgaacactgtgcatcaagctttgtttttttgtttttgtttttgtttttgtttttttttttgagacagagtctcgctcttgttgcccaggctggagtgcaatggtgccatctcggctcaccgcaacttccgcctcccgggttcaagtgattctcctgcctcagcctccagagtagctgggattacaggcatgcgccaccccgcccggctaattttgtattttttagtagagaccgggtttctccatgttggtcaggctggtcttgaactcccgacctcaggtgatccgcccgcctcggcctcccaaagtgctggaattacaggcgtgagccactgcgcctggcctaaactttgtatttttaaaccaggttattgaagtgtaatttatataccatacaattcactactttaagtatagaatttcatgagttttatatttttaacttttcttggtatcatttcagatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatggtaagaaaaaaaggctgtgttgtctacatttatattccagagatattgaattaatgtgagaccacatactgggtcttggatgatacttcctcttcaaaactaaatgcacatgtgcatgtgtatacctcgactcattcttggctgagaaagtgtgtatagaagcatagaaatgtgtacagaagtgtgtataggtgtttctgtgcctagtaaatttagtaagtatgaatgtgttattagactaatagaggaaagaagagatgagaggttagaaaattcatgagtaattaaaaacaattgtcacagaccattaaaaccagaaggaaccttagacattgtctagtccaatccgttcattttacagttgaggaacctcaatcagagaaaaggaaaatgccttattgacagtcactgagcccatctttaccatccagtagaactggggccagtcactcagccctcagccatccagcagaactggggccagaattcaggtcttctggctctcagggctagtcctatcaagaaaacagagatacacatcactcttagatgctgagcttcttccataggaagccatatttctaagctgagacagatgttcagttgggaatggggtgttgtacctaattatgtaaaaagagaaagtgtaggaaaaggattggcctacaggcttaaagtaaagagaaaggcaaagtgagcaagaacttaagaacttcaggatgatactgtgatgagtctgcattgtgtgcttctagttagatgatagtgcagtggtctttggttgcctttctttaagaccaaagtatactccagttcacacacactttggtggcctggctgtagtcattctcctgccttctcagtgctggaggtaggactgcctcattcgctagtatttttctttatgttggctccaaaaaccagttctatgtccaagggctgaaggcaatctggaagcagcatggtgggttaaaaaagcatcaaacttggagttggaaggctttggttcaggttccagctctgtcagtcactctgtgaccttgagcacatcacttctctgcttggagctacattctttctacctttcatatgaggggactagaatggataatctcttaagtgcctgccagtttcaggaccgtgtatggggcaacgctattttccagtttgggctggttgactagtgtatagcatctcagtctcccatctttgtgtgggaaagttagtgatgcacatgagaaaaacctttccctggccacaagcatttatcaaactctggccaagtaacctgtggatatgtcttggtgctcatataaagtcactggggtgccatgacatagacaaggcatgggttgtgggagctccttagtagataatagttggggctggttggaaaataacatttttcaagagggttatttagcattggatttcttgatgtccctggggactatttaattagcaaatatacagcccaatgtgtacatattttgcttcagaggatcagtagcaaataccatatccaggatattgatgttgtcttaccaagcaatcgacctggaaaaccaacattaaagtgctcatcagttgagaggaactgagccagtggggcaggtagacctgccacaggttctaaaactgaaatctgggtccttccattgtactagtgacagccagaagcttgattctattagcagagagtgaaaaatcatgccctctgtaccaccaggcattctcaagcttgagaaatagccaaactttcagtgcaagaatatcaaatatgtaaggggtataaatgtgtatgttcacattttatgtcatcttctcttgaaggcctccgagtttgtacataaatatcctctcctaggttaaggttaaggtcaataatgctgcctcttattcacaatgtaggaagaacatatgcactggttgtccaaacagtgctgtcaggatgaattaattcaccccggattttatataaaacagtccaaagaaagcaccatatccttcccttctcttctaattgctttattttttccttcatttgataaaattttcttatgcttctactatgtgcaaagtccctgatgccgcagctgaaaattttctttttttctttactgcagatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcct

SEQ ID NO: 5103 - DNA, 112035 bp, human; identical to SEQ ID NO: 5102

SEQ ID NO: 5104 - DNA, 5893 bp, human; identical to SEQ ID NO: 3883

SEQ ID NO: 5105 - DNA, 6365 bp, human; identical to SEQ ID NO: 3889

SEQ ID NO: 5106 - DNA, 20368 bp, human; identical to SEQ ID NO: 3885

SEQ ID NO: 5107 - DNA, 24655 bp, human; identical to SEQ ID NO: 3886

SEQ ID NO: 5108 - DNA, 20612 bp, human; identical to SEQ ID NO: 3887

SEQ ID NO: 5109 - DNA, 24654 bp, human; identical to SEQ ID NO: 3888

SEQ ID NO: 5110 - DNA, 12163 bp, human; identical to SEQ ID NO: 3894

SEQ ID NO: 5111 - DNA, 12197 bp, human; identical to SEQ ID NO: 3895

SEQ ID NO: 5112 - DNA, 12163 bp, human; identical to SEQ ID NO: 3894

SEQ ID NO: 5113 - DNA, 12197 bp, human; identical to SEQ ID NO: 3895

SEQ ID NO: 5114 - DNA, 5443 bp, human; identical to SEQ ID NO: 3897

SEQ ID NO: 5115 - DNA, 1190 bp, human; identical to SEQ ID NO: 3898

SEQ ID NO: 5116 - DNA, 11173 bp, human; identical to SEQ ID NO: 3899

SEQ ID NO: 5117 - DNA, 7766 bp, human
atccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacac

SEQ ID NO: 5118 - DNA, 125930 bp, human; identical to SEQ ID NO: 3903

SEQ ID NO: 5119 - DNA, 32910 bp, human
gttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagttta

SEQ ID NO: 5120 - DNA, 110386 bp, human; identical to SEQ ID NO: 3904

SEQ ID NO: 5121 - DNA, 61070 bp, human
aggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggt

SEQ ID NO: 5122 - DNA, 60075 bp, human
atggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagta

SEQ ID NO: 5123 - DNA, 60957 bp, human
gatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggt

SEQ ID NO: 5124 - DNA, 110354 bp, human; identical to SEQ ID NO: 3905

SEQ ID NO: 5125 - DNA, 60047 bp, human
atggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattg

SEQ ID NO: 5126 - DNA, 126445 bp, human; identical to SEQ ID NO: 3906

SEQ ID NO: 5127 - DNA, 125930 bp, human; identical to SEQ ID NO: 3903

SEQ ID NO: 5128 - DNA, 110386 bp, human; identical to SEQ ID NO: 3904

SEQ ID NO: 5129 - DNA, 110354 bp, human; identical to SEQ ID NO: 3905

SEQ ID NO: 5130 - DNA, 126445 bp, human; identical to SEQ ID NO: 3906

SEQ ID NO: 5131 - DNA, 142974 bp, human; identical to SEQ ID NO: 3907

SEQ ID NO: 5132 - DNA, 818 bp, human
tggaggagcagcagaaggagggcgaggccgaggtcgcggagcactggttttccaagtgggagcgccagtgcctggctgaggccgagcaggaggagcagctgccccccgagctgcaggaggaggcggctgcagagttggcagggctcaagagcgagaagcagaagctgtggcacctcttccagatctcggccaccgccgttgctcagctttacaaggattctgggtgccaacagcaaggactttccatgtgggaccccttccagaatgcggccatggccgtgaccagcctctacaaagagagcggggatgcccaccaacgaagttttgacttgggtgtccaggttggccaccagcgtcgcatcaaagatgtgctggagtgggtgaaaaagggccggagcaccattcgtcgcgaagacttgattagcttcctgtgtggcaaagtgccccccgctcctcctccacctcgcactcctaggacacccccgaagccacccactggggtcaccagccaggctgtggcaactgagtccagctcatcggtggacgtcgacctgcagcccttccaggaggcgatcgccctgcatggcctcagtggtgctatggccggcatcagcatgcgatcgggcgactcgcctcaagacagcggtgtcgccagcagtgggcgccgaaaaactagcttcttggaggacgacttgaatcccttcgactcagaggaactggccctccacctggacagtggggggatccgcaagcgcacctcggcccaatgcagtgatggcatcacagactccccaatccaaaagcgcaaccgaatggtc

SEQ ID NO: 5133 - DNA, 2073 bp, human
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccacgccgctgctcctttcacctttgtaggctgggaatcgctgtgttatttgcaaagaaaaaacagcccccactcctcctcctgagttccagggttattctgttacatttgaaaatgttgtcttgttagtttgcagttagccaaggagtgaatgggagaaacatagtatcgggtgaggccagctggagaactgcaacgcctacgcccccagtcgtgtcgcgtctgttttcctcgtggttttttggggcgctgaccgctccaagcagcgcggcagctaaagccaatgttaatttatagccaggtgtgcgtgtgtctcccgcctcgccgcccctggccgcgggacagcttctgtccaatcatgttgagttggtgatttctgccgtgatctgtttgatatttcttcgcgctaatgtgttcagatttcgtttgggtagtggggaggggctactttgtttcagggttttcaagcttttactcttaattcctaaatgagatcaataaattttataac

SEQ ID NO: 5134 - DNA, 1115 bp, human
tcaccaggagggtatgcatagggagggcaagagctctgggccactgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacggtaagattgttaggttttgaagtgaaggcgagggtgaaagaaagacacacagagcgggggcggctcaaacaacaacacaggaatattgcagaccattgtggaagtggggggcccgcttaatgccagagcccaccgccgcttacaacctggggtgcttgtaggtaggggtgggaggggcctgggcagtatggcttgctgcccggcaggatattgataagatgttcttatgatcaggtggtttggccctttttctggtggaatatcattgtggtgttccttagaacgctgccaagcaagatatgatagggatgtttcttcagttgggcctttgtccgccttgcggacaggtggttaggcaggatgtttctcacggcctgaacccccatgggatgtttcactttgaccaaggtctgcaaaatagcaaagaactgacaaaatggtgcagtttggactcacaggtgaccctacccacgctcctcttcttcttccccatagatccctactctgtgcttcaaccttcttcttctctggatcaaaccccttcctcaacctgcattccttcttctcatgaagcccccttgctatccagtctctatcctgttcacccaaaataatgtcctcctggcctctccctgttttcttaacagatgccggagaccccaactggggactcagacccgcaacctgctcctaaaaaaatgaaaacatctgagtcctcgaccatactagtggttcgctacaggaggaacgtgaaaagaacatctccagaggaactggtgaatgaccacgcccgagagaacagaatcaaccccgaccaaatggaggaggaggaattcatagaaataacgactgaaagacctaaaaagtagcaagaagctacatccctcaaacttcggcaatgaaaataaagtttgagaagctga

SEQ ID NO: 5135 - DNA, 45338 bp, human
gaagcttctgggccacggactgccggaccgttgggctgtgaggcagcgtctcagcgaggcggcacccggagccatgtcttcacataggaggaaagcgaaggggaggaataggagaagtcaccgtgccatgcgtgtggctcacttagagctggcaacttatgagttggcggcaactgagtcgaatcccgagagcagccatcctggatacgaggccgccatggctgacaggcctcagccaggatggcgggaatctctaaagatgcgggtcagcaaaccctttgggatgctcatgctctccatttggatcctgctgttcgtgtgctactacctgtcctactacctgtgctccggtgagtgctggctcaggccaggcagggaaatgctgggggagggggagggggagggagaggggggcggggtgtggcaacacaccggcaccaaccataggccttcctgccccttcctgtcctctctcctcccaaaggcctttatggccctatcctcagcagtccttacaaagtcctgccctctctcgcctggccgcaggaagtctttcctgcctaaactcacttataaaagactttccctccccaacttcccctaacaaaagccttcccttcctcacttcccgccacaaaatagactaacctcccttgtcgcccctttttaaaaattgaggacaaggcacggtggctcacatctgtaatcccagcactttaggaggctgaagcaggtggatcacttgaggtcaggagtccaaaccagcctggccaacatggtgaaaccctcatccctactaaaaatacaaaaattagccgggcatggtggtgcacgcctgtaatcccagttaatcgggaggctgaggcaggagaatcgcttgaattcgggaggtggaggttgcagtgagctggcatggtgccactgcactccagcctggtgagagagcgagactccgtctaaaaagaaaaaaaaaaaaggactgggcgcagtgctcacgcctgtaatcccaatactttgggaggccgaggcgggcggattgcctgagcttaggagttcaagactagcctgggcaacaaggtgaaaccccgtctctactaaaatacaaaaaaattagctgggcgtggtggcattcacctgtagtcccagctacttgggaggctgaggcaggagaattgcttgaacccgggaggcggaggttgcagtgagctgagatcgcaccactgcactccagcctgggcgacagagcgagactccgtctcaaaaaaaaaaaaaaaaaaaaaaaggccgggcgcggtgggtcatgcctgtaatcccagcactttgggaggcggaggcgggtggatcacgaggtcaggagatcgagaccatcctggttaacacggtgaaaccccgtctgtactaaaaatacaaaaaaattagccaggtgtggtggcaggcgcctgtattcccagctacttgggaggctgaggccggagaacggcatggacccggaaggcggagcttgcagtgagccaagatcgcgccactacactccagcttgggcgacagagcgaggctccatctcaaaaaaatgaaaaaaaaattgaagtgaaattcatataacataaattaactattttatagtgaacaattaaagggatttcgttcctgtaaatgttgtgcaaccatcaccccatgtagttccaaaatattttaaccaccccaaattaaaacccatacccatgaaccagttactcccaattccccagtccataagggtacttaattcctttttatggctaactagtattccattgtagggatatactatatttttatctagtttttgaaatttaccgaatttgggttgtttccactttgggcctattatgaacaatactgctatgagcatttgtgtacaagttgttgtgtagacatgttttgaattctctaggagtagaattgctgggtcatatgggaactccattgatctttttgaggaagtcccacactgttttacaaagtggttgaaccgttttacatctccactaacaatgtttgaaggtttcaatttcaccaatatatgttatctgtcccccttgttatacattatagccattatagtaggagtgaaatagtatctctttatggttttgatttatattttcctaatgcctaatgacgttgagcatgttttatatgcttgttggccattcgtacatctttggagaaatgtcttttcaattatttgaccatttttaattggatcgtttgtggttttgctgttgagctttaagaattctttatatattctggatactggatccttatcagatacctgatttgcaaatgtttcctcccattctgtgggtagtcttttcactttcttgataatgtcctttgatgtaaaaatgtttttaattttgagaaagttcaatttatctattttgtctttggttgcttgtgttttggagtcatatctaagaatccgttgccagatccaaggtcatgacgattactcccatgtttgcttctaagagttttacggttttaactctcatattcagattgttgatccatttggagttgattttggcatatggtgtatgttaagggtccaacttcattctttggcgtgtggatagcccctcgttccagcaccacttgttgaagagacgattttttcctcttggcagccttctgaaaaatcagttgattatagatttataggtttagttctggactctgaattttattctggtctacgtgtctatctctatgctggtaccacattctttggattactgcagctttatagcaagtttagaaattggaatgtgtgagtccatcattttcgttcttctttatccatactgttttgcgtattcatggccactaacgactctatataaatttgagagtcagcttttccgtttctgccccaagcccattggaatgttgatagagttggcattgaatctgtagatcactttggaagtgctgccatcttaacaatattagggattccaatctgtgaccaccccatgtctttccatttattaatgtcttctttaatttatttcagtaatgttttgtagttttcagtttacaggtctttaacttccttgggtaaatttatttttagatattttattcttttgtatgctattgcaaatggaatggtttcctttttcttttcatattgttctttgctggtgtatagaagcacagctcatttttacctgttggtctcgtaccctgtaaaattgtgaaattaatttattagctctagtaagattttgtgggctttttggatattctagacatagaatcatgttatctgtaaatagagagagttttactttttactttccgattttcatgccatttatttatccttattgcttaattgctcttgctagaacttccagtacaatattgaatagcagtgatgaaagcaggcatccatgttttagaggaagcttttggtttttcaacattgattataatgttagctgttcatcagctcttcatcatgttaagtaagattcattctgttcctagtttgctgagtgattttattacgacagggttttagattttgtcagatgctttttttgcatcaattgagatatgaaattgtttccctttgtgtattatgttgactgattttcttatgttcaactgtctttagattagtgggatgaaccccactttatagtcattgtgtataatccttataatacgctgttgcatttggtttgctggtattttgtaggagaattttctatctatattcataagcgatattggtctgcagttttcttgtggtgtctttgcctgcccttgggatcatgttactactgaactcctagaatgagttaagaagtattgttgctggaagattttgagaacgattgatgttaattcttctttaaatatttggtagaaattaccagtgaagccatccgttcctagattttttttgttgaaacattttatttttgattttatttttactttaaaaaaagttatgggatacatgtgcagaacgtgcaggtttgttacacaggtatacatgtgccatggtggtttgctgcacctatcaacctgtcaactaggttttaagtggtatttgtctgaatgctctccctcccctttcccccaacccctcgacaggccctggtgtgtgatgctcccctccctgtgtccatgtcttctcattgttcaactcccacttatgtgtgagaacatgcggtgtttagttttctgtccctgtgttagtttgctgaggatgatggttcccaacttcatccatgtccctgcaaaggacatgaactcattcttttttatggctgcatagtattccatggtgtgtatgtgccacattttatttatccagtctatcattgatgggcatttgggttggttccaagtctttgttattgtaaatagtgctgcaataaacatacatgtgcatgtgtctttatagtagaatgacttataatcctttgggtatatacccagtaatgggattgctgggtcaaatggtatttctggttctagatccttgaggaattgccacactgtcttccacaatggttgaactaattaacactcccaccaacagtgtaaaagtgtttctatttcttcacatcctcaccagcatctgttgtttccatacattttaatgattgccattctaactggcttgagatggtatctcattgtggtttttatttgcatttctctaatgaccagtgatgatgagcttcttttcatatgtttgggggcctcataaatggcttctttacagaagtgtctgttcctatcctacacccactttttaatggggttgtttatttatttcttgtaaatttgtttaagctccttgtagattctggttattagacctttgtcagatggatagattgcaaaaattttctcccattctataggttgcctgttcactctgatgatagtttcttttgctgagcagaagctctttagtttaattagatcccatttgtcaattttggcttttgttgccattgcttttggtgttttagtcatgaagcctttgcccatgcctctgtcctgaatggtattgcctagattttcttctagggtttttatggttttaggtcttatgtttaagtctttaatccatcttgagtttacttttgcataaggtgtaaggaaggggtccagtttctgcttcctgcatatggctagccagttttcccaacaccatttattaaatagggaatcctttccccattgcttgtttttgtcaggtttgtcaatgatcagatggttgtagaggtggggtgttaattctgaggcctctgttctgttccatttttctatatatctgttttggtaccagtactatgctgttttggttactgtagtcttgtagtatagtttgaagtcaggtagtgtgatgcctccagctttgttctttttgcttaggattgtcttggttacacgggctcttttttggttccatatgaaatttaaagtagtattttctagttctgtgaagaaagccaatggtatcttgatgggaatagcaacgagtctataaattactttgggcagtatggccattttcacgatactgattcttcttatcaatgaacatggaattttttttccatttgtttgtgtcgtctcttatttccttgagcaatggtttgtcgttctccttgaagaggtccttcatgtcccttgtaagttgtgttcctatgtattttattttctttgtagcaattgtgaatgggagttcactcatgatttggctctgtgcttttctattcttggtgtataggaatgcttgttatttttgcacattgattttgtatcctgagactttgctgaagttgtttatcagcttaaggagttttggggctgagacgatggggttttctaaatatataaaatcatgtcatctgcaaacagagacaatttgacttcctctcttcctatttgaatacactttatttctttctctggcatgattgctttggccagaacttccaatactatgttgaataggagtggtgagagagggcatccttgtcttgtgccggttttcaaagggaatgcttccagcttttgcccattcagtatgatgttggctatgggtttgtcataaatagctcttattattttgtgatgctgagaagaatgtatattctgttgatttggggtagagtcttctataggtgtctgttaggtctgcttggtccagagctgagttcaagtcctgaatatccttgttaattttctatctcgttgatctgtctaatattgacagtgggttgttaaagtctcccactattattgtgtgggagtctgtctttttgtaggtctgtaggaatttgttttatgaatctgagtgctcctgtattgggtgcatatgtatttaggataattagctcttctttttgcattgattccctttaccattatgtaatgcccttctttgtcttttttgatttaaatttgttttatcagagactaggattggttttttttttctttctatttgcttggtgaaatttctccatccctttattttgagactgtgtatgtctttgcatgtgagatgggtctcctgaatacaggacaccaatgggtcttggctctatccaatttgccagtctctgtattgtaattggggcatttagccgatttacatttaaggttaatattgttatgtgtgaatttgatcctgtcatcatgatgctagctgttttgcacattagttgatgcagtttcttcatagtgtcattggtctttgtattttggcgtgtttttgcagtggctggtactggtttttcctttccatatttagtgcttccttcaggtactcttgtaaggcaggcctggtggtgacagaatcccttaggatttgcttgtctgtaaggattttatttctccttcgcttatgaagcttagtttggctggatatgaaattctgggttgaaaattcttttctttaagaatattaaatattggccccactctattctggcttgtagggtttctgcagagagatctgctgttagtctgatgggcttccctttgtaggtaacctgacctttctgtcttgctgctcttaacattttttccttcatttcaaccttggtgagtctgatgattatgtgccttggggttgctcttctcgaggagtatctttgtggtgttctatttcctgaatttgaatgttggcctgtcttgctaggttaggggaagttctcctggataacatcctgaagtgtgttttccaactttgttccattctccccgtcactttcagggacctcaatcaaacgtaggttttgtcttttcacatagtcccatatttcttggaggcttttttcattccttttcaatcttttttctctaatcttgtcttcacgccttatttcattaagttgatcttcaatccctaatatcctttcttcttcttgattgatttggctattgatacttgtgtatgcttcacgaagttctcgtgctgtgtttttcagctccatcagttcatttatgttcttctctaaactggttattctagttagcagttcctgtaaccttttgtcaagattcttagcttccttgcattagattagaacatgctcctttagctcagaggagtttgttattacccaccttctgaagcctactttgtcaaacccattctctatccagttttctgcccttgccggagaggagttgtgatcatttggaggcgaagaggcattctggtttttggaattttcagcatttttgcactgttttttcctcatttttgtggatttatctacctttgatctttgaggctgaagaactttggatgggatttctgtgtgggggttctttttgctgatgttgatgttactgctttccatttgttaggttttcttctaacagtcaggcccctctgtggcaggtctgctctagtttgctggaggttcaccccagaccctgttttcctggttatcaccagtggaggctgcagaacagcaaagattgctttctgctcctttctctggaagcttcatctcagaggggcaccagcctgatgccagccagagctctcctgtatgaggctcctgtcaccccctgttgggaggtctctcccagtcaggaggcacaggggtcagggacccacttgaggatgcagtctgtcccttagcagagctcgagtgctgtgcttgtagaaccctccttgtcagggtccactgctctcttcagaagtggcaggcaggaacgtttaagtctgctgaagctgcgccgacagccgcccctttcctcgggtgctctgtcccagtgagacgggagttatatctttaagcccttgactggggttgctgcctttctttcagagatgccctgcccagtgaagaggaatctagagaggctgtctggacacagctgttttgccacactgtgttgagttccacccagtccttagcacagtcaggggaaagccgcctactcaagcctcagtaatggtggatgtccctccccacaccaagctcaattgtcccaggtcgacttcagactgctgtgctggcagggagaaattcaagccagtcattcttagcttcctgggctctgtgggagttggacccactggcttggctccctggcttcagccccctttccaggggagtgaacagttctgtctcactggggttccaggtgccactgggctaagaaaaaaaaaaaaaaaacaaaagctcctgcagctagctccgtgtctgtctgaacagctgccagttttgtgcttgaaacccagggccctggtggtgtaggcacatgagggaatctcctggtctgtggactgcaaaaaccatagaaaaagcatagtatctgggccagatagcacagtctgtcacagcttcgcttggctgggaaagggatgcctctgctccttgcacttcccaggtaaggcgacaccccaccctgcttctactcaccctccgtgggcttcacccactgcctaaccagtcccaatgagatgaacagggtacctcagttggaaatgcagaaatcacccaacttctgcattggtcttgctgggagctgcagaccagagctgttccttttcggccatcttgccagcagatgcccctgtttttgtatttttatattgatatatcatagttgtatgtatttttggggtatatgtgatattttaatatgtatatacaatgtgtagtgatcaaatccaggtaattgagatatccattacctcaaaaatttatctttgtgttgggaacattccaattcttctcttctagctactttgaaatataaaacaaattattattaactataatttctctgttacaagggaggttttgtttagtgtttcaatctctttatttgttataggtattctttgaaaggtcttccctccttaacctcccttcacaaagtactacatttcctttcccttctttcagaaatgactttctctcataggtgactttcctccctcatctctcccaagaccttcttttcagtacctccatcacatgggactaaccttcttcaccacaccgctgaaaccactaacctccatcatctcctctcttaaagcttttccacccctaacctcacttgctaacctcccttacttcaccacacatttcctcaatctcctcccttcacaaaagtctttccttgctcatttcccctcatgaaagcctttctttactcaccttccatcacagagtcctaccctcccgcatgttcactcacaaatgctttcttttatctctctctaaaggcttcctaccacacttctgaaaaagtgcttacttttctcacctcagtcgtggaggcctttaattcctcaactcttcactaaaattccttgtcttccttcacaaagacctttctccctcatctcctctcacaagggcctttcttctttcacctccctcatgaaataataacctccttcatctcctcttcatagtcctttcttatctcaccagtacattccctgcctcacctttgcttatatagttccaacctcccttatctctcctcacaaaggtataccctccatcttctcctctaccaaaatcttctttccatgctctcccctaacaaaattctaacctctttcacctcccctcacaaagacctaatcttctttcatggttacctttcctgctttctttaccttcacaattgacttccttccctgctcaaaggcctccttccctcaagtcccctcacaaaaccctaactttctcacctcctttcccaaaaaacttccttccttcacttatcatcacaaaggccttccttctttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttcagcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggcaaggtcacagatcaacaggatcccaaggcagaggaatttctcccagtgcagaacaaaatgaaaagtctcccatgtctacttccttccacacagacacggcaactatctgacttctcaatcccttccccacctttcccgcctttctactccacaaagctgccattgtcatcccgtcccgttctcaatgagctgttgggcacacctcccagacggggtggtggccgggcagaggggctcctcacttcccagtaggggtggctgggcagaggcgcccctcacctcccggacggggcggctggccgggcaggggggctgaccccccccacctccctcccagagggggcggctggccgggcagggggctgaccccccacctccctcccggacggggcggctggctgggcagaggggctcctcacttcccagtaggggccgccgggcagaggcacccctcacctcccagacggggcggctggccgggcggagtgctgacccccccacctccctcccggacggggcagctggccgggcggggggctgaccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacagggtctcggccgggcagaggcgctcctcacatcccagatggggtggcggggcagaggcgctccccacatctcagatgatgggtggccgggcagagacgctcctcacttcctagatgtgatggcggctgggaagaggcgctcctcacttcctagatgggatggcggccgggcggagatgctcctcactttccaggctgggcagccaggcagaggggctcctcacatcccagacaatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaattccggcacctcgggaggccgaggttggcggatcactcgcggccaggggctggagaccggcccggccaacacagcgaaaccccgtctccaccaaaaccagtcaggcgtggcggcgcgtgcctgcaatcgcaggcattcggcagactgaggcaggagaatcaggcagggaggttgcagtgagccgagatggcagcagtacagtccagcttcggttccgcatgagagggagaccgtggggagagggagagggagaggggccttccttcttttaccctcacaaatgccttccctccttcatcaccattccaaaagtttttcttgtccttcaatcaaggtcctttcatttctcacctccccacaatgactttcctttgctcacttcacaggccttttctcaaaagcttttcattccttatctcacagagcccttttctcctctcttaaagtcttcagtcccttacttcccttcttttaccttatatcatcctctccctctctaagctaccttcactaaggccttcccctctccctcaaattccttctcttacctctttatttaccctcctccaggccttcactcactccctctcagaagcctactttcagctctccaaaagttcttctccccactcaggttttccttccttcaccacccaaaggtactttccacttcttccccaaaagccttcttttcttccttccacttaatggtctttctgcctcacttgcttcactcaaagtctttccctcctcctccagattctcccaacctgaactgcttttccttttcctacaaccttctttccttccataaccttcctaagtctcagatggttttctcaaaacagctttctcaatattacccataatggcgtgccttttctcccaaccccctcacaaacgtattttatgttctcatctgcacaaaggccttagatttcccacagtctcctgcctttgagctccagacccaagcccaaagacttcagcatccccacctctaatcccaagggcttctttctccctgctctccctagaggttttccgtcttctcaaccaaggtccacccacagtcaaagagggaggcaaagattgggcagtggcatcacaactaaaaagaatagagacttctatacactatgtcacaactacatgggtttctaggtttttgtgaggaatgaaattcataattaaataaagtatatgctgttttatcaattatttgaaataagttagaaaatatgatttctgttctttgaaaaaatgttaagatatttttaatgatcatttacaaatcataatattactacaaattattcaggtttatttctactatttatctaaaacaccaaagtatttctgaattactgtatttgtaatagtacaatactaaaagtcttcttatcctctaaaaaagtaagctgaaaaacaaaactataaattgtgtattttttcttagtcagcgagttcttcattttctatttctattttgagtagaactcccacacaaaaaagaatactgtctaattcagtgtgatttctttatttccaggagtactttttccattataggtctaacatgttttctcctaaaataatctatgattcattctttacattgttagatttcccagattctcaggaggtaatatgtgactgtatgaattaaatttaatttgcatttaaaattatttcacttaattaacataacaaaatgcacttgttatgggttgaattgtgttccctcaccaaaaacagttgcaattataaccccaataccttatttgtgatcttgtttggagataaggtcttcatagagataatcaagttaaaatgaggtcatctgaagtgtattttaatccactatgaatggtgtccttataaaaaggggaaacttggatgcagagacagacacccatacaggaaagactatttcaacctgcaagccaaggagaggcgtttcctcacaatcctcagaaggaaccagccctactaacaccttggttttggacttctagcctccagaggtgtgagacaataaatttctgttttaagccacccagtttatggtatgttgttacaacagccctaggaaactaatatacatcagaaggtaaaataattgtccatggtcctgtagaattatggcaaaagcaaaacatatggttctgacattaaaattccctttctcatttctagacggaccctagtgagttctcttagatttaatggtactgacaggaattgaagttgagtgacctgaggtaactctgggatatacctccagtttgtattgtcatttgcattcccaagccacattgcctttcaagttatatttatgcagaagacgtacagaccagtggcatacaggataaggagagaagcaaactgtggactgggagtttgattccaccaataatctgtaacctattcagtcagtcctaattgctcatccttttcagggaaatttaaaaaatgagaaataaagatggactagtaggtaatattttcaaattgccttagctgcatggacagatctcagtaactagtttctgtatcattatattagaatactttatttatctgatatccttggggagtgaatgaggcattacacatagaaagtctggctgcctgccgtgtacctaattgagcacgaggctagcttttgctttaaccctgtgtacgtgtggtgtagttggaggagccctaagctaggaatcaagagatctaggttgccctgattgttcacactaacttgctgtgtgaccattgatgagtcattttacctctttaggcttcagttatcttatcgaaaaaatgaagaaatttcactaggtgggcatttttcctgttcagtcaaaatgcttggttatcttaatgataccagtcattcatattttcctttaagctaccttacttttttacattaatatatttatttaaaaagggaactgtaccatagttataaatggaaagttgaccatatttgctattaagaaagttattaataaaaataaatatcctgaaaacaagtaatgatattaaatttaaaattgtaagcaataaaaataaacgatgaaagacatgtaacaaactgttttgcattgtattaagcccttcacatgtgacttcatttaatcctcataacacttcaaaataaatatcaccattttgcagatgagtaaactgaggcaacgagaagtttactgacatgctcaagttcaccacctagtatgtggcagagtcaggatacaaactcaggtctgtttgaggccaacacccagaaagatagtggcataggtagaccctcaacttgaagcctcagtaaaatcctttagaaactgatacagttagccactgctctttctgtctcctcaccctgtcattcagtttctcatctattagacctcacaccacagcggggatggggggggcgggggcaacataatttgtaaaatgaaaatacaagatctctcatttaaaattcatggttttcaaaatggcgatagcaaaacattaaaccaagcatggagctccccaagtgtggggccctgtttgactgcacaagtcacatatagatgaagctctctgtctgcactgagtctggtgtttcttttccgttgaaatgtagttagatttttagtcttttatttgtaacagggaaattaaaaaataaaaaattctttgtgacaaggaaacataattcgttctttaatattttctgctaccaatttaaaaggctgactcctaatcttttatttgctgaacatgctaatgagtgtaaagatgcaaattagaggcaaagaggatgacattattcttcatatgaaaaataatggaggaggggaaaaaggctggaggctgtttgggtagagaggaagacctgagaaaaaggcttgtgtgctagctggtgggagactttggagagagttaaagaggaaaaggaggcaattgtcccagggaagaaagagcagggacaaaagtttataaagcctaagcaaaaagaacaaagctggaggcatcacactacctgacttcaaactatactacaaggctatagtaaccaaaacagcatggtactggtaccaaaacagacatacagaccaatggagaagaacagaggcctcagaaataatgccacacatctacaaccatctgatctttgacaaacctgtcaaatacaagcaatggggaaaggatttcctatttaataaagggtattggaaaaactggctagccatatgcaggaaacagaaattggaccccttccttataccttatacaaaaactaactcaagatggattaaacacttatgtgtaagacctaaaaccataaaaaccctagaagaaaacctagacagttccattcaggacaatggcatgggcaaagacttcatgactaaaacaccaaaagcaatggcaacaaaagccaaaattgacaaatgggatctaattaaactaaagagcttctactcagtaaaagaaactatcatcggagtgaactggcaacctatagaatgggagaaaatttttgcaatctatccatctgacaaaaggctaatatccagaatctacaaggagcttaaacaaatttacaagagaaaaaaaaaccatcaaaaagtgggcaaaggatatgaacagacacttctcaaaagaagacatttatgaggccaaaaaacatatgaaaaaaaactcatcatcactggtcattagagaaatgcaaataaaaaccacaatgagataccatctctcgcctgttagaatggcaatcattaaaatgtgtggaaacaacagatgatggagaggatgtggagaaacaggaacgcttttacactgttgatgggagtataaattagttcaaccattgtggaagacagtgtggcaattcctcaagtatctagaaccagaaataccatttgacctagcaatcccattactgggtatatacccaaaggattataaatcattctagtataaagacacatgcacacgtatgtttattgcagcactatttacaatagcaaagacttggaaccaacccaaatgcccatcaatgatagactggataaagaaaatatggcacatatacatcatggaatactatgcagccataaaaaagaatgagttcatgtcctttgcagggacatggatgaggcttgaaaccatcattctcagcaaactaacacagggacagaaaactaaacaccgcatgttctcacacataagtgggagttgaacaatgagaacatatggacacagggagaggaacatcacacaccagggcctgtcagggggtggggggctagaggagggagagcattaggagaaatacctaatgtagatgacgggttgatgggtgcagcaaaccaccatggcccatgtatacctatgtaacaaacctgcacattctgcacatgtatcccagaactcaaagtatcaaaaaagacaaagtttataaagatttgccctatggcaagtgatgtcagccgtgtttggtgtcatggtaggtttgatatgttactcatttttttcttttacactttcaaataaactcatagcaaacattaatatatccataaatattcatctatgttccacctaaaattcttatgtactactagtgatagactacactttgagacatactgctcaaattaatttaaaaataattttctttcagagtacggaagaaaccaaaggtggagggcagggtaaaatatattctagacttatggttgagactgccactgatgttgctcatcttagttaagatgtttaattgtcgctttcatttcaatgcccattgtaatgaccgaaagatctataaagggtgaaaacctggagaacctagaaagtttccatctggcatctatatgccagaaacttggagggttctctgaaagataaaaacatgatggagagaaatcacagcaacttgtgtttcatgtcaagccaagggcaagcctgtccagcagggtctggaggctagggcactctgagttggggactctaagttgggggatcaatattctagaggaattccagagagcacataacttgctgaatataacttaggatggagacttgggcctcagtgtgctactgtcagccaacacttacttcagatggtgtgctgaatcgagtggcaacaaggacagcaaattgacgaaggggaacactgagcaaacaaacagcaatatggaactaaagtcttgtcaaggtcccttccatctgtagctcccttctcatgtcatgtaggacagagggttctctgatctggcaaaatgtgcctagcaacattaatctcatttcttgtccttgtgctggaagcactctcccaggccctttgttcagccagctacttctagtcttttttttttttccacttaaatatcatctcctcagagagactggctcccatttaaagtagcccccctcctttattctgtatcagtatccacttttcttcatagcactcattacaatttgtaattacttaatttgttagtggtctgtcttctccactgcattgtagtaagctccatgagggcagggatcttgtctgacttgttcactgatatatcctcaaaacacagaatatagtgggtgttcaataatgagtaagcattagtagaaaacaagcaggacaaaatggattatgtttaatattgtcaaggtgtaatatatagtgaagataaaattgtcatgattgaatatgcactattggaatatatgaaacaaatagttttagaaatttaagtagaaatcgtcaaaaccacaatcatggtgagatactttaatatttatcttttagtccttgacagaaaaataaagatacagagcatttgcataatataatttagcttgatttaacatttataatagagttcattgtgagagtacacattcaaatgtatgtgtatggaagttgctctcattaaaatgagaaagaagatattatcattgatataaaggagatttaaatattacaagtgaatagtcttatgattccatgctaataattgctttgtaaatagatgatttcctagcaaaataaaaataacaaaattaactgtgaccatgaagaagcaaaagataaagaactacccctctccaaaaaatgaagactcagactttttctggatgagttttcccaaacctttaatggatcaaatcattcctatattgtttcatctgttttagtctagaaaagcaacaggaagcttcctaggttattttatgaatgaaacaggtataactcttatgccaaaatttacagatgtagcacacaaaagaaaactgcagacacacttcacttaggaatgttgaatcatgaatcctatataaaacattagcacttgtggactttgttcaagaatgcaagaatattttaatattggcaaatatattaataacattcaataattaataggcagggggaaatatcatcatggcagtaaatattaaaaggatttgatagaatcccagttctatccctgattcaaaatgaaacaaaataacaacagaaaatttgtagaaaactaaaactagagaaatacatccttaatttaataaagggtatctatcttacaccagcagccaacattatacttcattatgaaatattagcacattcccattaaagtcaggaatgactcaagaacgcccattattatggttattaatcaacatagtttaaacatttctaggcaatacagtgaaagaagaaaaataattcaggtgttaatattgtaaagaaaggagacaaagtcatctatatttagtgataatattattgtctatctggaatgaaactgaagaacaatgagaactaacgagagttaactaagggaggaagaaaatatatgtataaaaatcaatagctctcttacataccatcaatccactagaaaatgtggtgaaatggattatgttcacaaaacaacaaaatatatatgatgcctgggaataaatgtactaagaaaagtgcagggcctatctgaatacaatgataaaccttattcagggacataaaaagagacttgaatgaacagagaaacaaaactacttaggtgaaaaaattttgtaacattatcaattctctccaaatgagtctacatttaattgaattcatgcctagcacgtgggacacacaataaatgatttttgaatgaatgataaataagtgaacataattaccataaaatttagaattttttttgacttgacaaaacgattttaaggttcatctaaaaaattctcagagctgaaaataaaatttgatagtagagacaatgaaaggattaccagatcagttattaaaacataatgacataagataggccgggtgcagtggcttacggaggcctagacaggtggatcacgataccagcctgggaaacatggtgaaaccccgtctctactaaaaatacaaaaattagttgagcgtgatggtgcatgcctgtaatctcagctactcgggaggccaaggcacaagaatcacttgaaccaggaaggcggaggttgcagtgagctgagattgcgccattgcactccagcctgggcaacagagcgatactctgtctcaaaaaaaaaataaaagaaaagataaaataaacaataacattagtattggcacatgaatagataggttggtggaacagaatagaaagtcaagaagcagatctatgactataaggatatagtaaggatttagaatgtgatgatgttatcttaagtataacagaaaaggatggatttaataaagggccttatgactgctggaaaaatcgtatccctactccacaacacactccaaaatatactccaggtgtattaaatatttaaatttaaaaagtacaaccatgaaaatgttgggagtattagagtatagaatgcctttatagaggtaaaaataataaaggaagagattgatagatttaattacatataacattttaagcttctgagcttcccaaacaccataaaaaagtaaggataaccaattaccttgaaaaaaatattttaaatatgtggcagattaagagttaagttctctactatgcaacacaatatgaaatatgtaagctcactgattatgaaagttgcaaattaaaacaaaagatattttgttttattttggccatcaaattggcaaataataaaaaatggagaggtgtcagaaaactggcacttgcctgtactactggtagaagtgtattttagggttgccctgctggagggtaatttggacatactcaagagccaccatgccttaagaatttatcttaagtaatttttcatgaatatttgcaaatatataaatataaagcttcagtgataatcattgcaagctaacgataatgtaatgataatcattgcagtgttctttataacatcaataaattgtaaacagcctaaatgttttcctatggagaaattgctaactgagttataatagagccatataatggaattctgtgacattattaaagatagttttgggaaatatttaatgctatggacaaatctgtgttatcctcttctctcatgtaggagggaattgtgtaaataagactaaaaaccagttctttaaaatagtgagaaagaaggataaggaaggttttactgtatgtaaggccttgatttttgtcaatatatatgtaagccaacatattttccaagactttctgtgatgggatctgatttagttggaatacatactgttttcagctcatcagttgattaggcctcttaatgccatttgtcagaggcaagtttactattgtaaatcagcttacaacaatggcatgtgtcagcctatagcttaagcatttgtaaatttaacactttttcagtttcacaacaaaattgcattctgattattaatgatgcttaagctgttatgagatgaaagtatatctgttagctatttgacattctataattaatttaagcaaaggtaattaccattcaagggtcattgaaagtgataaatgctttatatgttgggattaataattttacttcttcttaagggtcctcatattttgtgcttgcaaatggacatatcctgcccaacagtgaaaatgctcatggccaatctctggaagaagattccgcattggaagctttgctgaattttttctttccaacaagtaagttcttgtttgatttttttccccctctaatgttcttgttttgaaaacagtaattaaatgtttaggaagcagtgtggtgtaatggcactggagtgggacagagctgagtttgaatcctggctctgctctttggcttaggcaagacaatctctctgaacctcagtgccctcatctttgaaatgaagatatttaccacaaagaattatgaggatgaactgagataatattcataaggcatttcataaatgtttgttactgtttataaaatacttttccttcgcaaatatctaatctttcacaatttgcctgaatggcattgcctgaaattcagtcactgacccagtattgtgaaattgatgtcttctgtggcattagtgagggtactgtgtgactgatgttatggaatatgccagatgttttcccatctgttttaatgatagaaatcccaggtttcaagtctcactgtctttttgtgattctgtatataatgtgtttatcaagcacattatgacccctgagaattattaaccacaaataaacacgtttcattttgtatagcatgtggtgccctttcaaggagaagcttcatataaattggaatatgtgaagtacaaagataaagctcttatgaaaaatcatgcagaatttattctaacaaaatttgatatactctataagcacaaaattatatctgttctttgattccaggcctttccactgaattctttagtgaacttgaaaaaatctctttatgtttctttatacttgttacattaagtttaaaacaggcatctaccaatgagaatagcaaaataaacaagttccttaaataaactcaaaatactgccatggtcaaattgagtaaataaaaaagaaatctgagacggtgttatgtcgtataggctgaaagaatggtttgagtgccacagttagtcgtaaacaacaactaatgatgatttaagctttaaagcttatgaaaacaacagatgtaaacagtcacatacttacctgtaataactacattgtacagacactgaagccacctgtaaaaatggttcgaaaaagatatctgcatttcccaaatatttctccaacctggtgcaggaaagtaagtcaaaatcaattatatgaagtaaaaattttgtccaacaaaataaaattgttccattttaatagaaacatctgacctaggttgattcaaaaagtgattaaatatttatcaaatgtacatactgtctttgaagacaataactacagcttcataaaacgtgaaatatttttaaccaatttatttcttcccccacataattgaaaataaacactcttaccacttaagcatgaaaaaaaagttcgttgttttgccattaggctactatttgtaaaatatttatctcttgcagattaaaatgacaaccttgatacacactggcagggaagcttgagagatcacctgatctttctccctttggacaaaattacatacttaaacctgacaaaaaaaaattgttctacctttttgattctttaaaattaccaatgcctcttagtaatttgagcttgaaagttaatttgtttttgtttttttgagacagagtctcgctctgttgccaggctggagtgcagtggcacaatctcggctcactgcaacctctgcttcccaggttcaagcaattctcctacctcagcctcctgagtagctgggactacaggcacatgccaccacgcccagctaatttttgtatttttagtagagacaggttttcaccatgttggccaggacggtctcgatctcttgacctcgtgatccgcccgccttgggctcccaaagtgctgggattacaggcactagccatcgtgcctggcctgtgttaattttaatatctagcataaagtccatcagatgcacttaaagcagaaattaacagatgatcttagagatcatatagtctagtctcttctacgatttaaccctaaccctaaccctctctttagcatttctgggaagtggtgtttgaacagtacccatggtgagaaactcagcatgcaaggaaatccatcccatctctgagtagtcctgactattgtcaccattttctgggtgtttgacacccagaactgaacacttgatgcaatccaacctaggggagaagagccgctctgggcctagcagaattgaagaacagattacttagaatatagaacaacaagtaggataaactctcatgtctaaaatgtttggaaaatgagtgtctaggccagttggtagtgcattaaatttttgatcttgcataagttactttgatcctttattatttttaaaacagagattgtaaaactcaatttgggagtttgttgcaaagattagtaataaagtgtgtaaagcaaggttcctggcccaaacaggtgcctaaataatggtagatattattatttttaccttggcttcagcaattgccaatctttaaaaaagaggaatgtagtaaaatatactgaggttaaaatttgcataaaacaattacgttgttctttgctgatgttgaagtgctttagtgattataaaatatcagttactacttttaagtttgtaattgttgatagtataagagattgaaccgaatctattctggccttaacacatagacatactgtggaggtttttctttttgaatgaaaatctaatattgtgctttttagtttgtatttgtttctcttataaagcaggatattatagaaaataagctatttgagcttgcaggtcttttagattcaggtatgtacgaatttattgcagttgcataatcttggtgttaatgccataaatcattgcctgtttaaaattatagagtcataatttaagggtgaaacgaagaatcttaaaatatattatagtgccaatatgataagtgttcacaaaaagtaggtcaatgccagtgtatcacttactttagtcactagcagcaaactatgtaatttttacttagttctgtggcttagtaacgttaagccggaggatatatgtgggatcattttaacaagggattagttttaaaagcatttgacttgttgttatttagttccttctgtgttatatttgcatcatcaccactcagcacatgatttattgtccttttaaactatcttaccaaagattttttaacaacttgtaattttctgcaattcacctagatttgaaaatgtgatattaaataacttagtggtaacttttagcttaagtcttattttcttttagcacccatcattagctgtatatgccattaaatgtttgcttttcttctttgtcttccagtaattatttaattagggaaagtggtaactaaccatgctgaattctctttcttaaatttctgtttttaaaagcttgcaatctgagggaaaatcaggtggcaaagccttgtaatgagctgcaagatcttagtgagagtgaatgtttgagacacaaatgctgtttttcatcatcggggaccacgagcttcaaatgttttgctccatttagagatggtaagttattcctctttcatttatttctattttttaatattaaataaacagatcgcagtggcataagttcatatttggatttcctagcttaatacttaaatgggactcccagtcctagagcggtgctccttagaaggtcctgaggtggtcatgactctggtcaggagcagtttttgcttagcctttggatggtgactttggtaatacaaaaattagtctcacattttcttttgctttagtcactctctgtgttttgtccaaaagtttccaggctctatggaaccctcaatggctgagagaagataccggttgggcatgccttagcttacttctctttgcccagcttttcctcctaggtagaattcttcccatttgtcttgtcttcatctcagtatgtaacagtagacttgaatgtttcttgttaaggtctgcttattagtttttctttattgggtattttttgagatagcatctcactctgttacccaggctggagtacagtggtgacgtgatcacagctgactgcagcctcgacatccggggctcaagtgatccacccgcctcagcttcctgagtagttgggactacagacgtgcaccagcaagcccgactaatttttagtttttttgtagagacaaggtctccctaggcttcccaggctggtctccaactcttgggttccagcagttcttctgcctcggcctcccaaagtgctggaatttataggtgtgagccaccacaccgagtcttgttctatagtttttgaattaggttcttctgaatatttttttctttacaaagttttgagaactacaccatctgtttttgctaccttcatttggatattggggatgtatttccagttgctctcatgatgcatggatttgatatgatgaaacactaatactacaaaaaggatgcatgcaaaataatatcttaagttaatatagtccctattcaatttacggctttttgttgaatatgtagtattaatactggaaactaaaacctgatcgtgaatataatattacaattttaacactgtcacatgttatttgtaattcatttatcagtttggtctttatattatgtatgaagcaacatttggttcttgcagaggaaaaaatttaactgtgacttacaattccccaatcacattagaatgcattttccgatgaatataagactaaaatatgcttatttcacctgcacattcttgattccttgtttaatttaatattttgtaatttggaagtaaacctgcagcatctggttattcccagtctcccatccaagcactaaccaggctagaccttgcttagctcacaagatcagatgagatggggcacattcaggatggtgtgaccatagattaagaagctatttatttaccaagttaacggttcatagattaatgtgctccccaagtgctctaggatatacaacatatggccaagagaaaaagccaatttagggccagaggaagaaatatcgtatgcatcatagtaatcaatgatggtacaaaaaataggatcattttgttaaggcttcattaaggggtacatattgaaagtgtagccttcagttgtatttcaagaacatttcatgaactcctgttccttataaagtagcaaggatatttacctgtcacataagaatacctcctcatttcactttattaactgatagtttctttataaagactttatgaaagaacttggatttacttctcttgcttaagtcatgaaagtaacaggatataattaaaccaacagtgcctaaacagatgatgcaaatgtttgggcttggtgcgatcagccttatcctggtatgtctgcccatttattgccgctctcttttctggaggaggtaggtgaacataaacttttatttgctcgttgctaagtatacatgagtatttgtgtatagacatatttattaatacacttcagaaatacagggattatgtttgggttctttatgttgaaaatatggtagcttgggaaagacctaaaactagagttgccataatatgtttttaaaatgcatgttatcggccaggcacggtggctcacgcctgtaatcccagcactttgggaggccgaggcgggtggatcacttgaggtcaggagttcgagaccagtctgaccaacatggcgaaaccccgtttctattaaaaaaaaatacaaaattagccgggcatggtggtgcacgcctgtaatcccagctacttgggaggcttaggcaagagaattgcttgaacctgggaggcagaggttgcagtgagccaagatcccaccactgcactccagtctcagcaacaagagtgaaaatacgtctcaaaaataaaataaaatgcgtgttattttatttttccatagattttcttcttgcatagtatctgtacattcccttatgaaacaaacccacaattagaaggaaaaataaattagcaagcttggtgtgtgtgcagtgggggtggctattaactgcaaatcagaacagttcctggaagtgttagtttccattgagtcatctgccattggtctttaatgatcatctactattgggtcataaagccttgatctgtcttcaagccaattggaaaacaaatttcttcttagcatcttatacaaaatgccaatggactactagcatgatgcttccaagctttttttttttttttatagctccccacctatggggacagagtgggtatagaggtacagagcacagtcaggactagagtgaggtgagtgaagcacttagagcacaaagttaagggaagcactcactctcaggtttgtgcgcgtgcaaggtcagcattgtcactaccctgagaataagtacctccttaaattctctgataaagacaaggtgcctgttgaaggttaagcatgttttatgtttttattgaagttaatgtggaagtagtagttgagttaccagaatatggtttagatttcgcaagaagagttagactatatacactgccttactttggatgaagatcatcgaagtgattggcagtaggagtggaatttttggcccttccttcttctcttcaaaggttgattttgtattaaaaaaataaaccatgaataacaataaagtaacatttgctagaaattggtggctaggaatataccatgaaatttagagagtttctaggattataagtttggtatgataacttcattatggtccctgtgttatacctctgcaaaggaattttatgggggtgttcaggtcccctggatttttttttctctaaaatgaaatccaaaggattgtcctctgatcctaatatatttccttctttctacatagtacagactgcttgagaaacaatgtgaataagtgtatatattggatactatacattttggtttactatgttttatttatttattttactattttgtgcaagagcagtatgctccttcggtcatcttgagctgactatcatgacccttggagcaggtagcagattcatcttgctgcttagctgaatttccaggaacaatgattgagagtggatgggcactttcagcctattgtggtaggctgattttagaggcaaggagaataattgtgtaagaacggggaaatcccatccctgatatcaaacaaggagccaagtgcaggacatagtcagcttttgcagggcaagatatctccttagaacgatttccttaactcactttctgttctccatttcaaagaataaagagatagataaaatattagggtaggtaaaataaataacccataaaagagaaatagacacagcagtaaaatcaatatgtggtggcttaaaaaggaaaagaaagaagccaaacacaattgtttgtccaaatcagaggtaccaaaagctattatgactatctgcagtaatgtgatttgggcctcttttggaagacctttttttgctctttcatcattggaagatacccttaagctcctcctcctgctaaatcctgtcttaaacattaaataactgagaattcctttaagaaagagctgtcatagctctcctcttggccttcggttgcaagccaaaacaaacaatgttttggtattccccaacctctgcaatttggacagtgccttttttaaggatcacctaaggagccagcaactgacaagagttggagagcttaaaaaatgagaagcactttgggaggccaaggcgggcagatcacgaggtcaggagttcgagaccagcctgaacaacatggtgaaaccctgtctctactaacaatacaaaaattagccgggcatggtgacatgcgcctgtaatcccagctactcaggaggctgaggcaggagaatcgcttgaacccgggaggcggcagttacagtgagccgagatcgcgtcactgcactctagcctgggcgacagagtgagactccatctcaaaaaaaacaaaaacaaaaacaaaaaaaaaatgtgaagcaatttgagttggtgggagaactaaaagcagtgtaggtgaaaagggtaattatgcaccagagccatatgtacttcagtttttggcgcctaagtcattttttccactattgaccatattcattgaatgtttgcctgtgccgggtataacggaggatacagaaatttttaagatataggccctacttttaaggagcttaaatccaccttaaaacaaatcccaagtatgacacatttaaattacaatataagacgaaaataattaaggactaaaatggatggtagcaataacttacaaaagttttgaagcagtggagatcaggttaagtaggagagggcacgtcaggcttcatggtagaggtgccgtttcaggtcgattttgaagggggacagatttggagtagatagagaggggtccttttcacagaattaattacattcagatggtggtcttctcactatagacaccttaatttatttcatttcctagcagatacagcttaattttgccactgaaaaaatctataactgaatctctagtttacttctacttgacttgagttctagtgtgatatgaacctggtacacagaggactcaagccggtttgaactggttgcacatacaaaaggaagcagagagcattagtgaaaaactttctaagaattcactaatagccatattaaactaacatataagatgtgtttttgaaatttattgtgtccttaaggttatgtaagatctatttttatcctcaatagggatcagaagcttcattaggtataagtgtcactagtaggcttaagcctttgcttagaggagaaggaaggaaaagatcaagtggatagcgacaaaaggaagcaggggagaggaattctaaggggaagagaaaaagggaggtggctgaattgttcttattaacagctattactgtagccagcgacagtagtctcaagtgcagtttctaattcagtttctaatctttatctgtttttagataaagtttaaatctgtgtgtatatgccatttaaacatctgtggattatatagtgatatgatacttgagtgtgtctgtagctttggtaaggtggaaaatttaaacataataccatgcctgttaaattcagatgaagtgcattttcatgttctttttcttcctatcagattgaatttgtaactttgaattaagacaaaattcagaactcagtctgaaaatgacaaaactgtgttttctttcaactaataaaatgtctatttttttttgaagattgtagatcatctgatacacagatgatgtaaaaagcacatcccccatacactttcaatgttgctacttgccagatggctgttactgaaaatttctacatttagaccaatcctgctgcatgattccctgtattataatctggttttcattatgccgctagtcttagtgccacttattttcttacaatgggaggtaaagaactgggaataaatgtgtcaaaaactgcctaaaaatcatcaccctttgaatttaaaaaatagacatttacattttcaatttcccatgtttgcatatctcattatactgtacaatataattagtaatgttattttgaaaagctttatgcagtaattagcgaactactggaaagtttgaagttcctaggattatatacatctggattcagaggaaggaaataaaatctataaattttgaaaagtatgactaggctgtaagaactttgataaaatatgtcagatgagaatgtgagcaaactggaactctgttctagcatgagtcactataggtttgaaattcgtataaagctggtacttcttggacgctgttcatggtaatttaattactgaaataataagagaacctcattatgcggatcatatgtctgaggtgttctcattgcaaggactccaaggacagcattttagagaactctggcatagtaggtactattaaaaagaacattctgttgccaagtaactaataacttcattgcaaaatgaagtgtccttttctcaattcccatttaatttgatctttttgtcacagagtacactgttgactgctcccttcttgaaattttccccccttggatttcattgttcctcttacaattttgatccatctcagtctgcttttctttgttcacccaaatgtggttgtttcccaaagccttactcccatttatcagaaaatgttagaaatatatagtaggaagaacattctaaaagatctgcgttctcattctgctttcaccacgtttcatggatgtgtttaaattctttgagtattgatttcctaacaaaattatagtagagacttgagttagataatttctatggtattttctgaccatagtattccaagagtctctgggtaaattactcttaattccaaatcctaaaatcttcacctctacctgttccatatttccagtcactctcgtgaattagatgttttatcagcacctcaaatgcaatatgtgaaaaagtgaactcattttctttttctcctaaattatctccccttgacccttctccattcctgtcagtgatttctttagtttcccaggctagaaccttagagtctttggtgactatttcttctcatttatcctcaatatataatcttttcacttactctccttgtcattgtgttctgttttgttttgttcttctttggaatgagtctggaatttgccccttctcccattttattgtaatttagtaccagccttgagtgccttttcccattctaggcaagtggcttcaggagaggagcaaaagggaactaagggtagcatctaaagagcgaaggcaggtttcagagctgagaggtcataatgatatatctaatccaagagattcttataggagagacaccatctgagatggggccgcaagtggggcttggaggatggctaggaggtgggttccagagaggtttcctggtacttaaataggaatgtatagcattggccttaggtaaagaggaattaaggatacctgccaaaccagtttggacatatacctggactcctaatctactctccctctaatccatcctgcaatgtcttgccagactcatcttcctgaaatatctctatttcatttcattatatcattcaagaacttctaatgctttcaagaatatctgtgttccaggccttgtgttaggtgctgtgaaggacaaagaagcaaatcagattatgctctgtgctctcaaggaacacacatagtctgtgtaataagggacatatacaagtatccaaagtagaaaatcattgtccgtaaaagaggtacagataaaaagttagcatgtagatggcttctacggaagtaaacttgggaatttttttttttaagacaagttctcgctctgtcacccaggttggagtgcagtggcacaatcacggcttactgcagcctcgacttcccgggctccggcaatcctcccacctcagcctcccgagtacccaggaccacaggcgtgtgccaccacacccaactaatttttgtatatttggtagaaacagagcttcaccatgttgcccaggctggtctcaaactcctgagctcaaggaatccacctgccttggcctcctgaagtgctgggattacagacagaagccaacatgcccagcccgtgggtcctgggcttttcttttcctgggagagttttattatagccttgctctcgttacttgttattggtctattcgggttttggatttcttcctggttcaatttagttaggttgtatgtgtctagacatttttccatttcttctagattttacaatttattggcatatagttgctcagagtagccactattgaacctttgaatttctatggtatcagttataatgtcttctttttcatctctgattttacttatttgggtattctctcttgtttgcttagtctggctaaaggtttgtgaattttatttatctttcttaaaaaaacaactttttgtttcattaatcttctgtattgttttcttcatttcaaatttatttatttctgctctcatctttattatttttattccctaattgtgggtttggtttgattttgcttttctggttatttaagatgtatcattaggctgtttatgtgaagtttttcctctttttgatataggtacttacagctataatcttccctctgagtactgcttatgttgtatcccaggttttggtatatcatgtttccattatcagttgtttcaagaagggttttaatttccttcttaatctcttcattgattcattggctattcaggaacatattgtttaatttccatgtgtttgtatagtttccaaatttccttttgttattgatttctagttttattccattttggtgagagaagatgcttgttatcgttttaatttttttcaatgttttagggcttgctttgtgacctaacacacagtctatccttgaggataattcatgtgctggggaaagaaagtgtattctgtagggttttctctaaatatctattaggtctatttggtgtacagtgcagattaagtctgatgttactttgttcattttctgtctggaatatctgtccagtgctgacagtagggtattgaagtcactagctattattgtacaggggtctatctctatctttagctctaatactatttgctttatgtatctgggtgttccagtgttgggtgcacatatatttactattgctatattccattgctgaattggcctctatcattatgtggtgactgtctttgtctcttcatatagttttgttttgaaatagatttttttctgatgtaagtatagctactccttccctttcttggtttccattggtatggaatgtcttttttcattcctttattttcagtctatatgtgtctttataggtgaagtgtgtttcttcatatagttttgttttgaaatatatttttttctgatgtaagtatagctactcctgctctgtcttggtttccattggtatggaatgtctttttttcattcctttattttcaagctatatgtgtctttataggtgaagtgtgtttcttgtaggcaactgatgattgggtctcatttttatatccattcagccactctgtgtcttttgattggagagtgtagtccttttatattcagtgttattattgataagtaatgacttacttctgccattttgttatttgttttctggtggccttgtggtcttctccttctactttccttccttcctgtcttcctctagtgaaggtgactttctctggtgatatgatttagtttcttgctttttattttctgtgaatccattgcatgttttttgattagaggttaccatgaggcttgcaaatactatctaataacctattattttaagctgataacaacataacattgtttgcataaacagtcaacaaaaaggcaactaataaaaactctacctcatagtttcatcccccaatttttaaactttttattgtttctgcttgtatcttatagtagtcgatgttttgaagagttgttgcagttaatatttttgattggttcgtctttagtctttccacttaagagtagtttatacaacaaagttactttgttataatattttgtggttttctgcatacttattattgccagtgagttttgtaccttcagatgatttattattggtcattaacacccttttctttctcattaaagtattcaatgtagcattttgtgtaggacagatctggtattgatgaaatcccccagcttttgtttgtctgggaaagtctttatttttcttcatgtctgaaggatattttcgttggacatactgctctagggtgaaagagtagtatgtcgtatttttccttcagcaccttatatatatcatgctactctctcctggccataaggtttctgctggtaactctgctgccagacttactggggctccattgtatgttatttgtttcttttctcttagtgcttttaggatctgttgttcatccttgacctttgggagtttgattattaaatgccttgaggtcatcttcttttggttaaatctgcctggtattctataaccttcttgtacttgtatattgatatctttgtctaggtttgggacatcctctgttattattgctttgaacaaacttttaccccatcaccttctctacctcctttttaaggccactaactcttagatttgtccttttgagactattttctttttttttcttttttttaattttttaaattttattattattatactttaagttttagggtacatgtgcacaatgtgcaggttagttacatatgtatacatgtgccatgctggtgcgctgcacccacattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtacatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttgcacaagggttgaactagtttacagtcccaccaacagtgtgaaagtgttcctatttctccacatcctctccagcacctgttgtttcctgactttttaatgattgccattctaactggcgtgagagggtatctcattgtggttttgatttgcatttctctgatggccagtgatggtgagcattttttcatgtgtttttttggctgcataaatgtcttcttttgagaagtgtctgttcatgccaagtcaatcctaagccaaaagaacaaagctggaggcatcacactacctgacttcaaactatactacaaggctacagtaaccaaaacagcatggtactggtatcaaaacagagacatagatcaatggaacagaacagagccctcagaagtaacactgcatatctataactatctgatctttgacaaacctgagaaaaacaagcaatggggaaagcattccctatttgataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatgacaacaaaagacaaaattgacaaatgggatctaattaaactaaagagcttctgcacagcaaaagaaactaccatcagtgtgaacaggcaacctacaaaatgggagaaaattttcgcaacctactcgtctgacaaagggctaatatccagaatctacaatgaactcaaacaaatttacaagaaaaaaacaaacaaccccatcaaaaagtgggtgaaggacatgaacagacaccttttgagactattttctagatgttgtaggcatgtttcattgttttcttttttcttttgtctcctctgaccattttaaatggtattaaatgtattttaaaatagcctatcttcaaggtcactaattgtttattctacttgatcaatctactattaaaaaactctgatgcattcttcagtatgtcagttgcatatttaactccagaatttctgcctgattatttttaattatttcaacctcttttttcagtttgtctgatataattatgcattccttgtctgagttctattgaatttctttgtgtttcctcaaaacagctattttgaattctttgtttgaaagataatatgtctttgtttctccaggattagtttctggtgccttatttagttcatttggtgatttcacattttcctggatggtgttgatgcttgtaaacatttgtctgtgtctgggcattgaagagttaggtattcattgtactgttcactatctgggcttgtttgtacctgtctttcttcggacagctttccaggtgttctaagggacttgagtgttgtgatctaagctgtattcacattaggaggcataccaaatccagtgacactgtgactcttgcagacttgtagaggtacttccttaatgatcttgggaaaaaaaccagaataattctctggattaccatcagaggctcttgttctcttcctttccttttccccaatcaaatggagtctctctctctggactgagctgcctggagctttggggtgaggtgacccaaacaccactgaggccaccaccactgggactgcactagggcagaccttaagccagcacagcactagggcttgtccaaggcccactgtaatcactacctggccactgcttatgtttgctcaaggcactgggactctacaaacagcaggtggcaaagccagccagccttgtatccttcccttcagggtggtgagttcttgcaggccccaggcatgtccaggggtactttccaggagccaagaactagagtcaaaaccttagaaatatacccagtgttctgttgtactgcaggtgatctggcactcaccacaagatgcagttcttcccactgtttcttcccctttctacaggcagaagagccctaccttgtggcaatcaacactgcaggcccacagggagtactgccaatgttctcttaaagcccaagggctcttctatcagcttgtggtgaatgttacctggcctgggactcaccacccttcagggcagtgggctcccctctggcccagggcaggtccagaaatgccatccaacagccaaggcccgggattgggtacactaaaagcccacttggtgctctactcccctgtgactaagctggtatttaaggttcgagacaaaattccctttacttttcccactgcttttctcaagcaggagtctctccctgtagccaccacagctgaggatgtgctgagtcacacctgaattcagcaagtctcaaagtctcacccaaggctcacagcataacctaggtatcactgcttgttattcagggcccaagggattttcagtcagcaggtcctgctaggactggatccttccctttaaggcagtagattgtctcctggttcagggtgtatctagaactgtcatctgtgagctagggcctgaaaaggggacctcttgactctgactggtgccctttcctactgtggctgagctgatatccaagatgtaagacaaagtctgctttactcttccctctcctcttctgaaacagatggaaggagtctcttttggagctatgagttttgcagcctggagttaggggaggggtggcaccaacattcccttagccaccctggctagtgtgtcagtaggttgtgtgcttcctaaatccactgactcttaacccagttcagcactaggactaacctaagaattgcagtccttgtggcctagactgcctttcaaggttattgagggccccagtgaacttttggcccacagtggcaaggcttgccagattcaatcctgactactgggatgggtggttcctctctggctaggtctggtttaaatagtccctctgtgagtgggcatcagctgggttcagcctggttttgctttctgctttgacagggcagctctgagttcaatgtaatgtctcacaattgctgcactctttctctcccaagtgcacagattctctttctgtgccatgcagccactgctgggggataggggagaggcggcattggcaattcaagactgtctttcctactctcttcagtacttctttcagctgtatgaagttaaaagcaagtactctgagtgctcccctgatttttggttcttatgaaggggctttttttttttttttcctgtgtagatagttgttaaatttggtgttcctatggcggggtaggatgggggtaattgttagagcattctgttctgccatcttgctctgtcctcaggccatttctttctttctgatcagttatgttaaactcttgaggttccaaaacacccaacaaatttcttcaatgatgtatgtttttgtttctttgagcccctagcctcagagttccctgatgtactcaatccggaggaattgcccctttactcatccttggccacccagtttcatgcccacatcttgaacattgttattcactcaaaactgaacctctgaatctctgaaatcttaaagttcaaaatcttactctttcaccataggttccttgtcctccagctttttctccgcttcatttttgctgaacctgttctttaacacattgaggcctccagtgtctttaactctctcttttctcccagtctgccatcttcctaacatcatctgctttttttttttttttatccagcctggatcccattgtctagtactttaatccattcttgtttccagtccccttgtttcatggaaactgaatccataccacttctctgctcttagatctaggctcctgggaatttttagaagaaaaaaaatgtcccacaactgtgtggatctgtgtcattaggaatttccagtgagctcacttaacatttccagccatgccactctactagatgtttacaaacaacatgccaccttgtcactctgagtctcataaagtgtatctgctgactgaaatgctcttatgcatctccccacctccacttttctttatctggctctctccactcaggctgcaggcctcatcttagaggtcacctcttctaggaagcttactccaaacctcctgcacacattgggtcaggcttcttcttgtctgccttctaccaacctctgattacctctacttgaactcatctcaacataatattgttagtctgtatatctactttcccttctaaattttaagctcctcaaggacaggtaccatatcttagtcatgtttatgtctctagtacttagaataatgtttatttaataaatgagcaaatatatcagtgagtgaatgagtgtgcaagaaattgaccttttccgtgtgcgtatgctggtcatgatatatgacactttatatgaaaagaagaaaaccacctctaggacactgaaaaatcatttcactcctactctctcccttgggcattttcattgcctattaggtagaatagctaaccttggatctcagtagtaaatgttagtcatatagccagttagtgatgaggctgaacaaaaaccaagtcctctgaaacctaggtcagttttgaaataataaggccgtgttgcttttttgttgttaattaaggtgaaatgtacatgaccaaatttaaaagaaaatctgtagataaagaaaacatagtcattttaattatataaagtaggctatattgacgtcacagcattagaaaaaagcataagttctcaatttcttctctaaaatcctgaaattcaaaaatttctgcaaacctaaaaattttgttgtattcattttgcgacaaacctggactgagattccttctagtcattatttaattcttagagtgaatattcatatatttgttgcagaaatgttactgtgtttgattatgagatgctaccccagaccccatgggaatgtcatgtagtattcaatatatcgtgtcatattacctttctaaatccaaaagaatctgcattctcaagcacatctggccccaaggtactgagaactgtgtagttgtttcagttattattttttttagactgtaggtaacaacatggcaacataaataggccatagataaatcatataaatatattttttgccttcattcaccatttcatttatgcccagagacatttttttgattaattgggaaagaatttgtttctttgccccacatttgtcttacctagtggagctcagtgtcaacccagtaatacagttttaggggagaaaagttagtattatttatcttcaaagtcataatttcaaaggcagacttatctttctctgggacccacatgctcagaaccttgtttttctgtacagctaagtagcacttacaaggtcctggtatcttcttctgcatgctacctagcttgagctgaggataggattatttatctgtcattacctcttcataatattgtgtgcaaatctttctttttttctgtctttggatttttctctttacctctgccatgaacattactattttttttggcttatgtttagttctttagaaagtaaaagccctataagcataaaaatcaacaaacatttccatttcctctgtgggatataaaaagtgataaggtaaggttccagtctgaaggaatttacaagctttgaggagagaatgagacaggttagtgtagtaggagagagattgtactttagatttaggtaggtctggatttgaatcctggttctactactgagtagtttggtgacctcggcaagttactttccgtcttggtgcctcagtttccccatatgaaaaatgggaatgatagaaatagtacctgcctcatcaagtcgttaatgaagattaaatgagatcatgcacgtgaagtgcttattatgcacataggaagtttatcatacctgctgctagccattattcacgaacactgcaaagtggtctaatggaaaaagcttgtactttagagtcaaacagacctacgtttaaattctagcatctccattactagttatctgtgaccttgggtgaattattttacctctttaagccccagattaatcatttgcaaaataggaaacacactatccaccttctagggtcgttatgaggatttaatgagaaagtatataaagcacttagtgaagttcttggcatgtggtagcctctcaagtgcccctttaccaactgtccacacaaatacaaggaggtacgagattgtatacccaatgacaacaggagtaagtgaaggtgctttgaaaattgtaaatgctaatacaatgtgagccattactgtgtagatttgaagttcataggaggaaggaatccctctaaactaggagtggaagagctggcttcctagacaagataatatctaaacttaccattaaagagtgggtaacattgatgtcagcacagggaagtgggagagcatttctgttacagatggtcacataatcaaaatgactgtatagagaataataatgatggttatgatgatcaatatgagcaagccaagtggaataatttctatcggatttattaaatctggtgagttaaaaatatcaggtgggaaagtatagttatctgggcaaatatttttttccttataaccctcccattgttattctatcactaatgagaaataaggtttcacttgaactttttatgttacagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaaggtaattgacaataggatataaagttgaagtgctcaatctctgattcttgttagctttatatttctaccatcatcttggcttgactgacacattttttttaaccacacaaatgtttggatcacaggagggccagcttctgaacacatatttatcactagagatattgagatggtaggaaaatggataagaaatgtgccaaattgttttgagtgccacattatatggtatacacaggtcagcttttcagagggagaaaagaagttgatcctgcccactctgactctatggctccctgatagacacccttggtaaataatgaaggccacagtcctcatatgtgaccacatcacatatccaggggaaggagaatggccttaggagtctgacagagatgagattgaatcctggatcttacctgttagtctcagctacctgttcttcaaacctgcacgatgtagtgttagaagaggttgagagagggatcccagaatcatacactagggactactttgtacaggttatacttgtacagggttatagatccctagccttgacttgggtctcctcctcccaaaataactgtgaagggacaagtaagaataaaatggttggtgagaaacaaagctgtatctcagggactgggagtaaggagacccaggtcattaactagtagtgtttccatgggcagtgaaattaacctttcagttccttgataccatcatagattttttgtgtaacttaaacaatataatgtatgtgaaaatgttttgaaaattgcaatgcagtacccaaaattatggtattaagttacagagaagcaaaggaatggaatgacaggccattgaattccgtgtcaggagactctggctttagtcccagttctgccattatttacagtgtttgcttgagcaagtcctttaactttcttgggcttcatttcaccaatcttcagaatgagaaggttgatttgatgaataggaaaagtgatttatctcagaagaaaaaaaagaaaatctttatataaggtatcatatatatatatgggatacatatttacttaaggtaacacataaatatgtattactataatgcctgtgtattattattcatataaatatattaccttgtattagtttaatgcaatacatgtgtgcatatgtacacatgtacacacacatatatacatatgtaacattataactagactaacaaaacttggtttctgtggaccattcactgagacatggaagttaactttgttattcagaaattatctctgtaatgatatttgctctaatctgttttatatgtatgcctcacagtaacagaagatgatgtactggcaaactgaaaatacataagttaatcataacattcactatatagaatttgataattttgttgcagggacttcttttatgacaaagtgcgatatgtgaataccagccttttcaagttgtttaaccctactttacttttctcccatagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcatcaaacc

SEQ ID NO: 5136 - DNA, 19849 bp, human
caaatgttttgctccatttagagatggtaagttattcctctttcatttatttctattttttaatattaaataaacagatcgcagtggcataagttcatatttggatttcctagcttaatacttaaatgggactcccagtcctagagcggtgctccttagaaggtcctgaggtggtcatgactctggtcaggagcagtttttgcttagcctttggatggtgactttggtaatacaaaaattagtctcacattttcttttgctttagtcactctctgtgttttgtccaaaagtttccaggctctatggaaccctcaatggctgagagaagataccggttgggcatgccttagcttacttctctttgcccagcttttcctcctaggtagaattcttcccatttgtcttgtcttcatctcagtatgtaacagtagacttgaatgtttcttgttaaggtctgcttattagtttttctttattgggtattttttgagatagcatctcactctgttacccaggctggagtacagtggtgacgtgatcacagctgactgcagcctcgacatccggggctcaagtgatccacccgcctcagcttcctgagtagttgggactacagacgtgcaccagcaagcccgactaatttttagtttttttgtagagacaaggtctccctaggcttcccaggctggtctccaactcttgggttccagcagttcttctgcctcggcctcccaaagtgctggaatttataggtgtgagccaccacaccgagtcttgttctatagtttttgaattaggttcttctgaatatttttttctttacaaagttttgagaactacaccatctgtttttgctaccttcatttggatattggggatgtatttccagttgctctcatgatgcatggatttgatatgatgaaacactaatactacaaaaaggatgcatgcaaaataatatcttaagttaatatagtccctattcaatttacggctttttgttgaatatgtagtattaatactggaaactaaaacctgatcgtgaatataatattacaattttaacactgtcacatgttatttgtaattcatttatcagtttggtctttatattatgtatgaagcaacatttggttcttgcagaggaaaaaatttaactgtgacttacaattccccaatcacattagaatgcattttccgatgaatataagactaaaatatgcttatttcacctgcacattcttgattccttgtttaatttaatattttgtaatttggaagtaaacctgcagcatctggttattcccagtctcccatccaagcactaaccaggctagaccttgcttagctcacaagatcagatgagatggggcacattcaggatggtgtgaccatagattaagaagctatttatttaccaagttaacggttcatagattaatgtgctccccaagtgctctaggatatacaacatatggccaagagaaaaagccaatttagggccagaggaagaaatatcgtatgcatcatagtaatcaatgatggtacaaaaaataggatcattttgttaaggcttcattaaggggtacatattgaaagtgtagccttcagttgtatttcaagaacatttcatgaactcctgttccttataaagtagcaaggatatttacctgtcacataagaatacctcctcatttcactttattaactgatagtttctttataaagactttatgaaagaacttggatttacttctcttgcttaagtcatgaaagtaacaggatataattaaaccaacagtgcctaaacagatgatgcaaatgtttgggcttggtgcgatcagccttatcctggtatgtctgcccatttattgccgctctcttttctggaggaggtaggtgaacataaacttttatttgctcgttgctaagtatacatgagtatttgtgtatagacatatttattaatacacttcagaaatacagggattatgtttgggttctttatgttgaaaatatggtagcttgggaaagacctaaaactagagttgccataatatgtttttaaaatgcatgttatcggccaggcacggtggctcacgcctgtaatcccagcactttgggaggccgaggcgggtggatcacttgaggtcaggagttcgagaccagtctgaccaacatggcgaaaccccgtttctattaaaaaaaaatacaaaattagccgggcatggtggtgcacgcctgtaatcccagctacttgggaggcttaggcaagagaattgcttgaacctgggaggcagaggttgcagtgagccaagatcccaccactgcactccagtctcagcaacaagagtgaaaatacgtctcaaaaataaaataaaatgcgtgttattttatttttccatagattttcttcttgcatagtatctgtacattcccttatgaaacaaacccacaattagaaggaaaaataaattagcaagcttggtgtgtgtgcagtgggggtggctattaactgcaaatcagaacagttcctggaagtgttagtttccattgagtcatctgccattggtctttaatgatcatctactattgggtcataaagccttgatctgtcttcaagccaattggaaaacaaatttcttcttagcatcttatacaaaatgccaatggactactagcatgatgcttccaagctttttttttttttttatagctccccacctatggggacagagtgggtatagaggtacagagcacagtcaggactagagtgaggtgagtgaagcacttagagcacaaagttaagggaagcactcactctcaggtttgtgcgcgtgcaaggtcagcattgtcactaccctgagaataagtacctccttaaattctctgataaagacaaggtgcctgttgaaggttaagcatgttttatgtttttattgaagttaatgtggaagtagtagttgagttaccagaatatggtttagatttcgcaagaagagttagactatatacactgccttactttggatgaagatcatcgaagtgattggcagtaggagtggaatttttggcccttccttcttctcttcaaaggttgattttgtattaaaaaaataaaccatgaataacaataaagtaacatttgctagaaattggtggctaggaatataccatgaaatttagagagtttctaggattataagtttggtatgataacttcattatggtccctgtgttatacctctgcaaaggaattttatgggggtgttcaggtcccctggatttttttttctctaaaatgaaatccaaaggattgtcctctgatcctaatatatttccttctttctacatagtacagactgcttgagaaacaatgtgaataagtgtatatattggatactatacattttggtttactatgttttatttatttattttactattttgtgcaagagcagtatgctccttcggtcatcttgagctgactatcatgacccttggagcaggtagcagattcatcttgctgcttagctgaatttccaggaacaatgattgagagtggatgggcactttcagcctattgtggtaggctgattttagaggcaaggagaataattgtgtaagaacggggaaatcccatccctgatatcaaacaaggagccaagtgcaggacatagtcagcttttgcagggcaagatatctccttagaacgatttccttaactcactttctgttctccatttcaaagaataaagagatagataaaatattagggtaggtaaaataaataacccataaaagagaaatagacacagcagtaaaatcaatatgtggtggcttaaaaaggaaaagaaagaagccaaacacaattgtttgtccaaatcagaggtaccaaaagctattatgactatctgcagtaatgtgatttgggcctcttttggaagacctttttttgctctttcatcattggaagatacccttaagctcctcctcctgctaaatcctgtcttaaacattaaataactgagaattcctttaagaaagagctgtcatagctctcctcttggccttcggttgcaagccaaaacaaacaatgttttggtattccccaacctctgcaatttggacagtgccttttttaaggatcacctaaggagccagcaactgacaagagttggagagcttaaaaaatgagaagcactttgggaggccaaggcgggcagatcacgaggtcaggagttcgagaccagcctgaacaacatggtgaaaccctgtctctactaacaatacaaaaattagccgggcatggtgacatgcgcctgtaatcccagctactcaggaggctgaggcaggagaatcgcttgaacccgggaggcggcagttacagtgagccgagatcgcgtcactgcactctagcctgggcgacagagtgagactccatctcaaaaaaaacaaaaacaaaaacaaaaaaaaaatgtgaagcaatttgagttggtgggagaactaaaagcagtgtaggtgaaaagggtaattatgcaccagagccatatgtacttcagtttttggcgcctaagtcattttttccactattgaccatattcattgaatgtttgcctgtgccgggtataacggaggatacagaaatttttaagatataggccctacttttaaggagcttaaatccaccttaaaacaaatcccaagtatgacacatttaaattacaatataagacgaaaataattaaggactaaaatggatggtagcaataacttacaaaagttttgaagcagtggagatcaggttaagtaggagagggcacgtcaggcttcatggtagaggtgccgtttcaggtcgattttgaagggggacagatttggagtagatagagaggggtccttttcacagaattaattacattcagatggtggtcttctcactatagacaccttaatttatttcatttcctagcagatacagcttaattttgccactgaaaaaatctataactgaatctctagtttacttctacttgacttgagttctagtgtgatatgaacctggtacacagaggactcaagccggtttgaactggttgcacatacaaaaggaagcagagagcattagtgaaaaactttctaagaattcactaatagccatattaaactaacatataagatgtgtttttgaaatttattgtgtccttaaggttatgtaagatctatttttatcctcaatagggatcagaagcttcattaggtataagtgtcactagtaggcttaagcctttgcttagaggagaaggaaggaaaagatcaagtggatagcgacaaaaggaagcaggggagaggaattctaaggggaagagaaaaagggaggtggctgaattgttcttattaacagctattactgtagccagcgacagtagtctcaagtgcagtttctaattcagtttctaatctttatctgtttttagataaagtttaaatctgtgtgtatatgccatttaaacatctgtggattatatagtgatatgatacttgagtgtgtctgtagctttggtaaggtggaaaatttaaacataataccatgcctgttaaattcagatgaagtgcattttcatgttctttttcttcctatcagattgaatttgtaactttgaattaagacaaaattcagaactcagtctgaaaatgacaaaactgtgttttctttcaactaataaaatgtctatttttttttgaagattgtagatcatctgatacacagatgatgtaaaaagcacatcccccatacactttcaatgttgctacttgccagatggctgttactgaaaatttctacatttagaccaatcctgctgcatgattccctgtattataatctggttttcattatgccgctagtcttagtgccacttattttcttacaatgggaggtaaagaactgggaataaatgtgtcaaaaactgcctaaaaatcatcaccctttgaatttaaaaaatagacatttacattttcaatttcccatgtttgcatatctcattatactgtacaatataattagtaatgttattttgaaaagctttatgcagtaattagcgaactactggaaagtttgaagttcctaggattatatacatctggattcagaggaaggaaataaaatctataaattttgaaaagtatgactaggctgtaagaactttgataaaatatgtcagatgagaatgtgagcaaactggaactctgttctagcatgagtcactataggtttgaaattcgtataaagctggtacttcttggacgctgttcatggtaatttaattactgaaataataagagaacctcattatgcggatcatatgtctgaggtgttctcattgcaaggactccaaggacagcattttagagaactctggcatagtaggtactattaaaaagaacattctgttgccaagtaactaataacttcattgcaaaatgaagtgtccttttctcaattcccatttaatttgatctttttgtcacagagtacactgttgactgctcccttcttgaaattttccccccttggatttcattgttcctcttacaattttgatccatctcagtctgcttttctttgttcacccaaatgtggttgtttcccaaagccttactcccatttatcagaaaatgttagaaatatatagtaggaagaacattctaaaagatctgcgttctcattctgctttcaccacgtttcatggatgtgtttaaattctttgagtattgatttcctaacaaaattatagtagagacttgagttagataatttctatggtattttctgaccatagtattccaagagtctctgggtaaattactcttaattccaaatcctaaaatcttcacctctacctgttccatatttccagtcactctcgtgaattagatgttttatcagcacctcaaatgcaatatgtgaaaaagtgaactcattttctttttctcctaaattatctccccttgacccttctccattcctgtcagtgatttctttagtttcccaggctagaaccttagagtctttggtgactatttcttctcatttatcctcaatatataatcttttcacttactctccttgtcattgtgttctgttttgttttgttcttctttggaatgagtctggaatttgccccttctcccattttattgtaatttagtaccagccttgagtgccttttcccattctaggcaagtggcttcaggagaggagcaaaagggaactaagggtagcatctaaagagcgaaggcaggtttcagagctgagaggtcataatgatatatctaatccaagagattcttataggagagacaccatctgagatggggccgcaagtggggcttggaggatggctaggaggtgggttccagagaggtttcctggtacttaaataggaatgtatagcattggccttaggtaaagaggaattaaggatacctgccaaaccagtttggacatatacctggactcctaatctactctccctctaatccatcctgcaatgtcttgccagactcatcttcctgaaatatctctatttcatttcattatatcattcaagaacttctaatgctttcaagaatatctgtgttccaggccttgtgttaggtgctgtgaaggacaaagaagcaaatcagattatgctctgtgctctcaaggaacacacatagtctgtgtaataagggacatatacaagtatccaaagtagaaaatcattgtccgtaaaagaggtacagataaaaagttagcatgtagatggcttctacggaagtaaacttgggaatttttttttttaagacaagttctcgctctgtcacccaggttggagtgcagtggcacaatcacggcttactgcagcctcgacttcccgggctccggcaatcctcccacctcagcctcccgagtacccaggaccacaggcgtgtgccaccacacccaactaatttttgtatatttggtagaaacagagcttcaccatgttgcccaggctggtctcaaactcctgagctcaaggaatccacctgccttggcctcctgaagtgctgggattacagacagaagccaacatgcccagcccgtgggtcctgggcttttcttttcctgggagagttttattatagccttgctctcgttacttgttattggtctattcgggttttggatttcttcctggttcaatttagttaggttgtatgtgtctagacatttttccatttcttctagattttacaatttattggcatatagttgctcagagtagccactattgaacctttgaatttctatggtatcagttataatgtcttctttttcatctctgattttacttatttgggtattctctcttgtttgcttagtctggctaaaggtttgtgaattttatttatctttcttaaaaaaacaactttttgtttcattaatcttctgtattgttttcttcatttcaaatttatttatttctgctctcatctttattatttttattccctaattgtgggtttggtttgattttgcttttctggttatttaagatgtatcattaggctgtttatgtgaagtttttcctctttttgatataggtacttacagctataatcttccctctgagtactgcttatgttgtatcccaggttttggtatatcatgtttccattatcagttgtttcaagaagggttttaatttccttcttaatctcttcattgattcattggctattcaggaacatattgtttaatttccatgtgtttgtatagtttccaaatttccttttgttattgatttctagttttattccattttggtgagagaagatgcttgttatcgttttaatttttttcaatgttttagggcttgctttgtgacctaacacacagtctatccttgaggataattcatgtgctggggaaagaaagtgtattctgtagggttttctctaaatatctattaggtctatttggtgtacagtgcagattaagtctgatgttactttgttcattttctgtctggaatatctgtccagtgctgacagtagggtattgaagtcactagctattattgtacaggggtctatctctatctttagctctaatactatttgctttatgtatctgggtgttccagtgttgggtgcacatatatttactattgctatattccattgctgaattggcctctatcattatgtggtgactgtctttgtctcttcatatagttttgttttgaaatagatttttttctgatgtaagtatagctactccttccctttcttggtttccattggtatggaatgtcttttttcattcctttattttcagtctatatgtgtctttataggtgaagtgtgtttcttcatatagttttgttttgaaatatatttttttctgatgtaagtatagctactcctgctctgtcttggtttccattggtatggaatgtctttttttcattcctttattttcaagctatatgtgtctttataggtgaagtgtgtttcttgtaggcaactgatgattgggtctcatttttatatccattcagccactctgtgtcttttgattggagagtgtagtccttttatattcagtgttattattgataagtaatgacttacttctgccattttgttatttgttttctggtggccttgtggtcttctccttctactttccttccttcctgtcttcctctagtgaaggtgactttctctggtgatatgatttagtttcttgctttttattttctgtgaatccattgcatgttttttgattagaggttaccatgaggcttgcaaatactatctaataacctattattttaagctgataacaacataacattgtttgcataaacagtcaacaaaaaggcaactaataaaaactctacctcatagtttcatcccccaatttttaaactttttattgtttctgcttgtatcttatagtagtcgatgttttgaagagttgttgcagttaatatttttgattggttcgtctttagtctttccacttaagagtagtttatacaacaaagttactttgttataatattttgtggttttctgcatacttattattgccagtgagttttgtaccttcagatgatttattattggtcattaacacccttttctttctcattaaagtattcaatgtagcattttgtgtaggacagatctggtattgatgaaatcccccagcttttgtttgtctgggaaagtctttatttttcttcatgtctgaaggatattttcgttggacatactgctctagggtgaaagagtagtatgtcgtatttttccttcagcaccttatatatatcatgctactctctcctggccataaggtttctgctggtaactctgctgccagacttactggggctccattgtatgttatttgtttcttttctcttagtgcttttaggatctgttgttcatccttgacctttgggagtttgattattaaatgccttgaggtcatcttcttttggttaaatctgcctggtattctataaccttcttgtacttgtatattgatatctttgtctaggtttgggacatcctctgttattattgctttgaacaaacttttaccccatcaccttctctacctcctttttaaggccactaactcttagatttgtccttttgagactattttctttttttttcttttttttaattttttaaattttattattattatactttaagttttagggtacatgtgcacaatgtgcaggttagttacatatgtatacatgtgccatgctggtgcgctgcacccacattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtacatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttgcacaagggttgaactagtttacagtcccaccaacagtgtgaaagtgttcctatttctccacatcctctccagcacctgttgtttcctgactttttaatgattgccattctaactggcgtgagagggtatctcattgtggttttgatttgcatttctctgatggccagtgatggtgagcattttttcatgtgtttttttggctgcataaatgtcttcttttgagaagtgtctgttcatgccaagtcaatcctaagccaaaagaacaaagctggaggcatcacactacctgacttcaaactatactacaaggctacagtaaccaaaacagcatggtactggtatcaaaacagagacatagatcaatggaacagaacagagccctcagaagtaacactgcatatctataactatctgatctttgacaaacctgagaaaaacaagcaatggggaaagcattccctatttgataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatgacaacaaaagacaaaattgacaaatgggatctaattaaactaaagagcttctgcacagcaaaagaaactaccatcagtgtgaacaggcaacctacaaaatgggagaaaattttcgcaacctactcgtctgacaaagggctaatatccagaatctacaatgaactcaaacaaatttacaagaaaaaaacaaacaaccccatcaaaaagtgggtgaaggacatgaacagacaccttttgagactattttctagatgttgtaggcatgtttcattgttttcttttttcttttgtctcctctgaccattttaaatggtattaaatgtattttaaaatagcctatcttcaaggtcactaattgtttattctacttgatcaatctactattaaaaaactctgatgcattcttcagtatgtcagttgcatatttaactccagaatttctgcctgattatttttaattatttcaacctcttttttcagtttgtctgatataattatgcattccttgtctgagttctattgaatttctttgtgtttcctcaaaacagctattttgaattctttgtttgaaagataatatgtctttgtttctccaggattagtttctggtgccttatttagttcatttggtgatttcacattttcctggatggtgttgatgcttgtaaacatttgtctgtgtctgggcattgaagagttaggtattcattgtactgttcactatctgggcttgtttgtacctgtctttcttcggacagctttccaggtgttctaagggacttgagtgttgtgatctaagctgtattcacattaggaggcataccaaatccagtgacactgtgactcttgcagacttgtagaggtacttccttaatgatcttgggaaaaaaaccagaataattctctggattaccatcagaggctcttgttctcttcctttccttttccccaatcaaatggagtctctctctctggactgagctgcctggagctttggggtgaggtgacccaaacaccactgaggccaccaccactgggactgcactagggcagaccttaagccagcacagcactagggcttgtccaaggcccactgtaatcactacctggccactgcttatgtttgctcaaggcactgggactctacaaacagcaggtggcaaagccagccagccttgtatccttcccttcagggtggtgagttcttgcaggccccaggcatgtccaggggtactttccaggagccaagaactagagtcaaaaccttagaaatatacccagtgttctgttgtactgcaggtgatctggcactcaccacaagatgcagttcttcccactgtttcttcccctttctacaggcagaagagccctaccttgtggcaatcaacactgcaggcccacagggagtactgccaatgttctcttaaagcccaagggctcttctatcagcttgtggtgaatgttacctggcctgggactcaccacccttcagggcagtgggctcccctctggcccagggcaggtccagaaatgccatccaacagccaaggcccgggattgggtacactaaaagcccacttggtgctctactcccctgtgactaagctggtatttaaggttcgagacaaaattccctttacttttcccactgcttttctcaagcaggagtctctccctgtagccaccacagctgaggatgtgctgagtcacacctgaattcagcaagtctcaaagtctcacccaaggctcacagcataacctaggtatcactgcttgttattcagggcccaagggattttcagtcagcaggtcctgctaggactggatccttccctttaaggcagtagattgtctcctggttcagggtgtatctagaactgtcatctgtgagctagggcctgaaaaggggacctcttgactctgactggtgccctttcctactgtggctgagctgatatccaagatgtaagacaaagtctgctttactcttccctctcctcttctgaaacagatggaaggagtctcttttggagctatgagttttgcagcctggagttaggggaggggtggcaccaacattcccttagccaccctggctagtgtgtcagtaggttgtgtgcttcctaaatccactgactcttaacccagttcagcactaggactaacctaagaattgcagtccttgtggcctagactgcctttcaaggttattgagggccccagtgaacttttggcccacagtggcaaggcttgccagattcaatcctgactactgggatgggtggttcctctctggctaggtctggtttaaatagtccctctgtgagtgggcatcagctgggttcagcctggttttgctttctgctttgacagggcagctctgagttcaatgtaatgtctcacaattgctgcactctttctctcccaagtgcacagattctctttctgtgccatgcagccactgctgggggataggggagaggcggcattggcaattcaagactgtctttcctactctcttcagtacttctttcagctgtatgaagttaaaagcaagtactctgagtgctcccctgatttttggttcttatgaaggggctttttttttttttttcctgtgtagatagttgttaaatttggtgttcctatggcggggtaggatgggggtaattgttagagcattctgttctgccatcttgctctgtcctcaggccatttctttctttctgatcagttatgttaaactcttgaggttccaaaacacccaacaaatttcttcaatgatgtatgtttttgtttctttgagcccctagcctcagagttccctgatgtactcaatccggaggaattgcccctttactcatccttggccacccagtttcatgcccacatcttgaacattgttattcactcaaaactgaacctctgaatctctgaaatcttaaagttcaaaatcttactctttcaccataggttccttgtcctccagctttttctccgcttcatttttgctgaacctgttctttaacacattgaggcctccagtgtctttaactctctcttttctcccagtctgccatcttcctaacatcatctgctttttttttttttttatccagcctggatcccattgtctagtactttaatccattcttgtttccagtccccttgtttcatggaaactgaatccataccacttctctgctcttagatctaggctcctgggaatttttagaagaaaaaaaatgtcccacaactgtgtggatctgtgtcattaggaatttccagtgagctcacttaacatttccagccatgccactctactagatgtttacaaacaacatgccaccttgtcactctgagtctcataaagtgtatctgctgactgaaatgctcttatgcatctccccacctccacttttctttatctggctctctccactcaggctgcaggcctcatcttagaggtcacctcttctaggaagcttactccaaacctcctgcacacattgggtcaggcttcttcttgtctgccttctaccaacctctgattacctctacttgaactcatctcaacataatattgttagtctgtatatctactttcccttctaaattttaagctcctcaaggacaggtaccatatcttagtcatgtttatgtctctagtacttagaataatgtttatttaataaatgagcaaatatatcagtgagtgaatgagtgtgcaagaaattgaccttttccgtgtgcgtatgctggtcatgatatatgacactttatatgaaaagaagaaaaccacctctaggacactgaaaaatcatttcactcctactctctcccttgggcattttcattgcctattaggtagaatagctaaccttggatctcagtagtaaatgttagtcatatagccagttagtgatgaggctgaacaaaaaccaagtcctctgaaacctaggtcagttttgaaataataaggccgtgttgcttttttgttgttaattaaggtgaaatgtacatgaccaaatttaaaagaaaatctgtagataaagaaaacatagtcattttaattatataaagtaggctatattgacgtcacagcattagaaaaaagcataagttctcaatttcttctctaaaatcctgaaattcaaaaatttctgcaaacctaaaaattttgttgtattcattttgcgacaaacctggactgagattccttctagtcattatttaattcttagagtgaatattcatatatttgttgcagaaatgttactgtgtttgattatgagatgctaccccagaccccatgggaatgtcatgtagtattcaatatatcgtgtcatattacctttctaaatccaaaagaatctgcattctcaagcacatctggccccaaggtactgagaactgtgtagttgtttcagttattattttttttagactgtaggtaacaacatggcaacataaataggccatagataaatcatataaatatattttttgccttcattcaccatttcatttatgcccagagacatttttttgattaattgggaaagaatttgtttctttgccccacatttgtcttacctagtggagctcagtgtcaacccagtaatacagttttaggggagaaaagttagtattatttatcttcaaagtcataatttcaaaggcagacttatctttctctgggacccacatgctcagaaccttgtttttctgtacagctaagtagcacttacaaggtcctggtatcttcttctgcatgctacctagcttgagctgaggataggattatttatctgtcattacctcttcataatattgtgtgcaaatctttctttttttctgtctttggatttttctctttacctctgccatgaacattactattttttttggcttatgtttagttctttagaaagtaaaagccctataagcataaaaatcaacaaacatttccatttcctctgtgggatataaaaagtgataaggtaaggttccagtctgaaggaatttacaagctttgaggagagaatgagacaggttagtgtagtaggagagagattgtactttagatttaggtaggtctggatttgaatcctggttctactactgagtagtttggtgacctcggcaagttactttccgtcttggtgcctcagtttccccatatgaaaaatgggaatgatagaaatagtacctgcctcatcaagtcgttaatgaagattaaatgagatcatgcacgtgaagtgcttattatgcacataggaagtttatcatacctgctgctagccattattcacgaacactgcaaagtggtctaatggaaaaagcttgtactttagagtcaaacagacctacgtttaaattctagcatctccattactagttatctgtgaccttgggtgaattattttacctctttaagccccagattaatcatttgcaaaataggaaacacactatccaccttctagggtcgttatgaggatttaatgagaaagtatataaagcacttagtgaagttcttggcatgtggtagcctctcaagtgcccctttaccaactgtccacacaaatacaaggaggtacgagattgtatacccaatgacaacaggagtaagtgaaggtgctttgaaaattgtaaatgctaatacaatgtgagccattactgtgtagatttgaagttcataggaggaaggaatccctctaaactaggagtggaagagctggcttcctagacaagataatatctaaacttaccattaaagagtgggtaacattgatgtcagcacagggaagtgggagagcatttctgttacagatggtcacataatcaaaatgactgtatagagaataataatgatggttatgatgatcaatatgagcaagccaagtggaataatttctatcggatttattaaatctggtgagttaaaaatatcaggtgggaaagtatagttatctgggcaaatatttttttccttataaccctcccattgttattctatcactaatgagaaataaggtttcacttgaactttttatgttacagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaaggtaattgacaataggatataaagttgaagtgctcaatctctgattcttgttagctttatatttctaccatcatcttggcttgactgacacattttttttaaccacacaaatgtttggatcacaggagggccagcttctgaacacatatttatcactagagatattgagatggtaggaaaatggataagaaatgtgccaaattgttttgagtgccacattatatggtatacacaggtcagcttttcagagggagaaaagaagttgatcctgcccactctgactctatggctccctgatagacacccttggtaaataatgaaggccacagtcctcatatgtgaccacatcacatatccaggggaaggagaatggccttaggagtctgacagagatgagattgaatcctggatcttacctgttagtctcagctacctgttcttcaaacctgcacgatgtagtgttagaagaggttgagagagggatcccagaatcatacactagggactactttgtacaggttatacttgtacagggttatagatccctagccttgacttgggtctcctcctcccaaaataactgtgaagggacaagtaagaataaaatggttggtgagaaacaaagctgtatctcagggactgggagtaaggagacccaggtcattaactagtagtgtttccatgggcagtgaaattaacctttcagttccttgataccatcatagattttttgtgtaacttaaacaatataatgtatgtgaaaatgttttgaaaattgcaatgcagtacccaaaattatggtattaagttacagagaagcaaaggaatggaatgacaggccattgaattccgtgtcaggagactctggctttagtcccagttctgccattatttacagtgtttgcttgagcaagtcctttaactttcttgggcttcatttcaccaatcttcagaatgagaaggttgatttgatgaataggaaaagtgatttatctcagaagaaaaaaaagaaaatctttatataaggtatcatatatatatatgggatacatatttacttaaggtaacacataaatatgtattactataatgcctgtgtattattattcatataaatatattaccttgtattagtttaatgcaatacatgtgtgcatatgtacacatgtacacacacatatatacatatgtaacattataactagactaacaaaacttggtttctgtggaccattcactgagacatggaagttaactttgttattcagaaattatctctgtaatgatatttgctctaatctgttttatatgtatgcctcacagtaacagaagatgatgtactggcaaactgaaaatacataagttaatcataacattcactatatagaatttgataattttgttgcagggacttcttttatgacaaagtgcgatatgtgaataccagccttttcaagttgtttaaccctactttacttttctcccatagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcatcaaa

SEQ ID NO: 5137 - DNA, 519 bp, human
atattactactttagcactgattgggtctcagttatttgtgtgttatcatgcatgtatttaattgagcagctactacatgcaaggagctgtgagaaatgaacatgaggccaagatattgaccttgccctcaaggaatttacagtcttgtcagagagataatccatacccacaaacaccgtaaaaagtagacagaattaagaagtatgagagctacacagagaacatgacgggaattcaaagaaagtactactcctttctttcagtgaagggtccagagtggctctgaggttcattttgaacatgacgggaattcaaagaaagtactacacctttcttgcagtgaagggtccagagtggctctgaggttcattttgaacatgacgggaattcaaagaaagtactacacctttcttgcagtgaagggtccagagtggctctgaggttcattttgtacatgaagagatgagaaaggacaatctaagtggaagatacaggagaaacacggaaacaaacaaaag
